United States Patent 10,463,711 (NUTRITIVE POLYPEPTIDES AND FORMULATIONS THEREOF, AND METHODS OF PRODUCTION AND USE THEREOF) - sequence listing, part 4

SEQ ID NO: 23184 - protein, 367 aa, Escherichia coli STEC_EH250; identical to SEQ ID NO: 5789

SEQ ID NO: 23185 - protein, 200 aa, Escherichia coli STEC_EH250; identical to SEQ ID NO: 6363

SEQ ID NO: 23186 - protein, 274 aa, Escherichia coli STEC_EH250; identical to SEQ ID NO: 6362

SEQ ID NO: 23187 - protein, 250 aa, Escherichia coli STEC_EH250; identical to SEQ ID NO: 6361

SEQ ID NO: 23188 - protein, 862 aa, Escherichia coli STEC_EH250; identical to SEQ ID NO: 14926

SEQ ID NO: 23189 - protein, 518 aa, Escherichia coli STEC_EH250; identical to SEQ ID NO: 6358

SEQ ID NO: 23190 - protein, 432 aa, Escherichia coli STEC_EH250; identical to SEQ ID NO: 5727

SEQ ID NO: 23191 - protein, 359 aa, Escherichia coli STEC_EH250; identical to SEQ ID NO: 5847

SEQ ID NO: 23192 - protein, 834 aa, Escherichia coli STEC_EH250; identical to SEQ ID NO: 7680

SEQ ID NO: 23193 - protein, 249 aa, Escherichia coli STEC_EH250
MRYLNTKNIIAAGVLLSCMSSIAWGAIIPDRTRIIMNESDKGEALKLTNQSKNLPYLAQTWIEDTKGNKSRDFIVTVPPMVRLNPSEQIQIRMITQEKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVTPFSYANTQFKNVPSTFQVGYINDFGGLIFYEINCPVVNNICNISVANRDQ

SEQ ID NO: 23194 - protein, 199 aa, Escherichia coli STEC_EH250; identical to SEQ ID NO: 8009

SEQ ID NO: 23195 - protein, 838 aa, Escherichia coli STEC_EH250; identical to SEQ ID NO: 6399

SEQ ID NO: 23196 - protein, 678 aa, Escherichia coli STEC_EH250; identical to SEQ ID NO: 6398

SEQ ID NO: 23197 - protein, 793 aa, Escherichia coli STEC_EH250; identical to SEQ ID NO: 6397

SEQ ID NO: 23198 - protein, 654 aa, Escherichia coli STEC_EH250; identical to SEQ ID NO: 6425

SEQ ID NO: 23199 - protein, 377 aa, Escherichia coli STEC_EH250
MLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 23200 - protein, 675 aa, Escherichia coli STEC_EH250
MAAEDVMIVSASGYEKKLTNAAASVSVISQEELQSSQYHDLAEALRAVEGVDVESGTGKTGGLEISIRGMPASYTLILIDGVRQGGSGDVTPNGFSAMNTGFMPPLAAIERIEVIRGPMSTLYGSDAMGGVVNIITKKNADKWLSSVNAGLNLQESNKWGNSSQFNFWSSGPLVDDSVSLQIRGSTQQRQGSSVTSLSDTSATRIPYPTESQNYNLGARIDWKATEQDVLWFDMDTTRQRYDNQDGQLGSLTGGYDHTLRYERNKISAGYDHTFTFGTWKSYLNWNETENKGRELVRSVLKSDKWGLAGKPRELKESNLILNSLLLTPLGESHLLTVGGEYQSSSMKDGVVLASTGETFRQKSWSVFAEDEWHLTDVLALTAGSRYEHHDQFGGHFSPRAYLVWDVTDAWTLKGGVTTGYKAPTMGQLHKGISGVSGQGRTNLLGNPELKPEESVSYEAGVYYDNLSGLNANITGFITDFSNKIVSYSIDDNTNSYTNSGKARLHGVEFAGTLPLWSEDVTLSLNYTWTQSEQRDGDNKGDPLSYTPEHMVNAKLNWQITEEVASWLGARYRGKTPRFTRNYSSLSAVQKKVYDEKGEYLKAWTVVDAGLSWKVTDALTLNAAVNNLLNKDYSDVSLYSADKSTLYAGDYFQTGSSTTGYVIPERNYWMSLNYQF

SEQ ID NO: 23201 - protein, 614 aa, Escherichia coli STEC_EH250
MIKKYWFLMVYSVTAFSVWAQDTPLDTLVVTANRFQEPLSTVLAPVTIVTREDIDRWQVSSVNDVLRRLPGVAISQHGGEGQLSTIFVRGTNSNHTLVLIDGVRLNLAGVSGDADLSQFPVALVQRIEYIRGPRSAIYGSDAIGGVINIITSRENTGTEISAGWGSNSYQHYDISTHQQLGENTRVTLLGDYTYTRGFDAVAYGSTGMQPQSDRDGFLSKTFYGKLEHNLSDTWSGFVRGYGYNNRTKYDAWYSPGSPLIDTRKLYSQSWDAGLRYAGETLQSQLVSSYSHSKDYNYDPHYGRYDTSANLDDMKQYNLQWTNSVTVGHGNVGAGIDRQKQSTTPGTGYLPKGYDQRNTGIYLTGLQKLGDFTLEGAVRNDDNSQFERHTTWQSSAGWEFIEGYRFIASYGTAFKAPNLGQLYGMYGNPNLAPEKSKQWEGAFEGLTGGVNWRISGYRNDISEMINYNPHTLRYYNDGKVHVKGIEATVNFDTGALTHTVSYDYTDARNALTDKPLERRPKLQVKYQLDWQVFDFDWGITYQYIGSRYDSDYSSWPYKSVKMGGVSLWDVAVAYPVTPHLIVRGKIANLFNKDYETGYGYQAAGREYILSGSYTF

SEQ ID NO: 23202 - protein, 272 aa, Escherichia coli STEC_EH250
MSKRNAVTTFFTNRVTKALGMTLALMMTCQSAMASLAADQTRYIFLGDKDALTITVTNNDKERTFGGQAWVDNIVEKDTRPTFVVTPSFFRVKPNGQQTLRIIMASDHLPKDKESVYWLNLQDIPPALEGSGIAVALRTKLKLFYRPKALLEGRKGAEEELSLQSRPDGRTMLVNTTPYIFAIGSLLDGNGKKIATDNETAQKLLMFMPGDEVQVKGNVVKVASLNDYGELQTWTINQKKTSASSGEKVSDSSVNLPDKADKADKADKADKK

SEQ ID NO: 23203 - protein, 800 aa, Escherichia coli STEC_EH250
MFFRRAALALAVSAAFASATGIAGEKLDMSFIQGGAGVNPEVWAALNGSYAPGRYLVDLSLNGKEAGKQILDVTPQDSNELCLTEAWLTKAGVYVSADYFREGYDATRQCWVLTKSPSVKVDFDVSTQSLALSIPQKGLVKMPENVDWDYGTSAFRVNYNANANTGRNNTSAFGSADLKANIGRWVVSSSATASGGDSGDNSTTINMFTATRAIRALSADLAVGKTSTGDSLLGSTGTYGASLSRNNSMKPGNLGYTPVFSGIANGPSRVTLTQNGRLLYSEMVPAGPFSITDVPLYTSGDVTMKVTGEDGREQTQVFPLAVMNGQLSPGEHEFNLAAGLPDDDSDMDGAVFAASYGYGLENLTLRTGLVFNQDWKGASAGMVVGLGWLGAVSVDGAYASAKYRDGSHSGNKVQLAWSKQLEPTNTSLRLSWSRRSEEYEDMSSFNPSEVYSQVNQGRRTKDEWSVGIGQPVGDLFSLSLSGWQRSYYPASVISAHRQQKDSGKERGVTGTLSTQVKGATLNLGWSGSRNSDGENNWSASASVSVPFTLFDRRYSSSTSVSTSKDGGTGFSTGVSGSLNDRFSYGLGGGRDSGGGVSSYLNASYSGDRAYLSGALNQSSSGGTSGSVSVSGSVLAVPAAKDIMFSRTTGDTVAVVNVKDTPGVKVTSGDGQTNSDGNLVVPLNSYDWNTVTIDAGTLPLSTELTNTSQKVVPTDKAVVWMPFDALKIKRYLLQVKQRDGEFVPGGTWARDSKNTPLGFVSNNGVLMINTVDAPGDITLGQCRIPAAKLQDTEKLQEITCE

SEQ ID NO: 23204 - protein, 208 aa, Escherichia coli STEC_EH250; identical to SEQ ID NO: 5717

SEQ ID NO: 23205 - protein, 462 aa, Escherichia coli STEC_EH250
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNCVFPDIVTMSVT

SEQ ID NO: 23206 - protein, 152 aa, Escherichia coli STEC_EH250; identical to SEQ ID NO: 23138

SEQ ID NO: 23207 - protein, 446 aa, Escherichia coli STEC_EH250 [sequence omitted]

SEQ ID NO: 23208 - protein, 656 aa, Escherichia coli STEC_EH250
MYMNVIRTVICTLIILPVGLQAATSHSSMAKDTITVVATGNQNTVFETPSMVSVITNDTAWSQNAVTSAGMLKGVAGLSQTGAGRTNGQTFNLRGYDKSGVLVLVDGVRQLSDMAKSSGTYLDPALIKRIEVVRGPNSSLYGSGGLGGVVDFRTADAADFLPPGETNGVSLWGNIASGDHSTGSGLTWFGKTGKTDALLSVIMRKRGNIYQSDGERAPNKEKPAALFAKGSVSITDSNKAGASLRLYQNNTTEPGNPTLTHGDNGLRDRKTAQNDVQFWYQYSPADNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSNPVNIIVGSRYDRYKSFNPRAGKLKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYHSDYFDWMLSYNRTESMDASSREWLGSGNPDTLISDISIPVGHGGVSAGWHAELSAAATHVKKGDPHQAGYALHSFSLSYKPVSVKGFEASVTLDNAFNKLAMNGKGVPLSGRTVSLYTRYQW

SEQ ID NO: 23209 - protein, 540 aa, Escherichia coli STEC_EH250
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKSNDASNPWRYVRAATATEISETSNPQSCTSAPQPSPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNSEPSTPADSVNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLI

SEQ ID NO: 23210 - protein, 774 aa, Escherichia coli STEC_EH250; identical to SEQ ID NO: 8932

SEQ ID NO: 23211 - protein, 368 aa, Escherichia coli STEC_EH250; identical to SEQ ID NO: 8795

SEQ ID NO: 23212 - protein, 646 aa, Escherichia coli STEC_EH250
MAASPGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDSNWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGILAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 23213 - protein, 87 aa, Escherichia coli STEC_EH250; identical to SEQ ID NO: 6040

SEQ ID NO: 23214 - protein, 170 aa, Escherichia coli STEC_H.1.8 [sequence omitted]

SEQ ID NO: 23215 - protein, 751 aa, Escherichia coli STEC_H.1.8
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKK

SEQ ID NO: 23216 - protein, 230 aa, Escherichia coli STEC_H.1.8; identical to SEQ ID NO: 7855

SEQ ID NO: 23217 - protein, 747 aa, Escherichia coli STEC_H.1.8
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVATCFNTYGCFWGAERQVVATATFRF

SEQ ID NO: 23218 - protein, 266 aa, Escherichia coli STEC_H.1.8; identical to SEQ ID NO: 5772

SEQ ID NO: 23219 - protein, 161 aa, Escherichia coli STEC_H.1.8; identical to SEQ ID NO: 5769

SEQ ID NO: 23220 - protein, 351 aa, Escherichia coli STEC_H.1.8; identical to SEQ ID NO: 5767

SEQ ID NO: 23221 - protein, 230 aa, Escherichia coli STEC_H.1.8; identical to SEQ ID NO: 6294

SEQ ID NO: 23222 - protein, 530 aa, Escherichia coli STEC_H.1.8
MGDGNTGSDIFDGVGFRGVRLYSSDNMYPDSQQGFAPTVRGIARTAAQLTIRQNGFIIYQSYVSPGAFEITDLHPTSPNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYATLGVGYNYDRDQHDVNWQLSGGVVGHENGITLSQPLGDTNVLIKAPGAGGVRIENQTGILTDWRGYAVMPYATVYRYNRIALDTNTMGNSIDVEKILAALCRRKARWFVPILIPA

SEQ ID NO: 23223 - protein, 365 aa, Escherichia coli STEC_H.1.8; identical to SEQ ID NO: 7931

SEQ ID NO: 23224 - protein, 746 aa, Escherichia coli STEC_H.1.8; identical to SEQ ID NO: 9223

SEQ ID NO: 23225 - protein, 193 aa, Escherichia coli STEC_H.1.8; identical to SEQ ID NO: 6300

SEQ ID NO: 23226 - protein, 243 aa, Escherichia coli STEC_H.1.8; identical to SEQ ID NO: 6463

SEQ ID NO: 23227 - protein, 816 aa, Escherichia coli STEC_H.1.8
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 23228 - protein, 430 aa, Escherichia coli STEC_H.1.8; identical to SEQ ID NO: 5758

SEQ ID NO: 23229 - protein, 760 aa, Escherichia coli STEC_H.1.8
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQSRNDSGIDASASIGSTWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 23230 - protein, 203 aa, Escherichia coli STEC_H.1.8; identical to SEQ ID NO: 6414

SEQ ID NO: 23231 - protein, 361 aa, Escherichia coli STEC_H.1.8; identical to SEQ ID NO: 7868

SEQ ID NO: 23232 - protein, 224 aa, Escherichia coli STEC_H.1.8; identical to SEQ ID NO: 7869

SEQ ID NO: 23233 - protein, 606 aa, Escherichia coli STEC_H.1.8; identical to SEQ ID NO: 23096

SEQ ID NO: 23234 - protein, 128 aa, Escherichia coli STEC_H.1.8; identical to SEQ ID NO: 7871

SEQ ID NO: 23235 - protein, 191 aa, Escherichia coli STEC_H.1.8; identical to SEQ ID NO: 5748

SEQ ID NO: 23236 - protein, 232 aa, Escherichia coli STEC_H.1.8; identical to SEQ ID NO: 5747

SEQ ID NO: 23237 - protein, 729 aa, Escherichia coli STEC_H.1.8
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGAVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 23238 - protein, 213 aa, Escherichia coli STEC_H.1.8; identical to SEQ ID NO: 5744

SEQ ID NO: 23239 - protein, 203 aa, Escherichia coli STEC_H.1.8; identical to SEQ ID NO: 6347

SEQ ID NO: 23240 - protein, 565 aa, Escherichia coli STEC_H.1.8; identical to SEQ ID NO: 6492

SEQ ID NO: 23241 - protein, 207 aa, Escherichia coli STEC_H.1.8; identical to SEQ ID NO: 5743

SEQ ID NO: 23242 - protein, 121 aa, Escherichia coli STEC_H.1.8; identical to SEQ ID NO: 9635

SEQ ID NO: 23243 - protein, 700 aa, Escherichia coli STEC_H.1.8; identical to SEQ ID NO: 7945

SEQ ID NO: 23244 - protein, 539 aa, Escherichia coli STEC_H.1.8; identical to SEQ ID NO: 6525

SEQ ID NO: 23245 - protein, 111 aa, Escherichia coli STEC_H.1.8; identical to SEQ ID NO: 8460

SEQ ID NO: 23246 - protein, 130 aa, Escherichia coli STEC_H.1.8; identical to SEQ ID NO: 7726

SEQ ID NO: 23247 - protein, 835 aa, Escherichia coli STEC_H.1.8
MRLRKKLLLPSLLVFISNRAVGGDYFDPSLLAAGIDGENIDLSVFSHPGGGIEGEQEVSVQVNDNFYTRKTLHFRNSGDKGLLPDFPAGFFDDLLAPEYRPVQKDTLLSSADFMSQTPYSSVTFNQGEGRVDIRVPQAFLGRAAQLRSSPDTWENGVPALLMDYSLTGNRNDSDSYSSRSLYASARLGLNVGPWRLRTSGNYSQYQSESRWWRSRTENTSFYSTWLERDISALRASLRIGEVSTGGMILDSVSFRGVRLYSNDDMLSSRLRNYSPTVKGFARTQAVVIITQNGRQVYQTNVPAGPFELNDFYISGYSGDLVVTVRESDGSEHSFIQPFSTLPEMKREGVSGFELSAGRYDNHGSEDYYNDPLFVYGAWSRGFGGGVTVFGETLQAGKYQSAGIGSTLSLGRVGAVSADISVSRAEKYDDIHTGQSYGLKYSKSQVETGTTVTLATYRYSTKDFYSFGDFVSRTEQARYVWENRLKNRMTLSLNQSLGSLGSVSLSASQQDYWTSGEVNRSFSLSHSFSWRDIYFSTTFSMDQMSGNRYGYDNNRQIDFYMSVPLSRLLGREEPTSSSVSWSATRTERQLRQTATLSGSVPDTRMRYRVGGNWGNGGAAEGQSASLTWNGDFTTASLGYTRSGGYRTTDFSLSGAAVAWSGGVAFGSNSVTDNGAIVVNTSGVSGIGTSAGGRTTWPGTALISSPQLYTENRIDLRTDGLPDDIVLAETSARTVPSRGAVVVLDYTVYRGGQVVFTLKRPDGSALPFGSVVSLDGMPSGKENTGIVGDEGRVYLAGVPEKGRLTVNSGGKQCHADFVLPQDRKKSGPVAEAVAVCR

SEQ ID NO: 23248 - protein, 234 aa, Escherichia coli STEC_H.1.8
MRIFSSAFILAGMLLCSYASAASFGPRESTLIFDGRQGSTSYRIDNSDARLPWLVQAWVEDINEERTDAFTSVPLVFRVEPSSTFTVRIVKKGTVPEDRETLYWAVSNSLPGGERSEQKTDGDKISAQLSLAYRFKVPMIYRPAALAGKPQQPESLQWHTAAGGKMTVRNPTPYVVQLNYVSVDGKRHQGKGVSWFISPEKSVTVDVSAGAGSRIKYGVVNDYGAVREYEGVVR

SEQ ID NO: 23249 - protein, 828 aa, Escherichia coli STEC_H.1.8; identical to SEQ ID NO: 6558

SEQ ID NO: 23250 - protein, 162 aa, Escherichia coli STEC_H.1.8; identical to SEQ ID NO: 6365

SEQ ID NO: 23251 - protein, 367 aa, Escherichia coli STEC_H.1.8; identical to SEQ ID NO: 5784

SEQ ID NO: 23252 - protein, 200 aa, Escherichia coli STEC_H.1.8; identical to SEQ ID NO: 6311

SEQ ID NO: 23253 - protein, 274 aa, Escherichia coli STEC_H.1.8; identical to SEQ ID NO: 8357

SEQ ID NO: 23254 - protein, 250 aa, Escherichia coli STEC_H.1.8; identical to SEQ ID NO: 6317

SEQ ID NO: 23255 - protein, 880 aa, Escherichia coli STEC_H.1.8; identical to SEQ ID NO: 6482

SEQ ID NO: 23256 - protein, 518 aa, Escherichia coli STEC_H.1.8; identical to SEQ ID NO: 6358

SEQ ID NO: 23257 - protein, 826 aa, Escherichia coli STEC_H.1.8; identical to SEQ ID NO: 8499

SEQ ID NO: 23258 - protein, 224 aa, Escherichia coli STEC_H.1.8; identical to SEQ ID NO: 6435

SEQ ID NO: 23259 - protein, 650 aa, Escherichia coli STEC_H.1.8; identical to SEQ ID NO: 9042

SEQ ID NO: 23260 - protein, 432 aa, Escherichia coli STEC_H.1.8; identical to SEQ ID NO: 5727

SEQ ID NO: 23261 - protein, 613 aa, Escherichia coli STEC_H.1.8; identical to SEQ ID NO: 13391

SEQ ID NO: 23262 - protein, 696 aa, Escherichia coli STEC_H.1.8; identical to SEQ ID NO: 9053

SEQ ID NO: 23263 - protein, 249 aa, Escherichia coli STEC_H.1.8; identical to SEQ ID NO: 6450

SEQ ID NO: 23264 - protein, 199 aa, Escherichia coli STEC_H.1.8; identical to SEQ ID NO: 7966

SEQ ID NO: 23265 - protein, 838 aa, Escherichia coli STEC_H.1.8
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSCAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWNYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 23266 - protein, 662 aa, Escherichia coli STEC_H.1.8; identical to SEQ ID NO: 8481

SEQ ID NO: 23267 - protein, 840 aa, Escherichia coli STEC_H.1.8
MHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDNRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 23268 - protein, 386 aa, Escherichia coli STEC_H.1.8; identical to SEQ ID NO: 7908

SEQ ID NO: 23269 - protein, 475 aa, Escherichia coli STEC_H.1.8; identical to SEQ ID NO: 9659

SEQ ID NO: 23270 - protein, 514 aa, Escherichia coli STEC_H.1.8; identical to SEQ ID NO: 9000

SEQ ID NO: 23271 - protein, 208 aa, Escherichia coli STEC_H.1.8; identical to SEQ ID NO: 5717

SEQ ID NO: 23272 - protein, 614 aa, Escherichia coli STEC_H.1.8; identical to SEQ ID NO: 7971

SEQ ID NO: 23273 - protein, 446 aa, Escherichia coli STEC_H.1.8; identical to SEQ ID NO: 8470

SEQ ID NO: 23274 - protein, 368 aa, Escherichia coli STEC_H.1.8; identical to SEQ ID NO: 7974

SEQ ID NO: 23275 - protein, 241 aa, Escherichia coli STEC_H.1.8
MSNKNVNVRKSQEITFCLLAGILMFMAMMVAGRAEAGVALGATRVIYPAGQKQVQLAVTNNDENSTYLIQSWVENADGVKDGRFIVTLPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 23276 - protein, 863 aa, Escherichia coli STEC_H.1.8; identical to SEQ ID NO: 9275

SEQ ID NO: 23277 - protein, 351 aa, Escherichia coli STEC_H.1.8
MIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLQSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 23278 - protein, 132 aa, Escherichia coli STEC_H.1.8
MDAVLSVQGASAPVRNKSFFPKFTRLKKYFSFRPSRLNMLRLARAVIPAAVLMMFFPQLAMAAGSSGQDLMASGNTTVKATFGKDSSVVKWVVLAEVLVGAVMYMMTKNVKFLAGFAIISVFIAVGMAVVGL

SEQ ID NO: 23279 - protein, 674 aa, Escherichia coli STEC_H.1.8
MDYSLTGNRNDSDSYSSRSLYASARLGLNVGPWRLRTSGNYSQYQSESRWWRSRTENTSFYSTWLERDISALRASLRIGEVSTGGMILDSVSFRGVRLYSNDDMLSSRLRNYSPTVKGFARTQAVVIITQNGRQVYQTNVPAGPFELNDFYISGYSGDLVVTVRESDGSEHSFIQPFSTLPEMKREGVSGFELSAGRYDNHGSEDYYNDPLFVYGAWSRGFGGGVTVFGETLQAGKYQSAGIGSTLSLGRVGAVSADISVSRAEKYDDIHTGQSYGLKYSKSQVETGTTVTLATYRYSTKDFYSFGDFVSRTEQARYVWENRLKNRMTLSLNQSLGSLGSVSLSASQQDYWTSGEVNRSFSLSHSFSWRDIYFSTTFSMDQMSGNRYGYDNNRQIDFYMSVPLSRLLGREEPTSSSVSWSATRTERQLRQTATLSGSVPDTRMRYRVGGNWGNGGAAEGQSASLTWNGDFTTASLGYTRSGGYRTTDFSLSGAAVAWSGGVAFGSNSVTDNGAIVVNTSGVSGIGTSAGGRTTWPGTALISSPQLYTENRIDLRTDGLPDDIVLAETSARTVPSRGAVVVLDYTVYRGGQVVFTLKRPDGSALPFGSVVSLDGMPSGKENTGIVGDEGRVYLAGVPEKGRLTVNSGGKQCHADFVLPQDRKKSGPVAEAVAVCR

SEQ ID NO: 23280 - protein, 230 aa, Escherichia coli STEC_MHI813
MDAVLSVQGASAPVKKKSFFSKFTRLNMLRLARAVIPAAVLMMFFPQLAMAAGSSGQDLMASGNTTVKATFGKDSSVVKWVVLAEVLVGAVMYMMTKNVQVLGRFCHHLCIYCCGYGRRWPLTGNKTMSGDENKLKKYRFPETLTNQSRWFGLPLDELIPAAICIGWGITTSKYLFGIGAAVLVYFGIKKLKKGRGSSWLRDLIYWYMPTDLLRGIFHNVPDSCFRQWIK

SEQ ID NO: 23281 - protein, 351 aa, Escherichia coli STEC_MHI813
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNMQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 23282 - protein, 229 aa, Escherichia coli STEC_MHI813
MTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPVQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 23283 - protein, 869 aa, Escherichia coli STEC_MHI813
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLISSAFPELAQQQNNKCIDLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 23284 - protein, 746 aa, Escherichia coli STEC_MHI813
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 23285 - protein, 193 aa, Escherichia coli STEC_MHI813; identical to SEQ ID NO: 6300

SEQ ID NO: 23286 - protein, 243 aa, Escherichia coli STEC_MHI813; identical to SEQ ID NO: 8524

SEQ ID NO: 23287 - protein, 819 aa, Escherichia coli STEC_MHI813
MDAVNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSLYGGMLLAGDDYRSGALGIGQNMLWLGALSFDVTWADSHFDTQQDEQGYSYRFNYSKQVDATNSTISLAAYRFSDRHFHSYANYIDHKYNDADAQDEKQTISLSFGQPITPLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKETWTEGAIGFKSLASRAGKDLNVIISDANGHFPPLGADVRQAEGGVSVGMVGENGHAWLSGVDENQQFTVHWGDQKTCAIHLPEHLEDVTKRLILPCH

SEQ ID NO: 23288 - protein, 430 aa, Escherichia coli STEC_MHI813; identical to SEQ ID NO: 5758

SEQ ID NO: 23289 - protein, 331 aa, Escherichia coli STEC_MHI813; identical to SEQ ID NO: 6551

SEQ ID NO: 23290 - protein, 760 aa, Escherichia coli STEC_MHI813
MENNRNFPARQFHSLTFFAGFCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGIAPSVAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTSNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 23291 - protein, 203 aa, Escherichia coli STEC_MHI813; identical to SEQ ID NO: 6414

SEQ ID NO: 23292 - protein, 361 aa, Escherichia coli STEC_MHI813; identical to SEQ ID NO: 11373

SEQ ID NO: 23293 - protein, 233 aa, Escherichia coli STEC_MHI813
MKTCITKGIVTVSLTAILLSCSSTWAAGKGGVGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 23294 - protein, 866 aa, Escherichia coli STEC_MHI813
MYRTHRQHSLLSSGGVPSFIGGLVVFVSAAFNAQAETWFDPAFFKDDPSMVADLSRFEKGQKITPGVYRVDIVLNQTIVDTRNVNFVELTPEKGIAACLTTESLDAMGVNTDAFPAFKQLDKQACAPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPINLLLPRSNDSYTSKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSTQGIPLRFGAIATLDGVQTNSGIIDDDGSLYMAGLPAKGTITVRWGEASDQICHISYQLTEQQINSAITRMDAICR

SEQ ID NO: 23295 - protein, 229 aa, Escherichia coli STEC_MHI813
MALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQCVKVAMRSVFKLFWRPEGLPGDPLEAYQQLRWTRNSQGVQLTNPTPYYINLIQVSVNGKALSNVGVVPPKSLRQTSWCQAIAPCHVAWRAINDYGGLSAKKEQNLP

SEQ ID NO: 23296 - protein, 229 aa, Escherichia coli STEC_MHI813
MKSVLLLLTVLFVQSVEAGIMPASSRMIYRDGDREKTLMLVNTNDYPVLVQSWVDNGEGSPEAASPPFVVLPPVFRLAARRTQGLRIIYNHDPLPQDRESAFWLNLYEMPPETPHQDPTHLTLAMNTQLKIFYRPKSVTMTPEEAMRKISWHLGNDGSSSYIELNNPTPLNISFTSISIGATKVQQESDMMIKPFSQRRYWLASNNVSGIVTATYLDDNGAQIKQQLAQ

SEQ ID NO: 23297 - protein, 840 aa, Escherichia coli STEC_MHI813
MNKSVVSISAAILVLLCQPVMGKEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAQELAPGITSQTQLSQLRLDLSVPQSQMISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGTVSRFSVPFSAVPESMRPGTSRYNVEVGKTQDSGDDSMFGDLTWQHGMTNTLTFNSGSRIADGYQALMLGGVYGSTLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSNDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGVTFGPYLGETFALVEAKGAEGAKVYNSSQLEINDSGYALVPAVTPYRYNRISLDPQGMDSDAELVDSEKQVAPVAGAAVKVVFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 23298 - protein, 240 aa, Escherichia coli STEC_MHI813
MDMEKIRMNIFAYLLVLVFSMSMSSSAFASVVMTGTRIIFPGDAKEKTIQLRNTSDQPYIINIHVEDERGSDKNVPFMPTPQTFRMEAAAGQALRLLYTGDNLPQDRESVFWFSFSQLPYLNKNDKSQNQLILALTNRVKIFYRPSSIVGKSSDAPKNLTYQVKHNRIEVTNPTGYYVVIRAAELLNNGKKVPLANSVMIAPQSTTEWTLRSGISVAPGAQIHLVTVNDYGVNVTSEHAL

SEQ ID NO: 23299 - protein, 236 aa, Escherichia coli STEC_MHI813
MFTRCYLNHNLMKSLPLLFVTLFSLHSEASIVITGTRVIYPAGEHSVSVKLNNNGKLPVLIQSWVDNGDPDKKPDDSQAPFIITPPINRVDPGKGQTLRVTFTDLPLPTDRESVFWLNVLEIPTRYEPKSNDNYLQVAFRTRIKLFYRPENLPGKSLEAPNTLIWKISSGQLMASNNSAWNVSLSSISVCGKKVEGKMVSPRGSEIFPLKVSPGMRVSFEAVNDYGAIMKKTATVQ

SEQ ID NO: 23300 - protein, 517 aa, Escherichia coli STEC_MHI813; identical to SEQ ID NO: 6817

SEQ ID NO: 23301 - protein, 191 aa, Escherichia coli STEC_MHI813; identical to SEQ ID NO: 5748

SEQ ID NO: 23302 - protein, 232 aa, Escherichia coli STEC_MHI813; identical to SEQ ID NO: 5747

SEQ ID NO: 23303 - protein, 729 aa, Escherichia coli STEC_MHI813
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWQVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQSSYALVDLFTRYQVTKNFSLQGNVNNLFDKTYDTNVEGSIVYGAPRNFSITGTYQF

SEQ ID NO: 23304 - protein, 213 aa, Escherichia coli STEC_MHI813; identical to SEQ ID NO: 5744

SEQ ID NO: 23305 - protein, 656 aa, Escherichia coli STEC_MHI813
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDDSITHYDDNNQSAFNWQVMGKYHFANEDTLALSYYDRTRFPTLKERYTTSKPAYNQIAIVNPQLKPERARGVDLTWNGAFTRDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGVEYTF

SEQ ID NO: 23306 - protein, 565 aa, Escherichia coli STEC_MHI813; identical to SEQ ID NO: 8529

SEQ ID NO: 23307 - protein, 207 aa, Escherichia coli STEC_MHI813; identical to SEQ ID NO: 5743

SEQ ID NO: 23308 - protein, 366 aa, Escherichia coli STEC_MHI813
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGVATYRNYDFFGLIEGLNFAAQYQGKNERTDNSHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLRPSLAYLKSKGKDLGRYGDQDMIEYIDVGATYFFNKNMSTYVDYKINLIDESDFTRAVDIRTDNIVATGITYQF

SEQ ID NO: 23309 - protein, 646 aa, Escherichia coli STEC_MHI813
MRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRAEGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGVNIAWRFE

SEQ ID NO: 23310 - protein, 539 aa, Escherichia coli STEC_MHI813; identical to SEQ ID NO: 6525

SEQ ID NO: 23311 - protein, 240 aa, Escherichia coli STEC_MHI813
MILLFTLWSFGSYAVQFVYRIDSRPPDVVFRDGFRSHGNNRNLQQHIRGDSCAAGSRDSAFIATTSDISETYNIARQYFSNSLFHGQLYRYRIRTNNVFYSLAPSVQLLRERGVTFSRFEEIMMREQSEIVADGRIPTENIAEAVQLNYERTTGIVSDGHGTTNSRFLNIPTDSNPGIIPNIPVPQVSVRQRINAFGSLITACFSLRGSRDEENGENVDVVTFYDARPVLKTLLVSTSIR

SEQ ID NO: 23312 - protein, 236 aa, Escherichia coli STEC_MHI813
MQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKDEVSVDIPHAATGDISFQTINDYGALTPRIKATMQ

SEQ ID NO: 23313 - protein, 111 aa, Escherichia coli STEC_MHI813
MKKQIEGMTMKKVLALVVAAAMGLSSAAFAAETATTPAPTATTTKAAPAKTTHHKKQHKAAPAQKAQAAKKHHKNAKAEQKAPEQKAQAAKKHAKKHSHQQPVKPAAQPAA

SEQ ID NO: 23314 - protein, 118 aa, Escherichia coli STEC_MHI813 [sequence omitted]

SEQ ID NO: 23315 - protein, 826 aa, Escherichia coli STEC_MHI813
MLRMTPLASAIVALLLGIEAYAAEETFDTHFMIGGMKDQQVANIRLDDNQPLPGQYDIDIYVNKQWRGKYEIIVKDNSQETCLSREVIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEVPPSVNVAINKQQGLSCTITFGKEIDESRNYICQ

SEQ ID NO: 23316 - protein, 224 aa, Escherichia coli STEC_MHI813
MKGLSSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPVGIAPVNKATFKKLLVNRSGNGLVIKNDSANWVTISDVKANNVKVNYETIMIAPLESQSVNVKSNNANNWYLTIIDDHGNYISDKI

SEQ ID NO: 23317 - protein, 631 aa, Escherichia coli STEC_MHI813
MVVTASSVEQNLKDAPASISVITQEDLQRKPVQNLKDVLKEVPGVQLTNEGDNRKGVSIRGLDSSYTLILVDGKRVNSHNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 23318 - protein, 89 aa, Escherichia coli STEC_MHI813; identical to SEQ ID NO: 6181

SEQ ID NO: 23319 - protein, 828 aa, Escherichia coli STEC_MHI813; identical to SEQ ID NO: 6558

SEQ ID NO: 23320 - protein, 162 aa, Escherichia coli STEC_MHI813; identical to SEQ ID NO: 5896

SEQ ID NO: 23321 - protein, 373 aa, Escherichia coli STEC_MHI813
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGYATYRNTDFFGLVDGLNFAVQYQGKNGSVSGEGMTNNGRGALRQNGDGVGGSITYDYEGFGIGAAVSSSKRTDDQNFGLNGYGERYLGNGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 23322 - protein, 200 aa, Escherichia coli STEC_MHI813; identical to SEQ ID NO: 7474

SEQ ID NO: 23323 - protein, 274 aa, Escherichia coli STEC_MHI813; identical to SEQ ID NO: 8543

SEQ ID NO: 23324 - protein, 250 aa, Escherichia coli STEC_MHI813
MTNLFCSAKKSTMLLALLLTTASLSAQASVTPDRTRLIFNESDKSISVTLRNNDPKMPYLAQSWMEDEQGNRISSPLTVLPPVQRIDSMMNGQVKVQGMPDINKLPADRESVFYFNVREIPPKSNKPNTLQIALQTRIKLFWRPKALENVSMKNPWQHKVTLTRSGQEFTVNNPTPYYVVISNASAQKNGNPAAGFSPMVISPKTSVPLKVKMDSVPVLSYVNDYGARMPLYFKCGGDTCQVDVEQSRKG

SEQ ID NO: 23325 - protein, 860 aa, Escherichia coli STEC_MHI813
MSGSYVNAWAEDEIQFDSRFLELKGDTKIDLKRFSSQGYVEPGKYNLQVQLNKQPLTEEYDIYWYASENDASKTYACLPPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQMGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDVTHSHTRLDKETAYGKGSLDGNSFRVSYSKDFDELNSRVTFAGYRFSEENFMTMSEYLDASDSEMVRTGNDKEMYTATYNQNFRDAGVSVYLNYTRHTYWDRDEQTNYNIMLSHYFNLGSIRNMSISMTGYRYEYDNQSDKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPMIQEQTQQVMPTEAPVSVSAN

SEQ ID NO: 23326 - protein, 518 aa, Escherichia coli STEC_MHI813
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVSQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 23327 - protein, 263 aa, Escherichia coli STEC_MHI813
MFKIRFKSRVLLINIFKLFLVSAFVLSNIAYSNDLFRADTRAPNQLRRVNGLLPRGQDDAYERGTPININLFDHVMGMPTGNTRYDDGYVSTTTTLNEAHNIGQNMFGGSNEYYIYVISPAPNMFDVNGVLGRYSPHPYENEVAALGGIPFSQIIGWYRVNFGVIETPMVRNRAYRSDLFHGLNIAPNEDGYRLAGFPDGHQAWREEPWRRYAPLQCSTDLRVISIITCHSIINGLSNKKLSDLKKKLLSVMALPVLLLIDDF

SEQ ID NO: 23328 - protein, 432 aa, Escherichia coli STEC_MHI813; identical to SEQ ID NO: 5727

SEQ ID NO: 23329 - protein, 567 aa, Escherichia coli STEC_MHI813; identical to SEQ ID NO: 8556

SEQ ID NO: 23330 - protein, 360 aa, Escherichia coli STEC_MHI813
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDNITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 23331 - protein, 240 aa, Escherichia coli STEC_MHI813
MKHILLFIFTVLLSLPSYGSVVIMGTRVIYPAEQKSINVRLNNGDSTPSLIQAWLDTGDPSSPPDSVMVPFIITPPVFRMEPLSGQTMRIMYTGEKLPADRESLFWLNVLDIPAKPSFAGKSEKAQGYNYLQFAVRSRIKFFFRPDGLPFSPDDAYKKVTWQLTGGDTLQASNPTPYFITFSTVSVGQGAQKVSSTQGGMAAPFSSVTFRLKQKVSPSGKVEWTVVNDNGGYQKGESVVK

SEQ ID NO: 23332 - protein, 822 aa, Escherichia coli STEC_MHI813
MLSVPLWAAEDAEFDPSFLSRTPGSSVIDVRRFTHGNPVPSGNYYSDIYLNGEWKGNAELSFRDMSSSQEESVLCVTPELLSILDVSPEAVAREPDTGNGRCMPFSAVVPDAKIRFDLSLLRLNVEIPQAMLVSRPRGYISPSQWQTGVPAAFVSYDVNHWRYRTPDMENNQSYLGLRAGFNAGGWAFRHRGTESWSDGHAEGYRSIETNLQHDIAMLRAQLTLGDFTTTGELMDSNSLRGIRLASDDRMLPGSLRGYAPVVRGMAGSNARVTVRQNGNIIYETTVPAGPFSISDLYPSGYGGDLTVTVTESDGQTRSFIVPFASVAQLVRPGFSRWQVAAGRYRYGNRTFSDTVFQGTLQYGLTNDITLNTGMSTAPHYLSGLGGVAFNTPLGAVATDITLARTTFPGSDTTHRGYSLHAGYSARIPETSTNVTLAAYRYSSRDFWSLRDAILTRNRDVINDSSVRSATGYRPRNQLQLTVNQSLGEGWGNLYLTGATYHYWGHTGTFNEYQAGYNNVWKKMSYQIGFSQTRRSGDYHHDNRFFFSFSLPLSDTGRTLLSTTVNVSDKNSNSIQSSISGVSGDDNQLSYGVSLNTQENGPTGYAVNGSYRSPVVTLQATAGNDSRHNRQISAGISGAIVAHPFGVTASNDLGDTFTVIHADGAGGAVINNAPGNRLDPWGNGIVPYVTPYEKNYISIDPTALAADVELSATEREIIPRANSTTMVTFTTKTGKAMLFDVKMPDGTPPPMAAEALTADGKSAGYIAQGGRLFVRDLDAEKGILRIVWGNGQNDSCVIHYSASGENARGNTAPVIHPATCMRE

SEQ ID NO: 23333 - protein, 686 aa, Escherichia coli STEC_MHI813
MFWRDITLSVWRKKTTCLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 23334 - protein, 199 aa, Escherichia coli STEC_MHI813
MIYDASRKEAALPVANKGAETPYLLQSWVDNIDGTSRAPFIITPPLFRLEAGDDSSLRIIKTADNLPENKESLFYINVRAIPAKKKSDDVNANELTLVFKTRIKMFYRPAHLKGLVNDAWKSLEFKRSDHSLNIYNPTEYYVVFAGLAVDKADLTSKIEYIAPGEHKQLPLPASGGKNVKWAAINDYGGSSGTETRPLQ

SEQ ID NO: 23335 - protein, 838 aa, Escherichia coli STEC_MHI813
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 23336 - protein, 678 aa, Escherichia coli STEC_MHI813
MVPSTFSRLKAARCLPVVLAALIFVGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDAIWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 23337 - protein, 386 aa, Escherichia coli STEC_MHI813
MVDDVPVAQVLQALAEQEKLNLVVSPDVSGTVSLHLTDVPWKQALQTIVKSAGLITRQEGNILSVHSVAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 23338 - protein, 660 aa, Escherichia coli STEC_MHI813
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLIDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 23339 - protein, 857 aa, Escherichia coli STEC_MHI813
MSRKTVSRTFSSFSISVVAVAVASTFSAHAGKFNPKFLEDVQGVGQHVDLTMFEKGQEQQLPGIYRVSVYVNEQRMETRTLEFKEATEAQRKAMGESLVPCLSRTQLAEMGVRVESFPALNLVPAEACVPFDEIIPQASSHFDFSEQKLVLSFPQAAMHQVARGTVPESLWDEGIPALLLDYSFSGSNSEYDSTGSSSSYVDDNGTVHHDDGKDTLKSDSYYLNLRSGLNLGAWRLRNYSTWSHSGGKAQWDNIGTSLSRAIIPFKAQLTMGDTATAGDIFDSVQMRGAMLASDEEMLPDSQRGFAPIVRGIAKSNAEVSVEQNGYVIYRTYVQPGAFEINDLYPTANSGDLTVIIKEADGSEQRFIQPFSSVPIFQREGHLKYSFAAGEYQAGNYDSGSPRFGQLDLIYGLPWGMTAYGGALISNNYNAFALGIGKNFGYIGAISIDVTQAKSELNNDRDSQGQSYRFLYSKSFESGTDFRLAGYRYSTSGFYTFQEATDVRSDADSDYNRYHKRSEIQGNLTQQLGAYGSVYLNLAQQDYWNDAGKQNTVSAGYNGRIGKVSYSIAYSWNKSPEWDDSDRLWSFNISVPLGRAWSNYRVTTDQDGRTNQQVGVSGTLLEDRNLSYSVQEGYASNGVGNSGNANVGYQGGSGNVNVGYSYGKDYRQLNYSVRGGVIVHSEGVTLSQPLGETMTLISVPGARNARVVNNGGVQVDWMGNAIVPYAMPYRENEISLRSDSLGDDVDVENAFQKVVPMRGAIVRARFDTRVGYRVLMTLLRSAGSPVPFGATATLITDKQNEVSSIVGEEGQLYISGMPEEGRVLIKWGNDASQQCVAPYKLSLELKQGGIIPVSANCQ

SEQ ID NO: 23340 - protein, 229 aa, Escherichia coli STEC_MHI813; identical to SEQ ID NO: 8572

SEQ ID NO: 23341 - protein, 219 aa, Escherichia coli STEC_MHI813
MYLLRLFFAVTLITQMSMAMAGIVVGGTRVIFYGDKPDTTISIFNKETNLPYLLQTWVDPFNKEDKSKPPFSVIPPVSRIEPQQEKILRILKTAGELPKDRESVFWLNVKNIPPSIDKKNTNVLEIAIKTRIKLFWRPAAVKIIPEQAIKNVKWSRQGNNLIVENPNPIHINVMSVTVDDKDVSLNMIRPFETLTLPIPAGVAGKSLVWRFINDYGAIS

SEQ ID NO: 23342 - protein, 208 aa, Escherichia coli STEC_MHI813; identical to SEQ ID NO: 5717

SEQ ID NO: 23343 - protein, 446 aa, Escherichia coli STEC_MHI813; identical to SEQ ID NO: 8576

SEQ ID NO: 23344 - protein, 237 aa, Escherichia coli STEC_MHI813; identical to SEQ ID NO: 6384

SEQ ID NO: 23345 - protein, 368 aa, Escherichia coli STEC_MHI813
MNKTITALAIMMASFAANASILPETPVPFKSGTGAIDNDTVYIGLGSAGTAWYKLDTQAKDKKWTALAAFPGGTRDQATSAFIDGNLYVFGGIGKNSKGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 23346 - protein, 241 aa, Escherichia coli STEC_MHI813; identical to SEQ ID NO: 6143

SEQ ID NO: 23347 - protein, 863 aa, Escherichia coli STEC_MHI813
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTSWSYNSSDRSSGSKNKWQHINTWLERDLIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 23348 - protein, 816 aa, Escherichia coli STEC_MHI813
MLRTTRWVAAIIFLYSFPGYAEETFDTHFMIGGMKGEKVSEYHFDNKQPLPGNYELDFYVNNQWRGKQDITIPESPVKPCLPKVLLTKLGVKTGNLNTEDNCILLDEAVHGGQYQWDISEHRLNLTVPQAYINELERGYVPPESWDRGIDAFYTSYNLSQYRSYDSNNNSHTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGVSNFDFIAGRSQIYGVKNQEDFLEANYIYGLNNLLTLYGGTILSDNYNAITLGNGWNTPLGAISFDATRSSSKLNNDTRHEGTSYQVAYNKYLLQTATHFSVAAWRYASQDYRTFSDHLYENDKINHQSDYDDFYDIGRKNSLSANIMQPLSNNLGNVSLSALWRNYWGRSGNAKDYQFSYSNNWQHISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIATIDGSYSHSKNAWQSGGSISSGLVVWPGGINITNQLSDTFAILDAPGLEGAHINGQKYNRTNSKGQVVYDLMIPHRENHLVLDIANSESETELHGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 23349 - protein, 227 aa, Escherichia coli STEC_MHI813; identical to SEQ ID NO: 8084

SEQ ID NO: 23350 - protein, 784 aa, Escherichia coli STEC_MHI813; identical to SEQ ID NO: 6283

SEQ ID NO: 23351 - protein, 170 aa, Escherichia coli STEC_MHI813
MSGILTRWRQFGKRYFWPHLLLGMVAASLGLPALSNAAEPNAPAKATTRNHEPSAKVNFGQLALLEANTRRPNSNYSVDYWHQHAIRTVIRHLSFAMAPQTLPIAEESLPLQAQHLALLDTLSALLTQEGTPSEKGYRIDYAHFTPQAKFSTPVWISQAQGIRAGPQRLS

SEQ ID NO: 23352 - protein, 238 aa, Escherichia coli STEC_MHI813
MVKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRPSGLQGEPAEAPAKITWKLNNAQLQANNPTPYYVSFNEVKLESGGKTYNVNSSMVAPFSQASFGVTGLPGSVSSGKVVFKAINDFGGNIDGSATF

SEQ ID NO: 23353 - protein, 747 aa, Escherichia coli STEC_MHI813
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQLKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNLVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 23354 - protein, 266 aa, Escherichia coli STEC_MHI813
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIEQYWGEQLKIPVIPLTSDWFERASPRIILAAQQLCNALSQVD

SEQ ID NO: 23355 - protein, 161 aa, Escherichia coli STEC_MHI813; identical to SEQ ID NO: 5769

SEQ ID NO: 23356 - protein, 774 aa, Escherichia coli STEC_S1191; identical to SEQ ID NO: 8932

SEQ ID NO: 23357 - protein, 368 aa, Escherichia coli STEC_S1191; identical to SEQ ID NO: 8795

SEQ ID NO: 23358 - protein, 241 aa, Escherichia coli STEC_S1191; identical to SEQ ID NO: 6143

SEQ ID NO: 23359 - protein, 878 aa, Escherichia coli STEC_S1191; identical to SEQ ID NO: 8797

SEQ ID NO: 23360 - protein, 784 aa, Escherichia coli STEC_S1191; identical to SEQ ID NO: 6283

SEQ ID NO: 23361 - protein, 170 aa, Escherichia coli STEC_S1191 [sequence omitted]

SEQ ID NO: 23362 - protein, 865 aa, Escherichia coli STEC_S1191; identical to SEQ ID NO: 6375

SEQ ID NO: 23363 - protein, 246 aa, Escherichia coli STEC_S1191; identical to SEQ ID NO: 6964

SEQ ID NO: 23364 - protein, 747 aa, Escherichia coli STEC_S1191; identical to SEQ ID NO: 6343

SEQ ID NO: 23365 - protein, 266 aa, Escherichia coli STEC_S1191; identical to SEQ ID NO: 5772

SEQ ID NO: 23366 - protein, 161 aa, Escherichia coli STEC_S1191; identical to SEQ ID NO: 5769

SEQ ID NO: 23367 - protein, 351 aa, Escherichia coli STEC_S1191; identical to SEQ ID NO: 6367

SEQ ID NO: 23368 - protein, 230 aa, Escherichia coli STEC_S1191; identical to SEQ ID NO: 6360

SEQ ID NO: 23369 - protein, 869 aa, Escherichia coli STEC_S1191; identical to SEQ ID NO: 12649

SEQ ID NO: 23370 - protein, 746 aa, Escherichia coli STEC_S1191; identical to SEQ ID NO: 6710

SEQ ID NO: 23371 - protein, 193 aa, Escherichia coli STEC_S1191; identical to SEQ ID NO: 6300

SEQ ID NO: 23372 - protein, 430 aa, Escherichia coli STEC_S1191; identical to SEQ ID NO: 5758

SEQ ID NO: 23373 - protein, 331 aa, Escherichia coli STEC_S1191; identical to SEQ ID NO: 6551

SEQ ID NO: 23374 - protein, 203 aa, Escherichia coli STEC_S1191; identical to SEQ ID NO: 6414

SEQ ID NO: 23375 - protein, 361 aa, Escherichia coli STEC_S1191; identical to SEQ ID NO: 7868

SEQ ID NO: 23376 - protein, 224 aa, Escherichia coli STEC_S1191
MTVSLTAILLSCSSAWAAGKGGIGLAATRLVYSEGEEQISLGVHNTSPDVPYLIQSWVMTPDNKKSADFIITPPLFVLNPANENLLRIMYIGAPLAKDRETLFFTSVRAVPSTTKRKEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 23377 - protein, 851 aa, Escherichia coli STEC_S1191; identical to SEQ ID NO: 14331

SEQ ID NO: 23378 - protein, 229 aa, Escherichia coli STEC_S1191
MAFLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 23379 - protein, 696 aa, Escherichia coli STEC_S1191; identical to SEQ ID NO: 6320

SEQ ID NO: 23380 - protein, 242 aa, Escherichia coli STEC_S1191; identical to SEQ ID NO: 6420

SEQ ID NO: 23381 - protein, 815 aa, Escherichia coli STEC_S1191
MNIYRLSFVSCLVMAMPCAMAVEFNLNVLDKSMRDRIDISLLKEKGVIAPGEYFVSVAVNNNKISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISDDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVGIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAASDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQLFTVVWGEQSCIIHLPERLEDTTKRLILPCH

SEQ ID NO: 23382 - protein, 505 aa, Escherichia coli STEC_S1191
MSAAVMLTLYTSSSWAFSIDDVAKQAQSLAGKGYETPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 23383 - protein, 191 aa, Escherichia coli STEC_S1191; identical to SEQ ID NO: 5748

SEQ ID NO: 23384 - protein, 232 aa, Escherichia coli STEC_S1191; identical to SEQ ID NO: 5747

SEQ ID NO: 23385 - protein, 729 aa, Escherichia coli STEC_S1191; identical to SEQ ID NO: 6402

SEQ ID NO: 23386 - protein, 213 aa, Escherichia coli STEC_S1191; identical to SEQ ID NO: 5744

SEQ ID NO: 23387 - protein, 203 aa, Escherichia coli STEC_S1191; identical to SEQ ID NO: 6396

SEQ ID NO: 23388 - protein, 565 aa, Escherichia coli STEC_S1191; identical to SEQ ID NO: 8030

SEQ ID NO: 23389 - protein, 207 aa, Escherichia coli STEC_S1191; identical to SEQ ID NO: 5743

SEQ ID NO: 23390 - protein, 102 aa, Escherichia coli STEC_S1191; identical to SEQ ID NO: 6385

SEQ ID NO: 23391 - protein, 118 aa, Escherichia coli STEC_S1191 [sequence omitted]

SEQ ID NO: 23392 - protein, 826 aa, Escherichia coli STEC_S1191
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYSWDIGVFRLDFSVPQAWVEELESGYVPPENWERGINAFYTSYYVSQYYSDYKASGNNKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYLSRDYRTFNDHVWANNKDNYRRDKNDIYDIADYYQNDFGRKNSFSANMSQSLPEGWGSVSLSTLWRDYWGRSGSSKDYQLSYSNNWRRISYTLAASQAYDENHHEEKRFNIFISIPFDWGDDVTTPRRQIYMSNSTTFDDQGGASNNTGLSGTVGSRDQFNYGVNLSYQHQENETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 23393 - protein, 224 aa, Escherichia coli STEC_S1191
MKGLLSLLISSMIFPVHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEQEGKNALKFAMQNRIKLFYRPAGIAPVNKATFKKLLINRSGNGLVIKNDSANWVTISDVKANNVKVNYETIMIAPLESQSVNVKSNNANNWYLTIIDDHGNYISDKI

SEQ ID NO: 23394 - protein, 539 aa, Escherichia coli STEC_S1191; identical to SEQ ID NO: 6391

SEQ ID NO: 23395 - protein, 646 aa, Escherichia coli STEC_S1191; identical to SEQ ID NO: 23175

SEQ ID NO: 23396 - protein, 650 aa, Escherichia coli STEC_S1191; identical to SEQ ID NO: 9042

SEQ ID NO: 23397 - protein, 828 aa, Escherichia coli STEC_S1191; identical to SEQ ID NO: 6366

SEQ ID NO: 23398 - protein, 162 aa, Escherichia coli STEC_S1191; identical to SEQ ID NO: 6365

SEQ ID NO: 23399 - protein, 367 aa, Escherichia coli STEC_S1191; identical to SEQ ID NO: 5789

SEQ ID NO: 23400 - protein, 200 aa, Escherichia coli STEC_S1191; identical to SEQ ID NO: 6363

SEQ ID NO: 23401 - protein, 274 aa, Escherichia coli STEC_S1191; identical to SEQ ID NO: 6362

SEQ ID NO: 23402 - protein, 250 aa, Escherichia coli STEC_S1191; identical to SEQ ID NO: 6361

SEQ ID NO: 23403 - protein, 881 aa, Escherichia coli STEC_S1191; identical to SEQ ID NO: 7317

SEQ ID NO: 23404 - protein, 518 aa, Escherichia coli STEC_S1191
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAVQLAQDYPAVSPTELGKEKFPFLSFLSQSSSNYLTHSPSLLFSRKGSEEKQN

SEQ ID NO: 23405 - protein, 432 aa, Escherichia coli STEC_S1191; identical to SEQ ID NO: 5727

SEQ ID NO: 23406 - protein, 359 aa, Escherichia coli STEC_S1191; identical to SEQ ID NO: 5847

SEQ ID NO: 23407 - protein, 686 aa, Escherichia coli STEC_S1191; identical to SEQ ID NO: 6339

SEQ ID NO: 23408 - protein, 834 aa, Escherichia coli STEC_S1191; identical to SEQ ID NO: 7680

SEQ ID NO: 23409 - protein, 249 aa, Escherichia coli STEC_S1191; identical to SEQ ID NO: 6407

SEQ ID NO: 23410 - protein, 199 aa, Escherichia coli STEC_S1191; identical to SEQ ID NO: 8009

SEQ ID NO: 23411 - protein, 838 aa, Escherichia coli STEC_S1191
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAINGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 23412 - protein, 678 aa, Escherichia coli STEC_S1191; identical to SEQ ID NO: 6398

SEQ ID NO: 23413 - protein, 793 aa, Escherichia coli STEC_S1191; identical to SEQ ID NO: 6397

SEQ ID NO: 23414 - protein, 654 aa, Escherichia coli STEC_S1191; identical to SEQ ID NO: 6425

SEQ ID NO: 23415 - protein, 897 aa, Escherichia coli STEC_S1191; identical to SEQ ID NO: 6392

SEQ ID NO: 23416 - protein, 386 aa, Escherichia coli STEC_S1191; identical to SEQ ID NO: 7993

SEQ ID NO: 23417 - protein, 208 aa, Escherichia coli STEC_S1191; identical to SEQ ID NO: 5717

SEQ ID NO: 23418 - protein, 614 aa, Escherichia coli STEC_S1191; identical to SEQ ID NO: 6387

SEQ ID NO: 23419 - protein, 446 aa, Escherichia coli STEC_S1191
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMFKWTPIMSTVMEIGYDNVESQRTGDKNNQYKITLAQQWQAGDSIWSRPAIRVFATYAKWDEKWGYDYTGNADNNANFGKAVPADFNGGSFGRGDSDEWTFGAQMEIWW

SEQ ID NO: 23420 - protein, 237 aa, Escherichia coli STEC_S1191; identical to SEQ ID NO: 6384

SEQ ID NO: 23421 - protein, 119 aa, Escherichia coli STEC_S1191
MDAVLSVQGASAPVKKKSFFSKFTRLNMLRLARAVIPAAVLMMFFPQLAMAAGSQDLMASGNSTVKATFGKDSSVVKWVVLAEVLVGAVMYMMTKNVKFLAGFAIISVFIAVGMAVVGL

SEQ ID NO: 23422 - protein, 108 aa, Escherichia coli STEC_S1191
MDAVLSVQGASAPIKKKSFFSKFTRLNMLRLARAVIPAAVLMMFFPQLAMASGGQDLMQSGNSTVKATFGKDSSVVKWVVLAEVLVGAVMYMMTKNVKFLAGFAIISV

SEQ ID NO: 23423 - protein, 784 aa, Escherichia coli str. K-12 substr. MDS42; identical to SEQ ID NO: 6283

SEQ ID NO: 23424 - protein, 170 aa, Escherichia coli str. K-12 substr. MDS42 [sequence omitted]

SEQ ID NO: 23425 - protein, 351 aa, Escherichia coli str. K-12 substr. MDS42; identical to SEQ ID NO: 6367

SEQ ID NO: 23426 - protein, 865 aa, Escherichia coli str. K-12 substr. MDS42; identical to SEQ ID NO: 6375

SEQ ID NO: 23427 - protein, 246 aa, Escherichia coli str. K-12 substr. MDS42; identical to SEQ ID NO: 6964

SEQ ID NO: 23428 - protein, 266 aa, Escherichia coli str. K-12 substr. MDS42; identical to SEQ ID NO: 5772

SEQ ID NO: 23429 - protein, 161 aa, Escherichia coli str. K-12 substr. MDS42; identical to SEQ ID NO: 5769

SEQ ID NO: 23430 - protein, 412 aa, Escherichia coli str. K-12 substr. MDS42; identical to SEQ ID NO: 6390

SEQ ID NO: 23431 - protein, 432 aa, Escherichia coli str. K-12 substr. MDS42; identical to SEQ ID NO: 5727

SEQ ID NO: 23432 - protein, 359 aa, Escherichia coli str. K-12 substr. MDS42; identical to SEQ ID NO: 5847

SEQ ID NO: 23433 - protein, 472 aa, Escherichia coli str. K-12 substr. MDS42; identical to SEQ ID NO: 5729

SEQ ID NO: 23434 - protein, 729 aa, Escherichia coli str. K-12 substr. MDS42; identical to SEQ ID NO: 6402

SEQ ID NO: 23435 - protein, 213 aa, Escherichia coli str. K-12 substr. MDS42; identical to SEQ ID NO: 5744

SEQ ID NO: 23436 - protein, 203 aa, Escherichia coli str. K-12 substr. MDS42; identical to SEQ ID NO: 6396

SEQ ID NO: 23437 - protein, 565 aa, Escherichia coli str. K-12 substr. MDS42; identical to SEQ ID NO: 6395

SEQ ID NO: 23438 - protein, 122 aa, Escherichia coli str. K-12 substr. MDS42; identical to SEQ ID NO: 6987

SEQ ID NO: 23439 - protein, 826 aa, Escherichia coli str. K-12 substr. MDS42; identical to SEQ ID NO: 6373

SEQ ID NO: 23440 - protein, 239 aa, Escherichia coli str. K-12 substr. MDS42; identical to SEQ ID NO: 6428

SEQ ID NO: 23441 - protein, 663 aa, Escherichia coli str. K-12 substr. MDS42; identical to SEQ ID NO: 6307

SEQ ID NO: 23442 - protein, 200 aa, Escherichia coli str. K-12 substr. MDS42; identical to SEQ ID NO: 6363

SEQ ID NO: 23443 - protein, 274 aa, Escherichia coli str. K-12 substr. MDS42; identical to SEQ ID NO: 6362

SEQ ID NO: 23444 - protein, 250 aa, Escherichia coli str. K-12 substr. MDS42; identical to SEQ ID NO: 6361

SEQ ID NO: 23445 - protein, 578 aa, Escherichia coli str. K-12 substr. MDS42; identical to SEQ ID NO: 6950

SEQ ID NO: 23446 - protein, 230 aa, Escherichia coli str. K-12 substr. MDS42; identical to SEQ ID NO: 6360

SEQ ID NO: 23447 - protein, 867 aa, Escherichia coli str. K-12 substr. MDS42; identical to SEQ ID NO: 6359

SEQ ID NO: 23448 - protein, 746 aa, Escherichia coli str. K-12 substr. MDS42; identical to SEQ ID NO: 6422

SEQ ID NO: 23449 - protein, 242 aa, Escherichia coli str. K-12 substr. MDS42; identical to SEQ ID NO: 6420

SEQ ID NO: 23450 - protein, 815 aa, Escherichia coli str. K-12 substr. MDS42; identical to SEQ ID NO: 6927

SEQ ID NO: 23451 - protein, 430 aa, Escherichia coli str. K-12 substr. MDS42; identical to SEQ ID NO: 5758

SEQ ID NO: 23452 - protein, 332 aa, Escherichia coli str. K-12 substr. MDS42; identical to SEQ ID NO: 6429

SEQ ID NO: 23453 - protein, 760 aa, Escherichia coli str. K-12 substr. MDS42; identical to SEQ ID NO: 6415

SEQ ID NO: 23454 - protein, 204 aa, Escherichia coli str. K-12 substr. MDS42; identical to SEQ ID NO: 5755

SEQ ID NO: 23455 - protein, 362 aa, Escherichia coli str. K-12 substr. MDS42; identical to SEQ ID NO: 5809

SEQ ID NO: 23456 - protein, 233 aa, Escherichia coli str. K-12 substr. MDS42; identical to SEQ ID NO: 6411

SEQ ID NO: 23457 - protein, 866 aa, Escherichia coli str. K-12 substr. MDS42; identical to SEQ ID NO: 6410

SEQ ID NO: 23458 - protein, 236 aa, Escherichia coli str. K-12 substr. MDS42; identical to SEQ ID NO: 6409

SEQ ID NO: 23459 - protein, 511 aa, Escherichia coli str. K-12 substr. MDS42; identical to SEQ ID NO: 6694

SEQ ID NO: 23460 - protein, 191 aa, Escherichia coli str. K-12 substr. MDS42; identical to SEQ ID NO: 5748

SEQ ID NO: 23461 - protein, 207 aa, Escherichia coli str. K-12 substr. MDS42; identical to SEQ ID NO: 5743

SEQ ID NO: 23462 - protein, 541 aa, Escherichia coli str. K-12 substr. MDS42; identical to SEQ ID NO: 6754

SEQ ID NO: 23463 - protein, 700 aa, Escherichia coli str. K-12 substr. MDS42; identical to SEQ ID NO: 6388

SEQ ID NO: 23464 - protein, 102 aa, Escherichia coli str. K-12 substr. MDS42; identical to SEQ ID NO: 6385

SEQ ID NO: 23465 - protein, 828 aa, Escherichia coli str. K-12 substr. MDS42; identical to SEQ ID NO: 6366

SEQ ID NO: 23466 - protein, 162 aa, Escherichia coli str. K-12 substr. MDS42; identical to SEQ ID NO: 6365

SEQ ID NO: 23467 - protein, 367 aa, Escherichia coli str. K-12 substr. MDS42; identical to SEQ ID NO: 5789

SEQ ID NO: 23468 - protein, 193 aa, Escherichia coli str. K-12 substr. MDS42; identical to SEQ ID NO: 6300

SEQ ID NO: 23469 - protein, 231 aa, Escherichia coli str. K-12 substr. MDS42; identical to SEQ ID NO: 6400

SEQ ID NO: 23470 - protein, 838 aa, Escherichia coli str. K-12 substr. MDS42; identical to SEQ ID NO: 6399

SEQ ID NO: 23471 - protein, 678 aa, Escherichia coli str. K-12 substr. MDS42; identical to SEQ ID NO: 6398

SEQ ID NO: 23472 - protein, 208 aa, Escherichia coli str. K-12 substr. MDS42; identical to SEQ ID NO: 5717

SEQ ID NO: 23473 - protein, 614 aa, Escherichia coli str. K-12 substr. MDS42; identical to SEQ ID NO: 6387

SEQ ID NO: 23474 - protein, 446 aa, Escherichia coli str. K-12 substr. MDS42 [sequence omitted]

SEQ ID NO: 23475 - protein, 237 aa, Escherichia coli str. K-12 substr. MDS42; identical to SEQ ID NO: 6384

SEQ ID NO: 23476 - protein, 478 aa, Escherichia coli str. K-12 substr. MDS42; identical to SEQ ID NO: 5711

SEQ ID NO: 23477 - protein, 111 aa, Escherichia coli TA007; identical to SEQ ID NO: 7676

SEQ ID NO: 23478 - protein, 236 aa, Escherichia coli TA007; identical to SEQ ID NO: 6472

SEQ ID NO: 23479 - protein, 377 aa, Escherichia coli TA007
MPEYRSSCQSWYKKIALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNI

SEQ ID NO: 23480 - protein, 535 aa, Escherichia coli TA007
MRYQRHCFSFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFSEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 23481 - protein, 207 aa, Escherichia coli TA007; identical to SEQ ID NO: 5743

SEQ ID NO: 23482 - protein, 565 aa, Escherichia coli TA007; identical to SEQ ID NO: 6395

SEQ ID NO: 23483 - protein, 203 aa, Escherichia coli TA007; identical to SEQ ID NO: 6396

SEQ ID NO: 23484 - protein, 213 aa, Escherichia coli TA007; identical to SEQ ID NO: 5744

SEQ ID NO: 23485 - protein, 729 aa, Escherichia coli TA007; identical to SEQ ID NO: 6531

SEQ ID NO: 23486 - protein, 232 aa, Escherichia coli TA007; identical to SEQ ID NO: 5747

SEQ ID NO: 23487 - protein, 191 aa, Escherichia coli TA007; identical to SEQ ID NO: 5748

SEQ ID NO: 23488 - protein, 517 aa, Escherichia coli TA007; identical to SEQ ID NO: 6406

SEQ ID NO: 23489 - protein, 161 aa, Escherichia coli TA007; identical to SEQ ID NO: 14332

SEQ ID NO: 23490 - protein, 606 aa, Escherichia coli TA007
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNFGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKITPG

SEQ ID NO: 23491 - protein, 224 aa, Escherichia coli TA007; identical to SEQ ID NO: 7705

SEQ ID NO: 23492 - protein, 362 aa, Escherichia coli TA007
MMKRNILAVIVPALLVAGTANAAEIYNKDGNKVDLYGKAVGLHYFSKDNGVNSYGGNGDKTYARLGFKGETQINSDLTGYGQWEYNFQGNNSEGADAQTGNKTRLAFAGLKYADIGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEDIGDVDLVNYFEVGATYYFNKNMSTYVDYIINQIDSDNKLGVGSDDTVAVGIVYQF

SEQ ID NO: 23493 - protein, 200 aa, Escherichia coli TA007; identical to SEQ ID NO: 6363

SEQ ID NO: 23494 - protein, 367 aa, Escherichia coli TA007; identical to SEQ ID NO: 5789

SEQ ID NO: 23495 - protein, 162 aa, Escherichia coli TA007; identical to SEQ ID NO: 6365

SEQ ID NO: 23496 - protein, 828 aa, Escherichia coli TA007; identical to SEQ ID NO: 6558

SEQ ID NO: 23497 - protein, 663 aa, Escherichia coli TA007
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATTFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 23498 - protein, 239 aa, Escherichia coli TA007; identical to SEQ ID NO: 6428

SEQ ID NO: 23499 - protein, 826 aa, Escherichia coli TA007; identical to SEQ ID NO: 6373

SEQ ID NO: 23500 - protein, 130 aa, Escherichia coli TA007; identical to SEQ ID NO: 7726

SEQ ID NO: 23501 - protein, 351 aa, Escherichia coli TA007; identical to SEQ ID NO: 5767

SEQ ID NO: 23502 - protein, 230 aa, Escherichia coli TA007
MMTKIKLLMLIIFYLIISASAHAAGGIALGATRIIYPADAKQTAVWIRNSHTNERFLINSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 23503 - protein, 869 aa, Escherichia coli TA007; identical to SEQ ID NO: 12649

SEQ ID NO: 23504 - protein, 746 aa, Escherichia coli TA007; identical to SEQ ID NO: 6710

SEQ ID NO: 23505 - protein, 193 aa, Escherichia coli TA007; identical to SEQ ID NO: 6300

SEQ ID NO: 23506 - protein, 242 aa, Escherichia coli TA007; identical to SEQ ID NO: 6420

SEQ ID NO: 23507 - protein, 815 aa, Escherichia coli TA007; identical to SEQ ID NO: 6927

SEQ ID NO: 23508 - protein, 431 aa, Escherichia coli TA007
MMKQALRVAFGFLILWASVLHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKSPAWSPYL

SEQ ID NO: 23509 - protein, 331 aa, Escherichia coli TA007; identical to SEQ ID NO: 6551

SEQ ID NO: 23510 - protein, 760 aa, Escherichia coli TA007; identical to SEQ ID NO: 6415

SEQ ID NO: 23511 - protein, 249 aa, Escherichia coli TA007; identical to SEQ ID NO: 6407

SEQ ID NO: 23512 - protein, 837 aa, Escherichia coli TA007; identical to SEQ ID NO: 14360

SEQ ID NO: 23513 - protein, 686 aa, Escherichia coli TA007
MFWRDMTLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDANGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 23514 - protein, 360 aa, Escherichia coli TA007; identical to SEQ ID NO: 6702

SEQ ID NO: 23515 - protein, 432 aa, Escherichia coli TA007; identical to SEQ ID NO: 5727

SEQ ID NO: 23516 - protein, 510 aa, Escherichia coli TA007; identical to SEQ ID NO: 6653

SEQ ID NO: 23517 - protein, 881 aa, Escherichia coli TA007; identical to SEQ ID NO: 6713

SEQ ID NO: 23518 - protein, 250 aa, Escherichia coli TA007; identical to SEQ ID NO: 6714

SEQ ID NO: 23519 - protein, 274 aa, Escherichia coli TA007; identical to SEQ ID NO: 6362

SEQ ID NO: 23520 - protein, 784 aa, Escherichia coli TA007; identical to SEQ ID NO: 6283

SEQ ID NO: 23521 - protein, 865 aa, Escherichia coli TA007
MTIEYTKNYHHLTRIATFCALLYCNTAFSAELVEYDHTFLMGQNASNIDLSRYSEGNPAIPGVYDVSVYVNDQPIINQSITFVAIEGKKNAQACITLKNLLQFHINSPDINNEKAVLLARDETLGNCLNLTEIIPQASVRYDVNDQRLDIDVPQAWVMKNYQNYVDPSLWENGINAAMLSYNLNGYHSETPGRKNESIYAAFNGGMNLGAWRLRASGNYNWMTDSGSNYDFKNRYVQRDIASLRSQLILGESYTTGETFDSVSIRGIRLYSDSRMLPPTLASFAPIIHGVANTNAKVTITQGGYKIYETTVPPGAFVIDDLSPSGYGSELIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSTSWGSYSVSAQRSWNEDGDTDDSVYLSFTIPIEKLLGTEQRTSGFQSIDTQISSDFKGNNQLNVSSSGYSDNARVSYSVNTGYTMNKASKDLSYVGGYASYESPWGTLAGSISANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEQSKPVSCLAHYQQSPEAEKIAQSIILNGIRCQIQ

SEQ ID NO: 23522 - protein, 246 aa, Escherichia coli TA007; identical to SEQ ID NO: 6964

SEQ ID NO: 23523 - protein, 747 aa, Escherichia coli TA007
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFSVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYYWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 23524 - protein, 266 aa, Escherichia coli TA007; identical to SEQ ID NO: 5772

SEQ ID NO: 23525 - protein, 161 aa, Escherichia coli TA007; identical to SEQ ID NO: 5769

SEQ ID NO: 23526 - protein, 678 aa, Escherichia coli TA007; identical to SEQ ID NO: 6688

SEQ ID NO: 23527 - protein, 813 aa, Escherichia coli TA007
MVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFTPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 23528 - protein, 231 aa, Escherichia coli TA007; identical to SEQ ID NO: 6690

SEQ ID NO: 23529 - protein, 498 aa, Escherichia coli TA007; identical to SEQ ID NO: 15749

SEQ ID NO: 23530 - protein, 654 aa, Escherichia coli TA007; identical to SEQ ID NO: 6425

SEQ ID NO: 23531 - protein, 897 aa, Escherichia coli TA007; identical to SEQ ID NO: 6749

SEQ ID NO: 23532 - protein, 412 aa, Escherichia coli TA007; identical to SEQ ID NO: 6495

SEQ ID NO: 23533 - protein, 478 aa, Escherichia coli TA007; identical to SEQ ID NO: 5711

SEQ ID NO: 23534 - protein, 446 aa, Escherichia coli TA007 [sequence omitted]

SEQ ID NO: 23535 - protein, 614 aa, Escherichia coli TA007; identical to SEQ ID NO: 6387

SEQ ID NO: 23536 - protein, 203 aa, Escherichia coli TA007; identical to SEQ ID NO: 6414

SEQ ID NO: 23537 - protein, 368 aa, Escherichia coli TA007; identical to SEQ ID NO: 7693

SEQ ID NO: 23538 - protein, 774 aa, Escherichia coli TA007; identical to SEQ ID NO: 7694

SEQ ID NO: 23539 - protein, 656 aa, Escherichia coli TA007; identical to SEQ ID NO: 15156

SEQ ID NO: 23540 - protein, 733 aa, Escherichia coli TA007
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVSKKGQPETMKEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAVFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTIVDLLGSYQLPVGTLSFSIENLFDRDYTTVWGQRAPLYYSPGYGPASLYGYKGRGRTFGLSYSVLF

SEQ ID NO: 23541 - protein, 246 aa, Escherichia coli TA124; identical to SEQ ID NO: 8078

SEQ ID NO: 23542 - protein, 840 aa, Escherichia coli TA124
MNNKNTFTGDKLSHAIKIALSGVVCSLLFVLPVHAVEFNVDMVDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDAGIAGFILDYNVYASQYAPHHGDSTQNVSSYGTLGFNLGAWRLRSDYQYNQNFADGRSVNHDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSDNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGVEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSILHLTWGDNTCEVTPPNQSNISESAIILPCKTVK

SEQ ID NO: 23543 - protein, 713 aa, Escherichia coli TA124
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGITSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 23544 - protein, 686 aa, Escherichia coli TA124; identical to SEQ ID NO: 6339

SEQ ID NO: 23545 - protein, 359 aa, Escherichia coli TA124
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGIDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 23546 - protein, 567 aa, Escherichia coli TA124; identical to SEQ ID NO: 6075

SEQ ID NO: 23547 - protein, 432 aa, Escherichia coli TA124; identical to SEQ ID NO: 5727

SEQ ID NO: 23548 - protein, 243 aa, Escherichia coli TA124
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLNLKNPTGYYLTIAYLGRNEQGILPGFKTVMVAPFSTVITNTGSYSGSQFYLGYMDDYGALRMTTLNCNGHCRLQAVEAKK

SEQ ID NO: 23549 - protein, 803 aa, Escherichia coli TA124
MAIPSALAVEFNLNVLDKSMRDRIDISLLKEKGVIAPGEYFVSVAVNNNQISNGQKIDWKKNGDQTIPCINDLLVDKFGLKPEVRQSLPRLNQCVDFSSRPEILFIFDQASQQLNITIPQAWLAWHSDNWTPPSTWKEGVAGVLMDYNLFASSYRPQDGSNSTNLNAYGTAGINAGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRTSMSHQTENETFFSNEVSWGMLSNTSLYGGLLISGDDYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNLNLYANLLHQTWWNADASTTANITAGFNVDIGNWRDISISTSFNTTHYEDKDRDNQIYLSISLPFGNGGRVGYDMQNSSHSTTHRMSWNDTLDERNSWGMSTGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVADNVIKETWIEGAIGYKSLASRSGKDVNVIIRNASGQFPPLGADIRQEDSGISVGMVGEEGHAWLSGVAENQQVTVIWGDSQRCSIHLPEHMEDTANRLILPCH

SEQ ID NO: 23550 - protein, 430 aa, Escherichia coli TA124
MKQALRVAFGFLILWASVLHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRSRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 23551 - protein, 331 aa, Escherichia coli TA124; identical to SEQ ID NO: 6551

SEQ ID NO: 23552 - protein, 760 aa, Escherichia coli TA124
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAQSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 23553 - protein, 203 aa, Escherichia coli TA124; identical to SEQ ID NO: 6414

SEQ ID NO: 23554 - protein, 362 aa, Escherichia coli TA124; identical to SEQ ID NO: 5813

SEQ ID NO: 23555 - protein, 233 aa, Escherichia coli TA124
MKTCITKGIVTVSLTAILLSCSSAWAAGKGGIGLAATRLVYSEGEEQISLGVHNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLAEAPAKLRCTSSADMVTLSNPTPYFITLTDLKIGGKVVKNQMISPFDKYQFPLPKGAQNSSVTYRTINDYGAETPQLNCKS

SEQ ID NO: 23556 - protein, 866 aa, Escherichia coli TA124
MPRTHRQHSLLTSGGVPSFIGGLVVFVSAAFNAQAETWFDPAFFKDDPSMVADLSRFERGQKITPGVYRVDIVLNQTVIDTRNVNFVEITPEKGIAACLTTESLDAMGVNIDAFPAFKQLDKQACAPLAEIIPDASVTFDVNKLRLEISVPQIAIKSNARDYVPPERWDEGINALLLGYSFSGANSIHSSSDSDSTDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEVDGSINSYSVPFSSVPLLQRQGRIKYAVTLAKYRTNSNDQQESKFAQATLQWGGPWGTTWYGGGQYAEYYRAAMLGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGDYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDSGSQQQLNYALSGSLVAHSRGITLGQSLGETNVLIVAPGAENTRVANSTGLKTDWRGYTVVPYATSYRENRIVLDAASLKRNVDLENAVVNVVPTKGALVLAEFNAHAGARVLMKTSKQGMPLRFGAIATLDGVQTNSGIIDDDGSLYMSGLPAQGAITVRWGEAPDQICHISYELTEQQINAAITRMDAICR

SEQ ID NO: 23557 - protein, 229 aa, Escherichia coli TA124; identical to SEQ ID NO: 22690

SEQ ID NO: 23558 - protein, 229 aa, Escherichia coli TA124
MKSVLLLLTVLFVQSVEAGIMPASSRIIYRDGDREKTLMLVNTNDYPVLVQSWVDNGEGSPEAASPPFVVLPPVFRLAAKRTQGLRIIYNHDPLPQDRESAFWLNLYEMPPETPHQDPTHLTLAMNTQLKIFYRPKSVTMTPEEAMRKISWHLGNDGSSSYIELNNPTPLNISFTSISIGATKVQQESDMMIKPFSQRRYWLASNNVSGVVAATYLDDNGSQIKQQLAP

SEQ ID NO: 23559 - protein, 840 aa, Escherichia coli TA124
MNKSVVSISAAILVLLCQPVMGKEISPATPSDEDNYTFDPQLFRGSRFSQSSLAKLTTRVSVAPGNYKMDIYTNNKLSGSWNVTFKEAADGRVLPCLTPEVADAIGLKTGEDKGEKDPVCTFAQELAPGITSHTQLSQLRLDLSVPQSQMISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSTLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGVTFGPYLGETFALVEAKGAEGAKVYNSSQLEINDSGYALVPAVTPYRYNRISLDPQGMDGDAELVDSEKQVAPVAGAAVKVVFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 23560 - protein, 233 aa, Escherichia coli TA124
MNIFAYLLVLVFSMSMSSSAFASVVMTGTRIIFPGDAKEKTIQLRNTSDQPYIINIHVEDERGSDKNVPFMPTPQTFRMEAAAGQALRLLYTGDNLPQDRESVFWFSFSQLPYLNKNDKSQNQLILALTNRVKIFFRPSSIVGKSSDAPKNLTYQVKQNRIEVTNPTGYYVVIRAAELLNNGKKVPLANSVMIAPQSTTEWTLRSGISVAPGAQIHLVTVNDYGVNVTSEHAL

SEQ ID NO: 23561 - protein, 191 aa, Escherichia coli TA124; identical to SEQ ID NO: 14762

SEQ ID NO: 23562 - protein, 232 aa, Escherichia coli TA124
MQKNAAHTYAISSLLVLSLTGCAWIPSTPLVQGATSAQPVPGPTPVANGSIFQSAQPINYGYQPLFEDRRPRNIGDTLTIMLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 23563 - protein, 729 aa, Escherichia coli TA124
MLSTQFNRDNQHQTTSKPSLLAACIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMLELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 23564 - protein, 213 aa, Escherichia coli TA124
MTKMSRYALITALAMFLAGCVGQREPAPVEEVKPAPEQPAEPQQPVPTVPSVPTIPQQPGPIEHEDQTAPPAPHIRHYDWNGAMQPMVSKMLGADGVTAGSVLLVDSVNNRTNGSLNAAEATETLRNSLANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 23565 - protein, 203 aa, Escherichia coli TA124; identical to SEQ ID NO: 6347

SEQ ID NO: 23566 - protein, 656 aa, Escherichia coli TA124; identical to SEQ ID NO: 8625

SEQ ID NO: 23567 - protein, 565 aa, Escherichia coli TA124
MKSPTPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELMAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPVKQKEAEPTP

SEQ ID NO: 23568 - protein, 207 aa, Escherichia coli TA124; identical to SEQ ID NO: 5743

SEQ ID NO: 23569 - protein, 161 aa, Escherichia coli TA124; identical to SEQ ID NO: 5769

SEQ ID NO: 23570 - protein, 266 aa, Escherichia coli TA124
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALSQLALWSPQPDKAEQAAQSLLDQYAQLKAQYADKPKKRVFLQFGINPPFTSGKESIQNQVLEVCGGENIFKDSRVPWPQVSREQVLARAPQAIVITGGPDQIPKIKQYWGEQLKIPVIPLTSDWFERASPRIILAAQQLCNALSQVD

SEQ ID NO: 23571 - protein, 747 aa, Escherichia coli TA124; identical to SEQ ID NO: 8088

SEQ ID NO: 23572 - protein, 259 aa, Escherichia coli TA124
MSPPCLENNSCHGWYILLNKKNIVALCVASSMAFSMPVMADIVISGTRVIYKSDQKSVSVRLENKGNSHLLVQSWLDTGDDNAEPGSINVPFTATPPVSRIDAKRGQTIKLMYTGSTVLPSDKESVFWFNVLEVPPKPDATKVENQSLLQLAFRTRIKLFYRPAGLNGNPSEAPLALKWKWAEGKSGLSVYNPTPYYVSFNSAELIAGGKSNPLNVKMVAPKSEEIFTISGSGGKATSGKVHFSAINDFGGAIEGDVNL

SEQ ID NO: 23573 - protein, 873 aa, Escherichia coli TA124
MQQEANVMKTTTSTKRHNLTRIAMYCSIMYSGATIGAESVEYDPTFLMGGNASSIDVSRYSDGNPTLPGVYDVSIYVNEQPVANLEIPFIAIPDKKNAQACITLKNLLQLHIKTPPADEENTILLPRDETLGNCLDLSLAIPKSSVSYDPSEQRLDINVPQAWVMKNYQNYVDPSLWENGINAATLSYNINAYRSENSNYTNDSVYTSFNGGVNLGAWRLRSSGNYSWRNDAGSDVEFMNRYVQRDITAIRSQLIMGESYTTGETFDSVSIRGIRLYSDSRMLPPVLANFAPTIRGVANTNAKVSITQSGYKIYETTVPPGPFVIDDLSPSGYGSDLIVTIEEADGSKRTFSQPFSSVIQMLRPGVSRWDISGGQINKDDLHHEPNLLQATYYRGLSNLFTGYTGFQVTDNHYAAGLLGIGMNTSVGAISFDVTHSSVDIPDDKRYQGQSYRISWNKFFDLTDTSLNIAAYRYSTQDYLGLNDALTLIDEVEHPTQDLDPKTMRNYGRMKNQFTVSINQPLRFGKDDYGSFYTSGSWSDYWGGGKSRSNYSVGYSNSASWGSYSISAQRSWDEYSQTENSIYLSFSIPIEKLMGTEHRDSGFQSIDTQLSTNMDGNNQFNMSSSGYSNDNRVSYSVNAGYGMNKTGKDLSNIGGYASYESPWGTLAGSVSATSDNNRQYSVNTDGGFVLHSGGLTFSNDSFSDNDTIALVKAPGAKGARINYGNNTVDRWGYGVTSALSPYQENKIALDTENLENDIEMKSTSTVAVPRQGSVIFAGFETNQGQSAIMNIKRSDGKGIPFAADIHDETNAIIGNVGQGGQAFVRGIQQQGTIKITWLEASMPKTCVAQYQQPNVTSEKIQQTIILNNILCQLQ

SEQ ID NO: 23574 - protein, 784 aa, Escherichia coli TA124; identical to SEQ ID NO: 6283

SEQ ID NO: 23575 - protein, 227 aa, Escherichia coli TA124; identical to SEQ ID NO: 12709

SEQ ID NO: 23576 - protein, 816 aa, Escherichia coli TA124
MLRTTRWVAAIIFLYSFPGYAEETFDTHFMIGGMRGEKVSEYRFDNKQPLPGNYELDFYVNHQWRGKKDITIPESPAKPCLPKVLLTTLGVKTDNLNTENNCILLDEAVHGGQYQWDISEHRLNLTVPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYIIYQKEVPPGPFTIADLQLSGSGSDLDVSIKEADGSVRSFLVPYSSVPNMLQPGVSNFDFITGRSKLYGVKNQEDFLEANYIYGLNNLLTLYGGTILSDNYNAITLGNGWNTPLGAISFDATRSSSKLNNDITHEGTSYQVAYNKYLVQTATLFSVAAWRYASQDYRTFSDHLYENDKINHQSDYDDFYDIGRKNSLSANIMQPLSNNLGNVSLSALWRNYWGRSGNAKDYQFSYSNSWQRISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIAIIDGSYSHSKNTWQSGGSISSGLVVRPGGINITNQLSDTFAILDAPGLEGAHINGQKYNRTNSKGQVVYDLMIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 23577 - protein, 878 aa, Escherichia coli TA124
MSYLNLRLYQRNTQCLHIRKHRLAGFFVRLVVACAFAAQAPLSSAELYFNPRFLADDPQAVADLSRFENGQELPPGTYRVDIYLNNGYMATRDVTFNTGDSEQGIVPCLTRAQLAGMGLNTASVSGMNLLADDACVPLTTMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKTRVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 23578 - protein, 241 aa, Escherichia coli TA124; identical to SEQ ID NO: 6143

SEQ ID NO: 23579 - protein, 368 aa, Escherichia coli TA124
MNKTITALTIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGMSNDSLIFVGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 23580 - protein, 826 aa, Escherichia coli TA124
MLRMTPLASAIVALLLGIEAYAAEETFDTHFMIGGMKDQQVANIRLDDNQPLPGQYDIDIYVNKQWRGKYEIIVKDNPQETCLSREIIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNSNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTSWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSSNLRRISYTLAASQAYDENHHEEKRFNILISIPFDWGDDVTTPRRQIYMSNSTTFDDQGFASNNTGLSGTVGGRDQFNYGVNLSHQHQGNETTAGANLTWNAPVATVNGSYSQSSTYRQAGASVSGGIVAWSGGVNLANRLSETLAVMNAPGIKNAYVNGQKYRTTNRNGVVVYDGMTPYRENHLMLDVSQSDSEAELRGNRKIVAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 23581 - protein, 224 aa, Escherichia coli TA124
MKGLLALLISSMVLPAHAGIVIYGTRIIYPAEHKEVMVQLMNQGNRSSLLQAWIDDGDTSLPPEKIQIPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSINVKSNNANNWYLTIIDDHGNYISDKI

SEQ ID NO: 23582 - protein, 663 aa, Escherichia coli TA124; identical to SEQ ID NO: 8146

SEQ ID NO: 23583 - protein, 828 aa, Escherichia coli TA124; identical to SEQ ID NO: 5895

SEQ ID NO: 23584 - protein, 162 aa, Escherichia coli TA124; identical to SEQ ID NO: 8101

SEQ ID NO: 23585 - protein, 375 aa, Escherichia coli TA124
MKVKVLSLLVPALLVAGAANAAEVYNKDGNKLDLYGKVDGLHYFSDDKSVDGDQTYMRLGFKGETQVTDQLTGYGQWEYQIQGNAPESENNSWTRVAFAGLKFQDIGSIDYGRNYGVVYDVTSWTDVLPEFGGDTYGSDNFMQQRGNGFATYRNTDFFGLVDGLNFAVQYQGQNGSVSGESDPDFTGHGITNNGRKALRQNGDGVGGSITYDYEGFGIGGAISSSKRTWDQNNTGLIGTGDRAETYTGGLKYDANNIYLAAQYTQTYNATRVGSLGWANKAQNFEAVAQYQFDFGLRPSVAYLQSKGKNLGVIKGRNYDDEDILKYVDVGATYYFNKNMSTYVDYKINLLDDNRFTRDAGINTDDIVALGLVYQF

SEQ ID NO: 23586 - protein, 237 aa, Escherichia coli TA124; identical to SEQ ID NO: 6384

SEQ ID NO: 23587 - protein, 446 aa, Escherichia coli TA124; identical to SEQ ID NO: 7485

SEQ ID NO: 23588 - protein, 478 aa, Escherichia coli TA124; identical to SEQ ID NO: 5711

SEQ ID NO: 23589 - protein, 518 aa, Escherichia coli TA124; identical to SEQ ID NO: 6358

SEQ ID NO: 23590 - protein, 392 aa, Escherichia coli TA124
MKRKVLAMLVPALLVAGAANAAEIYNKDGNKLDLYGKVAGLHYFSDDAGSDGDKSYARIGFKGETQIADQFTGYGQWEFNIGANGTESDKGNTATRLAFAGLGFGQNGTFDYGRNYGVVYDVEAWTDMLPEFGGDTYAGADNFMNGRANGVATYRNNGFFGQVDGLNFALQYQSNNENGGPFGQEGSGKGKGRDIAQENGDGFGMSTSYDFDFGLSLGAAYSNSDRTDNQVHKGWHNTRDGDRSDTTAGGETAEAWTVGAKYDANNVYLAAMYAETRNMTGYGKVDAIANKTQNFEVVAQYQFDFGLRPSIAYLQSKGKDLGGWAHDGNGDPRYTNKDLVKYVDIGATYYFNKNMSTYVDYKINLLDNDDDFYKANGIATDDIVAVGLVYQF

SEQ ID NO: 23591 - protein, 118 aa, Escherichia coli TA124 [sequence omitted]

SEQ ID NO: 23592 - protein, 102 aa, Escherichia coli TA124; identical to SEQ ID NO: 14041

SEQ ID NO: 23593 - protein, 654 aa, Escherichia coli TA124
MDSVMKGLNKITCCLLAALLMPCAGHAENEQYGANFNNADIRQFVEIVGQHLGKTILIDPSVQGTISVRSNDTFSQQEYYQFFLSILDLYGYSVVTLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNERKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHPPAPSAR

SEQ ID NO: 23594 - protein, 505 aa, Escherichia coli TA124
MSQYGNPTTCEIDNGGVIVADGFQASKAYSANSIVDYNDAHYKTSVDQGAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGANYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAITNLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 23595 - protein, 364 aa, Escherichia coli TA124
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSTSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTLYVIYNGSIYKNAWWVGAANCPGDAKENDASNPWRYVRAATATEISQYGNPGSCSVKPDNNGDAVTPVDPTPETPETPVTPTPDNNEPSTPADSSNDYSLQAWSGQEGSEIYHVIFNGNVYQNA

SEQ ID NO: 23596 - protein, 402 aa, Escherichia coli TA124
MLIPGVQAAKPQKVTLMVDDVPVAQVLQALAEQEKLNLVVSPDVSGTVSLHLTDVPWKQALQTVVKSAGLITRQEGNILSVHSVAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKNGETLALGGIFTRKNKSGQDSVPLLGDIPWFGQLFRHDGKEDERRELVVFITPRLVSSE

SEQ ID NO: 23597 - protein, 258 aa, Escherichia coli TA124
MLQFPLSSLMINVLICILICCTNAQAGVVVGGTRFVYPEKQSSISVELKNTASKDMLVKISVTPDDGRQLKGTLESQPLLPDKAFIATPPLLVLKQDKNTKIRINRVGGQLPIDRESLFILNVAALPAQEKNSQLKNENQLQVAVRNRMKIFYRPETLSGNPLDAYQQLRWSRKNEAVTVFNPTPWYVTLYNLSIDGKSINGGMVAPFSHRQQDWCQRQGYCEINWQTLDLYNNALPVWSVKLNVLQNNVMSAVAIHG

SEQ ID NO: 23598 - protein, 250 aa, Escherichia coli TA124; identical to SEQ ID NO: 8657

SEQ ID NO: 23599 - protein, 879 aa, Escherichia coli TA124
MPEHSFLRLRGLSWWIALAISGSPFNALADDTIQFDGRFLDLKGNTKIDLGRFSQKGYVEPGKYNLRVHVNNQPLPDDYDIYWYATENDPNKSYACLSPELVAQFGLKEDIAKNLQWIRDGQCLNTALLAGTEISGDLGQSALLVSVPQAYLEYTDSEWDPPSRWDDGIPGLIADYSINAQTRHENGGDDTNDISGNGTVGVNVGPWRLRADWQSDYQHTRSNDDGDTDDSGTQKNWEWSRYYTWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKNYMTMSEYLDANDDDRARTGNDKEMYTVTYNQNFTDARVSVYLNYSHHTYWDRQDQTNYNMMLSHYFNLGSLRNLSVSLTGYRYEYDKSADKGVYLSLSLPWGDNSTISYNGNYGSGADSNQVSLYHRIDDASHYTVSAGTSENHSSVDGYYSHDGTLAKVDLSANYHEGQYTSAGISLQGGATLTAHGGALHRTQNMGGTRLLIDADGVANVPVEGNGSAVYTNMFGKAVVADVNDYYRNQAYIDLNKLPENAEATKSVVQATLTEGAIGYRKFAVISGEKAMAVLRLQDGSHPPFGAEVKNDNQQQVGLVDDEGNVYLAGVKPGEHMTVSWEGESHCDISLPDPLPNDLFNGLLLPCQQKGGSAPVIPHDIQPVIQQQTQQVAPMEPPMSVSSNQ

SEQ ID NO: 23600 - protein, 249 aa, Escherichia coli TA124
MTKYLSAKTLTTVLSLLAATVSFSAQASVTPDRTRLIFNESDKSISVTLRNNDPKLPYLAQSWIEDEKGVKISSPLAVLPPVQRIDAMMNGQVKIQGLPDIHKLPADRESMFYFNVREIPPKSNKSNTLQIALQTRIKLFWRPKALEKNTTQNPWQHKVTLTRNGQEFTVNNPTPYYVIFSNASAQKNGNPAAGFSPIVMSPKTSAPLNVKMGSVPVLTYVNDYGARMPLFFTCNGNSCQVDEEQSRKG

SEQ ID NO: 23601 - protein, 274 aa, Escherichia coli TA124; identical to SEQ ID NO: 8643

SEQ ID NO: 23602 - protein, 200 aa, Escherichia coli TA124; identical to SEQ ID NO: 7474

SEQ ID NO: 23603 - protein, 660 aa, Escherichia coli TA124; identical to SEQ ID NO: 8092

SEQ ID NO: 23604 - protein, 193 aa, Escherichia coli TA124; identical to SEQ ID NO: 6300

SEQ ID NO: 23605 - protein, 746 aa, Escherichia coli TA124; identical to SEQ ID NO: 8607

SEQ ID NO: 23606 - protein, 208 aa, Escherichia coli TA124; identical to SEQ ID NO: 5717

SEQ ID NO: 23607 - protein, 351 aa, Escherichia coli TA124; identical to SEQ ID NO: 22737

SEQ ID NO: 23608 - protein, 236 aa, Escherichia coli TA124; identical to SEQ ID NO: 7814

SEQ ID NO: 23609 - protein, 803 aa, Escherichia coli TA124
MTAFRAAFKAYRMHQVLLLPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLADASTEFDIGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSIKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKMRTRPVFIPTGVAMPYYHLRQNIEKIVSLLTRIPLQIMLNWMKPLSLSSQLTVLLPEQHLMHKSAGKY

SEQ ID NO: 23610 - protein, 539 aa, Escherichia coli TA124
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKTVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPSSDSTDPVDMRMYLRCQGDAISETWLYQYFPPAPDKRQYVDDRVMS

SEQ ID NO: 23611 - protein, 700 aa, Escherichia coli TA124
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAEMAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 23612 - protein, 360 aa, Escherichia coli TA124; identical to SEQ ID NO: 5879

SEQ ID NO: 23613 - protein, 869 aa, Escherichia coli TA124
MKIPTTTDIPQRYSWCLAGICYSSLAILPSFLSYAESYFNPAFLLENGTSVADLSRFERGNHQPAGVYRVDLWRNDEFIGSQDIVFESTTENTRDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 23614 - protein, 230 aa, Escherichia coli TA124; identical to SEQ ID NO: 6360

SEQ ID NO: 23615 - protein, 366 aa, Escherichia coli TA124; identical to SEQ ID NO: 7946

SEQ ID NO: 23616 - protein, 866 aa, Escherichia coli TA143; identical to SEQ ID NO: 14734

SEQ ID NO: 23617 - protein, 243 aa, Escherichia coli TA143; identical to SEQ ID NO: 21271

SEQ ID NO: 23618 - protein, 747 aa, Escherichia coli TA143
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPDNSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPTNSFKVGSYTVVDALVRYDLARVGMAGSNVALHVNNLFDREYVASCFNTYGCFWGAERQVVATATFRF

SEQ ID NO: 23619 - protein, 266 aa, Escherichia coli TA143; identical to SEQ ID NO: 8089

SEQ ID NO: 23620 - protein, 161 aa, Escherichia coli TA143; identical to SEQ ID NO: 5769

SEQ ID NO: 23621 - protein, 816 aa, Escherichia coli TA143; identical to SEQ ID NO: 14730

SEQ ID NO: 23622 - protein, 162 aa, Escherichia coli TA143
MRIITALLMSFFILPVHAGVVIYGTRIIYPEKNREVLVQLMNQSKNASLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSLSQLNIKKKITPSQ

SEQ ID NO: 23623 - protein, 789 aa, Escherichia coli TA143; identical to SEQ ID NO: 8085

SEQ ID NO: 23624 - protein, 351 aa, Escherichia coli TA143; identical to SEQ ID NO: 5767

SEQ ID NO: 23625 - protein, 230 aa, Escherichia coli TA143; identical to SEQ ID NO: 6360

SEQ ID NO: 23626 - protein, 869 aa, Escherichia coli TA143
MKIPTTTDIPQRYTWCLAGICYSSLAISPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHSGS

SEQ ID NO: 23627 - protein, 243 aa, Escherichia coli TA143
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPSPEKNSGHAVLQVAIQSRIKVFWIPSALRKKAGEKVELQLQVSQQGNQLNLKNPTGYYLTIAYLGRNEQGILPGFKTVMVAPFSTVNTNTGSYSGRQFYLGYMDDYGALRMTTLNCSGQCRLQAVEAKK

SEQ ID NO: 23628 - protein, 816 aa, Escherichia coli TA143
MNIYRLSFISCLVMAIPSALAVEFNLNVLDKSMRDRIDISLLKGKGGIAPGEYFVSVAVNNNQISNGQKIDWKKNGDQTIPCINDLLVDKFGLKPEVRQSLPRLNQCVDFSSRPEILFIFDQASQQLNITIPQAWLAWHSDNWTPPSTWKEGVAGVLMDYNLFASSYRPQDGSNSTNLNAYGTAGINAGAWRLRSDYQLNQTDSDDNHEQSGEISRTYLFRPLPQLGSKLTLGETDFSSNIFDGFSYTGAALASDDRMLPWELRGYAPQISGIAQTNATVTVSHSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISGDDYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNFNLYANLLHQTWWNADASTTANITAGFNVDIGNWRDISISTSFNTTHYEDKDRDNQIYLSISLPFGNGGRVGYDMQNSNHSTTHRMSWNDTLDERNSWGMSTGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVADNVIKETWIEGAIGYKSLASRSGKDVNVIIRNASGQFPPLGADIRQEDSGISVGMVGEEGHAWLSGVAENQQFTVVWGDSQHCSLYLPEHMENTANRLILPCH

SEQ ID NO: 23629 - protein, 760 aa, Escherichia coli TA143; identical to SEQ ID NO: 8074

SEQ ID NO: 23630 - protein, 362 aa, Escherichia coli TA143; identical to SEQ ID NO: 5813

SEQ ID NO: 23631 - protein, 656 aa, Escherichia coli TA143
MRLKKRYLCTALSLAFTQQAVAAQESDSLTVWSSPVSSTTTTILDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGIEYTF

SEQ ID NO: 23632 - protein, 565 aa, Escherichia coli TA143
MKSPTPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 23633 - protein, 207 aa, Escherichia coli TA143; identical to SEQ ID NO: 5743

SEQ ID NO: 23634 - protein, 746 aa, Escherichia coli TA143; identical to SEQ ID NO: 8052

SEQ ID NO: 23635 - protein, 193 aa, Escherichia coli TA143; identical to SEQ ID NO: 6300

SEQ ID NO: 23636 - protein, 430 aa, Escherichia coli TA143; identical to SEQ ID NO: 5758

SEQ ID NO: 23637 - protein, 332 aa, Escherichia coli TA143; identical to SEQ ID NO: 5757

SEQ ID NO: 23638 - protein, 203 aa, Escherichia coli TA143; identical to SEQ ID NO: 8073

SEQ ID NO: 23639 - protein, 517 aa, Escherichia coli TA143; identical to SEQ ID NO: 6817

SEQ ID NO: 23640 - protein, 191 aa, Escherichia coli TA143; identical to SEQ ID NO: 8071

SEQ ID NO: 23641 - protein, 232 aa, Escherichia coli TA143; identical to SEQ ID NO: 7454

SEQ ID NO: 23642 - protein, 729 aa, Escherichia coli TA143
MLSTQFNRDNQYQAITKPSLLAGCIVLALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEMGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPIIGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTRYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 23643 - protein, 213 aa, Escherichia coli TA143; identical to SEQ ID NO: 5744

SEQ ID NO: 23644 - protein, 111 aa, Escherichia coli TA143; identical to SEQ ID NO: 5889

SEQ ID NO: 23645 - protein, 541 aa, Escherichia coli TA143
MAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPSSDSTDPVDMRMYLRCQGDAISETWLYQYFPPAPDKRQYVDDRVMS

SEQ ID NO: 23646 - protein, 871 aa, Escherichia coli TA143
MHQVLLLPRFARLTIALGLATAVFPVDAEYYFNPRFLSNDLAESVDLSAFTKGREAPPGTYRVDIYLNDEFITSRDITFIADDNNADLIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSIKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGKNKNGSIVAENGQVYLTGLPQSGKLQVSWGKDKNSNCIVEYKLPEVSPGTLLNQQTAICR

SEQ ID NO: 23647 - protein, 236 aa, Escherichia coli TA143; identical to SEQ ID NO: 14777

SEQ ID NO: 23648 - protein, 202 aa, Escherichia coli TA143
MKDSWMLTSVLRQNLQRDTFNEFTLQVANNSYASSFASFSDASNTMAHGRYYYGDHTNGIAWRLISQGEMYLTDNIIMANALVYSHGEDVYSYESGAHSDFDSIRTVVRPAWIWNTWNQTGLELGWFKQQNKTQQGVTLNESAYKTTLWHALKVGESILGSRPEIRFYGTYINILDNELSNFKFNENSKDEFMAGIQAEVWW

SEQ ID NO: 23649 - protein, 118 aa, Escherichia coli TA143 [sequence omitted]

SEQ ID NO: 23650 - protein, 700 aa, Escherichia coli TA143; identical to SEQ ID NO: 8120

SEQ ID NO: 23651 - protein, 366 aa, Escherichia coli TA143; identical to SEQ ID NO: 7432

SEQ ID NO: 23652 - protein, 823 aa, Escherichia coli TA143
MTPLASAIVALLLGIEAYAAEETFDTHFMIGGVKDQQVANIRLDDNQPLPGQYDIDIYVNKQWRGKYEIIVKDNPQETCLSREIIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGTWKSNTLYLERGFAQLLGTLRVGDMYTSSDIFDSVRFSGVRLFRDMQMLPNSKQNFTPRVQGIAQSNALVTIEQNGFVVYQKEVSPGPFAITDLQLAGGGADLDVSVKEADGSVTTYLVPYAAVPNMLQPGVSKYDFAAGRSHIEGASKQSEFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTTRRQIYMSNSTTFDDQGFASNNTGLSGTVGSRDQFNYGVNLSHQYQGNETTVGANLTWNAPVATVNGSYSQSSTYRQAGASVSGGIVAWSGGVNLANRLSETFAVMNASGIKDAFVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGFSCTITFGKEIDESKNYICQ

SEQ ID NO: 23653 - protein, 154 aa, Escherichia coli TA143
MLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSINVKSNNANNWYLTIIDDNGNYISDKI

SEQ ID NO: 23654 - protein, 659 aa, Escherichia coli TA143; identical to SEQ ID NO: 5736

SEQ ID NO: 23655 - protein, 200 aa, Escherichia coli TA143; identical to SEQ ID NO: 7474

SEQ ID NO: 23656 - protein, 518 aa, Escherichia coli TA143; identical to SEQ ID NO: 6358

SEQ ID NO: 23657 - protein, 828 aa, Escherichia coli TA143
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISKPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEDVWPEELLAKKPELRGKTLYEVLYATPEVSKFPLSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 23658 - protein, 162 aa, Escherichia coli TA143; identical to SEQ ID NO: 8101

SEQ ID NO: 23659 - protein, 367 aa, Escherichia coli TA143; identical to SEQ ID NO: 5785

SEQ ID NO: 23660 - protein, 274 aa, Escherichia coli TA143; identical to SEQ ID NO: 8643

SEQ ID NO: 23661 - protein, 249 aa, Escherichia coli TA143
MTKYLSAKTLTTVLSLLAATVSFSAQASVTPDRTRLIFNESDKSISVTLRNNDPKLPYLAQSWIEDEKGVKISSPLAVLPPVQRIEAMMNGQVKIQGLPDIHKLPADRESMFYFNVREIPPKSNKSNTLQIALQTRIKLFWRPKALEKNTTQNPWQHKVTLTRNGQEFTVNNPTPYYVIFSNASAQKNGNPAAGFSPIVMSPKTSAPLNVKMGSVPVLTYVNDYGARMPLFFTCNGNSCQVDEEQSRKG

SEQ ID NO: 23662 - protein, 879 aa, Escherichia coli TA143
MPEHSFLRLRGLSWWIALAISGSPFNALADDTVQFDGRFLDLKGNTKIDLGRFSQKGYVEPGKYNLRVHVNNQPLPDDYDIYWYATENDPNKSYACLSPELVAQFGLKEDIAKNLQWIRDGQCLNTALLAGTEISGDLGQSALLVSVPQAYLEYTDSEWDPPSRWDDGIPGLIADYSINAQTRHENGGDDTNDISGNGTVGVNVGPWRLRADWQSDYQHTRSNDDGDTDDSGTQKNWEWSRYYAWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKNYMTMSEYLDANDDDRARTGNDKEMYTVTYNQNFTDARVSVYLNYSHHTYWDRQDQTNYNMMLSHYFNLGSLRNLSVSLTGYRYEYDKSADKGVYLSLSLPWGDNSTISYNGNYGSGADSNQVSLYHRIDDASHYTLSAGTSENHSSVDGYYSHDGTLAKVDLSANYHEGQYTSAGISLQGGATLTAHGGALHRTQNMGGTRLLIDADGVANVPVEGNGSAVYTNMFGKAVVADVNDYYRNQAYIDLNKLPENAEATKSVVQATLTEGAIGYRKFAVISGEKAMAVLRLQDGSHPPFGAEVKNDNQQQVGLVDDEGNVYLAGVKPGEHMTVFWEGESHCDISLPDPLPNDLFNGLLLPCQQKGGSSPVIPHDIQPVIQEQTQQVTPMEPPMSVSSNQ

SEQ ID NO: 23663 - protein, 432 aa, Escherichia coli TA143; identical to SEQ ID NO: 5727

SEQ ID NO: 23664 - protein, 359 aa, Escherichia coli TA143; identical to SEQ ID NO: 5847

SEQ ID NO: 23665 - protein, 686 aa, Escherichia coli TA143; identical to SEQ ID NO: 15667

SEQ ID NO: 23666 - protein, 567 aa, Escherichia coli TA143
MKIKLRITIILISALCIFNGLLTPGAYAATANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGGGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIIATAGAPETDNIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 23667 - protein, 713 aa, Escherichia coli TA143; identical to SEQ ID NO: 23061

SEQ ID NO: 23668 - protein, 222 aa, Escherichia coli TA143; identical to SEQ ID NO: 14796

SEQ ID NO: 23669 - protein, 678 aa, Escherichia coli TA143; identical to SEQ ID NO: 21300

SEQ ID NO: 23670 - protein, 412 aa, Escherichia coli TA143; identical to SEQ ID NO: 21980

SEQ ID NO: 23671 - protein, 259 aa, Escherichia coli TA143; identical to SEQ ID NO: 8094

SEQ ID NO: 23672 - protein, 250 aa, Escherichia coli TA143; identical to SEQ ID NO: 17298

SEQ ID NO: 23673 - protein, 243 aa, Escherichia coli TA143; identical to SEQ ID NO: 14800

SEQ ID NO: 23674 - protein, 660 aa, Escherichia coli TA143; identical to SEQ ID NO: 8092

SEQ ID NO: 23675 - protein, 614 aa, Escherichia coli TA143; identical to SEQ ID NO: 14804

SEQ ID NO: 23676 - protein, 208 aa, Escherichia coli TA143; identical to SEQ ID NO: 5717

SEQ ID NO: 23677 - protein, 237 aa, Escherichia coli TA143; identical to SEQ ID NO: 6384

SEQ ID NO: 23678 - protein, 368 aa, Escherichia coli TA143
MNKTITALTIIMASFAANASVLPETPVPFKSGTGAIDNDTVYIGLGSAGTAWYKLDTQAKDKRWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGDNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 23679 - protein, 241 aa, Escherichia coli TA143; identical to SEQ ID NO: 6143

SEQ ID NO: 23680 - protein, 878 aa, Escherichia coli TA143
MSYLNLRLYQRNTQCLHIRKHRLAGFFVRLFVACAFTAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQMADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 23681 - protein, 446 aa, Escherichia coli TA143; identical to SEQ ID NO: 7485

SEQ ID NO: 23682 - protein, 746 aa, Escherichia coli TA206; identical to SEQ ID NO: 6783

SEQ ID NO: 23683 - protein, 431 aa, Escherichia coli TA206; identical to SEQ ID NO: 6791

SEQ ID NO: 23684 - protein, 159 aa, Escherichia coli TA206
MTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 23685 - protein, 362 aa, Escherichia coli TA206; identical to SEQ ID NO: 5874

SEQ ID NO: 23686 - protein, 823 aa, Escherichia coli TA206
MTPLASAIVALLIGIEAYAAEETFDTHFMIGGMKDQQVSNIRLEDNQPLPGQYDIDIYVNKQWRGKYEIIVKDNPQETCLSREMIKRLGINTDSFASGKQCLTFKQLIQGGSYTWDIGVFRLDFSVPQAWVEELESGYVPPENWERGINAFYTSYYMSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNVLVTIEQNGFVVYQKEVPPGPFAITDLQLAGGGADLDVSVKEADGSVTTYLVPYAAVPNMLQPGVSKYDFAAGRSHIEGASKQSDFVQAGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 23687 - protein, 224 aa, Escherichia coli TA206; identical to SEQ ID NO: 16503

SEQ ID NO: 23688 - protein, 193 aa, Escherichia coli TA206; identical to SEQ ID NO: 6300

SEQ ID NO: 23689 - protein, 331 aa, Escherichia coli TA206
MKKTVVIGLAVVVLAAVVAGGYWWYQSRQDNGLTLYGNVDIRTVSLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLVAPSDGTLLTRAVEPGTVLNEGGTVFTVSLTRPVWVRAYVDERNLDQAQPGRKVLLYTDGRPNKPYHGQIGFVSPTAEFTPKTVETPDLRTDLVYRLRIVVTDADDALRQGMPVTVQFGDEAGHE

SEQ ID NO: 23690 - protein, 517 aa, Escherichia coli TA206; identical to SEQ ID NO: 6817

SEQ ID NO: 23691 - protein, 191 aa, Escherichia coli TA206; identical to SEQ ID NO: 16539

SEQ ID NO: 23692 - protein, 232 aa, Escherichia coli TA206; identical to SEQ ID NO: 5747

SEQ ID NO: 23693 - protein, 729 aa, Escherichia coli TA206; identical to SEQ ID NO: 17732

SEQ ID NO: 23694 - protein, 213 aa, Escherichia coli TA206; identical to SEQ ID NO: 5744

SEQ ID NO: 23695 - protein, 700 aa, Escherichia coli TA206; identical to SEQ ID NO: 16513

SEQ ID NO: 23696 - protein, 203 aa, Escherichia coli TA206; identical to SEQ ID NO: 7450

SEQ ID NO: 23697 - protein, 656 aa, Escherichia coli TA206
MRLKKRYLCTVLSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSHDNAYDMHASFAASSDLGYLQVSGSQLKQDFLGLPHGVNNDIAGKHGKMINSSADDKHGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSIYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 23698 - protein, 565 aa, Escherichia coli TA206
MKSPAPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 23699 - protein, 207 aa, Escherichia coli TA206; identical to SEQ ID NO: 5882

SEQ ID NO: 23700 - protein, 874 aa, Escherichia coli TA206
MTAFRAAFKAYRMHQVLILTRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGNLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNVQIGGKVLMTLKYGNKSVPFGAIVTHGENKNGSIVAENGQVYLTGLPQSGKLQVSWGKDKTQTVLSSTSFLKFLLVPY

SEQ ID NO: 23701 - protein, 236 aa, Escherichia coli TA206; identical to SEQ ID NO: 7624

SEQ ID NO: 23702 - protein, 130 aa, Escherichia coli TA206; identical to SEQ ID NO: 7726

SEQ ID NO: 23703 - protein, 673 aa, Escherichia coli TA206
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTHATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 23704 - protein, 641 aa, Escherichia coli TA206; identical to SEQ ID NO: 8755

SEQ ID NO: 23705 - protein, 828 aa, Escherichia coli TA206
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYDVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 23706 - protein, 162 aa, Escherichia coli TA206; identical to SEQ ID NO: 5896

SEQ ID NO: 23707 - protein, 376 aa, Escherichia coli TA206; identical to SEQ ID NO: 16523

SEQ ID NO: 23708 - protein, 200 aa, Escherichia coli TA206; identical to SEQ ID NO: 5898

SEQ ID NO: 23709 - protein, 721 aa, Escherichia coli TA206; identical to SEQ ID NO: 6807

SEQ ID NO: 23710 - protein, 351 aa, Escherichia coli TA206; identical to SEQ ID NO: 14680

SEQ ID NO: 23711 - protein, 274 aa, Escherichia coli TA206
MNKTAIALLALLASSASLAATPWQKITQPVPGSAQSIGSFSNGCIVGADTLPIQSEHYQVMRTDQRRYFGHPDLVMFIQRLSRQVSNLGMGTVLIGDMGMPAGGRFNGGHASHQTGLDVDIFLQLPKTRWTSAQLLRPQALDLVSRDGKHVVPTLWKPEIFSLIKLAAQDKDVTRIFVNSAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 23712 - protein, 250 aa, Escherichia coli TA206; identical to SEQ ID NO: 6150

SEQ ID NO: 23713 - protein, 882 aa, Escherichia coli TA206
MPNHSNFRLRGIACYIALAISGGSVNAWADDSIQFDPRFLELKGDTKIDLGKFSKKGYVDAGKYNLRVFINKHPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGGADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSADGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 23714 - protein, 518 aa, Escherichia coli TA206
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEVAMQLAQDYPAVSPTELGKEKFPFLSFLSQSSSNYLTHTPSLLFSRKGSEEKQN

SEQ ID NO: 23715 - protein, 359 aa, Escherichia coli TA206
MKKYLALALIAPLLISCSTTKKGNTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRANNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 23716 - protein, 732 aa, Escherichia coli TA206
MMRKKYMPRALGPLLLVVLSPVAAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRFYPFPTVNANKQATAFSSSQQDTDQYGMKLTLNSQLMDGWQITWGLDAEHERFTSNQMFFDLAQASASGGMNNHKIYTTGRYPSYDITNLAAFLQSSYDINDIFTVSGGVRYQYTENRVDDFIGYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGANFNVLKTESKVNGQWQKYNVKESSPSKATAYISWAPDPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 23717 - protein, 655 aa, Escherichia coli TA206
MHVIKVVIGILVVLSPALQVATAHPSSPDKDTITVVATGNQNTVFETPAMVSVVTRETPWSQNAVTSAGMMRGVAGLSQTGAGRTNGQTFNLRGYDKSGVLVLVDGVRQLSDMAKSSGTWLDPALVKRVEVVRGPNSSLYGSGGLGGVVDFRTADATDFLVPGEASGFRLWGNTASGDHSTGSGLTWFGKTEKTDALLSVIMRKRGSLYQSDGGHAPNEERPASVFAKGSVRLTDASKAGASLRLYRNVTTEPGNPTLTRGDSGLRDRKTVQNDVQLWHQYAPADRSLINLKSTIYLSDTTIRTEGESKTAEWRNNRTSGVNIVNRSHTLIFPGAHQLSYGAEYYRQQQSPEGSATLYPEGDISFSSLYFQDEMTMEDYPVNVIVGTRYDRYRSHNPRAGELKAGRWSPRAAISVSPTDWLMMYGAVSSAFRAPTMAEMYRDDVHFYRRGKPNYWIPNPDLKPENNITREVGVGFQMDSLFTANDHFQVKGGYFGTDARNYIATRVDMKRMRSYSYNVSRARIWGWDVQGNYQSDYADWTLSYNRTESIDADSREWLGTGNPDTLISDISLPVGHEGIYAGWRAELSAPVSHVKKGDSHQAGYAIHSFSLSYKPAMVKGFEASVTLDNAFNKLAMNGKGVPLSGRSISLYTSYQW

SEQ ID NO: 23718 - protein, 231 aa, Escherichia coli TA206
MMKHMRIWAVLASFLVFFYIPQSYAGVALGATRVIYPEGQKQVQLAVTNNDDKSSYLIQSWIENAEGKKDARFVITPPLFSMQGKKENTLRIIDATNGQMPEDRESLFWVNVKAIPAMDKAKTGENYLQFAIVSRIKLLYRPQGLVIPPEQAPGKLEFTRENGGLTLLNPTPYYLTVTDLKAGNKSLENTMVPPQGKVTVNIPGGYTGGDITYKTINDYGALTEQVRGGVK

SEQ ID NO: 23719 - protein, 876 aa, Escherichia coli TA206
MFSGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVPLRSRLTMGDSYTRGDIFDGVNFRGIQLASDDNMVPDSQRGYAPTIHGISRGTSRINIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTASCR

SEQ ID NO: 23720 - protein, 830 aa, Escherichia coli TA206
MKHHDFISGKVSRALAIVLCAFPPFSGGAENTETVYQFNDGFIVGSRERVDLSRFSTSAIDEGVYSLDVYTNGEWKGRYDLNVRRRQDGQSGVCYTREMLVQYGIAAEKLNRRLSGQAGYCGPLKAWRSEDNVHDTLIPSSLRLEISVPQIYEDQRLKDYVSPAFWDKGITALSLGWTANAWNNHESGQGEDNNSVYLGLNGGLSWNGWLLKHIGNLNWQEQQGGAHWSSNQTYLQRPLPAMNAILSGGQFFTSGEFFDTTGMRGVNLATDDNMFPDGMRSYAPEIRGVARSNALVTVRQGNNIIYQTTVPPGPFILQDVYPSGYGSDLDVSVKEADGTVNVFSVPYASVTQLLRPGMTRYAFSAGKADDDFLRHKPVLWQATWQHGLSNMFTGYTGVTGFNDYQAFLLGTGMNTGIGALSFDVTHSRLKSDMLDESGQSWRATFNRMFTETQTSIVLAAYRYSTRGYYNLNDALYAVDQTRNKRNNYVLWREKNGMTFTVNQNLPEGWGGFWLSGRVSSYWDRSGTEKQYQMSYNNSAGRLSWSVSAQRVYTHDSSGHRRDDRVSLNFSLPLWFGENRTANLTSNTVFSNSHFSSSQTGINGSLDSENNLSYGISTTTTTGGRHDVALNGSWRMPWTTLNGSYSQGSGWRQSGIGGSGTLIVHSGGVTLSPETGSTMALIEARDAKGAMLPGSPGTRVDGNGYAVLPYLRPYRINSVEIDPKGSEDDVKFDRTVARVVPWEDSVVKITFATEVQNTLTLPVHRADGRPLPFAATIYDPAGREIGVVGQGSMMFINRAGATRAVVRWAGGQCSTALDPVSALKTKELVCR

SEQ ID NO: 23721 - protein, 233 aa, Escherichia coli TA206
MKCTAFFLCAIFSFAASASNIIVNGTRFIYPGNEKEITVQLSNTADRPALAQVWLDNGNPDATPDTITTPFIITPPISRVDAKSGQTLRIKLGSNVGLAKDKETLWWLNILEIPPVETGGKNEGQSVLQLAIRSRFKFIYRPSGLGNRDTAPEKLVLSASGNRLSISNPTPFWITVSRIARGDGKNLNDKVVMLAPQSGQTILLSSAVGRGEALIVNNINDYGADVAVKVTVK

SEQ ID NO: 23722 - protein, 686 aa, Escherichia coli TA206
MFWRDMTLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 23723 - protein, 713 aa, Escherichia coli TA206; identical to SEQ ID NO: 17773

SEQ ID NO: 23724 - protein, 222 aa, Escherichia coli TA206; identical to SEQ ID NO: 5850

SEQ ID NO: 23725 - protein, 678 aa, Escherichia coli TA206
MVPSTFSRLKAARCLPVVLAALIFAGCGTHTPDQSTAYMQGTAQADSAFYLQQMQQSSDDTRINWQLLAIRALVKEGKTGQAVELFNQLPQELNDTQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQSQPQTVDDVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGPVLQQKFGSTSELRAGVNGGSGIALTGSPITPRETTDSGMTTNNPTLQTTPTDDQFTNNGSRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 23726 - protein, 432 aa, Escherichia coli TA206; identical to SEQ ID NO: 5727

SEQ ID NO: 23727 - protein, 654 aa, Escherichia coli TA206; identical to SEQ ID NO: 8265

SEQ ID NO: 23728 - protein, 645 aa, Escherichia coli TA206
MGAANCPGDAKENDASNPWRYVRAATATEITQYGNPASCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPGGDNPWKKYEPAKAWSASTVYVKGDRVVVDGQAYEALFWTQSDNPALIANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 23729 - protein, 412 aa, Escherichia coli TA206
MKQWIAALLLMLIPGVQAAKPQKVTLMVDDVPVAQVLQALAEQEKLNLVVSPDVSGTVSLHLTDVPWKQALQTVVKSAGLITRQEGNILSVHSVAWQNDNVARQEVEQTRAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 23730 - protein, 258 aa, Escherichia coli TA206
MRQYRLLSPMIKVVIVLFSLLFSTAQAGLVIGGTRFAYPENQSSISVELKNTSDRDMLVKVAVSPDDARQLTGTVESLPSYSETVFIATPPLFVLKPDKNTKIRINRVGGSLPADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPILKVKLNPSQLDVTGFAFSQ

SEQ ID NO: 23731 - protein, 250 aa, Escherichia coli TA206; identical to SEQ ID NO: 5862

SEQ ID NO: 23732 - protein, 660 aa, Escherichia coli TA206; identical to SEQ ID NO: 6837

SEQ ID NO: 23733 - protein, 843 aa, Escherichia coli TA206
MHWMHLPLDHYRAHFSFSLLALTIASALPAYGGKFNPKFLENVQGIDQHVDLSVYDSPVGQQIPGKYRVFVFVNEEKMASRTLDFSTASEAQRKASGESLMPCLSRVQLEEMGVRIDSFPALKILPPEACVAFDEIIPQATSRFDFNTQTLHLTFPQAAMMMTARGTVDPSRWDEGIPALLLDYSFSGSNGRNEGSGSSPDSTSNSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKESDGSEQRFIQPFSAVAIFQREGYLKYSLAAGEYRAGNYDSGKPRFGQFTAMYGLPWGMTAYGGALLSADYNALALGLGKNFGTIGAVSVDVTQAKSQLRNNEKDEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSIAYTWTRSPEWDEDDRLWSFSLSIPLGGAWGSYRMTTDQNGKTSQQASVSGTLLEDRNLNYNVQQGYTSNGVGNSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAIVRSRFDTRVGYRVLMSLKRANGNAVPFGATAALSDESKPASSIVGEEGQLYISGMPEEGELQVSWGHEQAQRCRVPFRLPEKKDNSGIVMVNAVCDK

SEQ ID NO: 23734 - protein, 228 aa, Escherichia coli TA206; identical to SEQ ID NO: 5866

SEQ ID NO: 23735 - protein, 231 aa, Escherichia coli TA206; identical to SEQ ID NO: 8424

SEQ ID NO: 23736 - protein, 785 aa, Escherichia coli TA206; identical to SEQ ID NO: 16495

SEQ ID NO: 23737 - protein, 234 aa, Escherichia coli TA206
MCNFYSAFVLVSALFCSCAGAASFGPRESMLIFDGRQSSTSYRMDNSDVRLPWLVQAWVEDINEKRTDVFTTVPLVFRVEPSSTFTVRIVKKGTVPEDRETLYWAVSNSLPGGERSEQKTDGDKISAQLSLAYRFKIPLIYRPALLASKPQQPEALRWHVGKSGKITVHNPTRYVVQLNYVNAGGKRYQGRGVSWFISPETSVTVDVSVGTGSRIKYGVVNDYGAVREYEGVVR

SEQ ID NO: 23738 - protein, 835 aa, Escherichia coli TA206
MRLRKKLLLLSLLVFISNRAMGGDYFDTSLLAAGIDGENIDLSVFSHPGGGIEGEQEVSVQVNDNFYTRKTLHFRNSGDKGLLPDFPAGFFDDLLAPEYRPVQKDALLSSADFMSQTPYSSVTFNQGEGRVDIRVPQAFLGRAAQLRSSPDTWENGVPALLMDYSLTGNRNDSDDYSSRSLYASARLGLNVGPWRLRTSGNYSQYQSESRWWHSRTENTSFYSTWLERDISALRASLRIGKVSTGGMILDSVSFRGVRLYSNDDMLSSRLRNYSPTVKGFARTQAVVVITQNGRQVYQTNVPAGPFELNDFYISGYSGDLVVTVRESDGSEHSFIQPFSTLPEMKREGVSGFELSAGRYDNYGSEDYYNDPLFVYGAWSRGFGGGVTVFGETLQAGKYQSAGIGSTLSLGRVGAVSADISVSRAEKYDDIHTGQSYGLKYSKSQVETGTTVTLATYRYSTKDFYTFGDFVSRTEQARYVWENRLKNRMTLSLNQSLGSLGSVSLSASQQDYWTSGEVNRAFSLSHSFSWQDIYFSTTFSMDQMSGNRYGYDNNRQIDFYMSVPLSRLLGREEPTSSSVSWSATRTERQLRQTATLSGSVPDTRMRYRVAGNWGNGGAAEGQSASLTWNGDFTTASLGYTRSGGYRTTDFSLSGAAVAWAGGVAFGSNSVTDNGAIVVNTSGVSGIGTSAGGRTTWPGTALISSPQLYTENRIDLRTDGLPDDIVLAETSARTVPSRGAVVVLDYTVYRGGQVVFTLKRPDGSALPFGSVVSLDGMPAGKENTGIVGDEGRVYLAGVPEKGRLTVNSGGKQCHADFVLSKNRKQAGPVAEAVAVCR

SEQ ID NO: 23739 - protein, 369 aa, Escherichia coli TA206
MKKLTVTISAVATAVLMAVSAQAAEIYNKDGNKLDLYGKVDGLHYFSSNKDENGDKSYMRMGIKGETQINDDLTGYGHWEYQIQANTPENENHAWTRLAFAGLKLSDYGSLDYGRNYGVVYDVTSWTDVLPEFGGDTYSADNFMQGRGNGFATYRNTDFFGLVDGLNFAVQYQGENGGVSGENTTNNGRGALRQNGNGVGGSITYEYDGFSIGGAVSSSQRTWDQNHTGLMGTGNRAETYTGGLKYDANNVYLAAQYTQTYNATLAGNLGWANKAQNLELVAQYQFDFGLRPSLAFLQSKGKKLGSINGRNYDNQDILKYVDVGATYYFNKNMSTYVDYKINLLKDNQFTRDAGINTDDIVAVGLVYQF

SEQ ID NO: 23740 - protein, 243 aa, Escherichia coli TA206
MQKMKPALKKTLMAVACLSAVPAAQAAISLDRTRAIFNGDEKSMTLNIANDNKQLPYLAQAWVENEKKEKITTGPIIATPPVQRLEPGSKSMVRLTSTPDISRLPQDRESLFYFNLREIPPKSDKANVLQIALQTKIKLFYRPESIKAKPNAVWQDQLVLNKTGGGYQIDNPTPYYVTVIGIGGSEKQAREGEFDAVMLAPKSTQMVKSGTYSTPYLSYINDYGGRPVLQFSCAGSRCTAVKK

SEQ ID NO: 23741 - protein, 819 aa, Escherichia coli TA206
MLSLAGVPVYAVDFNTDVLDAADRQNIDFSRFSRAGYIMPGQYQMEIRVNGQDISPSAFQIAFLEPPFSDSDNEKPLPEPCLTPEIVSRMGLTEASQEKVTYWNNGQCADFRQLSGVEIRPNPAEGMLYINMPQAWLEYSDASWLPPSRWDNGIPGLLFDYNINGTVNKPHQGKQSQSLNYNGTAGANFGAWRLRADYQGNLNHTTGSAQGTDSQFTWSRFYMYRAIPRWRANLTLGENYINSEIFSSWRYTGASLESDDRMLPPKLRGYAPQVSGIADTNARVVISQQGRILYDSTVPAGPFTIQDLDSSVRGRLDVEVIEQDGRKKTFQVDTAYVPYLTRPGQVRYKLVSGRSRTYEHTMEGPVFAAGEASWGISNTWSLYGGSIVAGDYNALAVGLGRDLSKFGTVSADVTQSVARIPGYDTKQGKSWRLSYSKRFDEVNTDITFAGYRFSERNYMTMDQYLNARYRNDFTGREKELYTVTLNKNFEDWKASVNLQYSHQTYWDRRTSDYYTLSVNRYFDAFSFKNIALGISASRSKYQNRDNDSAFVRLSVPWGTGTASYSGSMSNDRYTNTVGYSDTLNNGLSSYSLNAGVNSGGGQPSQRQMSAYYNHNGSLTNLSASFSAVENGYSSFGMSASGGATVTMKGAALHAGGMNGGTRLLVDTDGVGGVPVDGGRVSTNRWGIGVVTDVSSYYRNITSVDLNRLPEDMEASRSVVESVLTEGAIGYREFEVLKGSRLFAVLRLADNSHPPFGASVTNAKGRELGMVADSGLAWLSGVNPGETLNVGWDGRTQCVVDIPAHPDPAQQLLLPCRQVK

SEQ ID NO: 23742 - protein, 208 aa, Escherichia coli TA206; identical to SEQ ID NO: 5869

SEQ ID NO: 23743 - protein, 614 aa, Escherichia coli TA206; identical to SEQ ID NO: 16515

SEQ ID NO: 23744 - protein, 446 aa, Escherichia coli TA206; identical to SEQ ID NO: 5873

SEQ ID NO: 23745 - protein, 260 aa, Escherichia coli TA206; identical to SEQ ID NO: 6790

SEQ ID NO: 23746 - protein, 478 aa, Escherichia coli TA206; identical to SEQ ID NO: 6796

SEQ ID NO: 23747 - protein, 368 aa, Escherichia coli TA206
MNKTITALAILMASFAANASVLPETPVPFKSGTGVIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTTIDKINAHYFDKKAEDYFFNKFLLSFDPSTQQWSYAGESPWYGTAGAAVVNKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 23748 - protein, 241 aa, Escherichia coli TA206; identical to SEQ ID NO: 6140

SEQ ID NO: 23749 - protein, 878 aa, Escherichia coli TA206
MSYLNLRLYQRNTQCLHIRKHRLAGFFVRLFVACAFTAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 23750 - protein, 784 aa, Escherichia coli TA206; identical to SEQ ID NO: 16516

SEQ ID NO: 23751 - protein, 862 aa, Escherichia coli TA206
MTIKSTNHLTHIATFCALLYSNSALCAELVEYDHTFLMGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNATSEKIAQSIILNGLRCQIQ

SEQ ID NO: 23752 - protein, 246 aa, Escherichia coli TA206; identical to SEQ ID NO: 5857

SEQ ID NO: 23753 - protein, 752 aa, Escherichia coli TA206
MAPSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKMQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMIGYSFDHEFNDTFTVRQNLRFAQNKVSQKSVYGYGMCSDPLYTKDQEALKASPCLSIPQSQWGHTLTRQYVIDNEKLENFSVDTQLQSKFATGSVGHTLLTGVDFMRMRNDIDSWFGYAGSVAPSDIYNLDRSDFDFGAHPNPSGPYRVLLKQKQTGLYVQDQAQWDKVLVTLGGRYDWADQSSFNRDYGNKSERDDKEFTWRGGVNYLFDNGVTPYFSYSESFEPASQTDANGDLFAPSKGKQYEVGVKYVPEDRPIVVTGALYQLTKTNNLMADPNGSLFSVEGGEIRARGVELEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 23754 - protein, 266 aa, Escherichia coli TA206; identical to SEQ ID NO: 5772

SEQ ID NO: 23755 - protein, 161 aa, Escherichia coli TA206; identical to SEQ ID NO: 5769

SEQ ID NO: 23756 - protein, 368 aa, Escherichia coli TA271
MNKTITALTIIMASFAANASVLPETPVPFKSGTGAIDNDTVYIGLGSAGTAWYKLDTQAKDKRWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAYYFDKKAEDYFFNKFLLSFDPSTQQWSYAGESPWYGTAGAAVVNKGDKTWLINGEAKPGLRTDAVFELDFTGDNLKWNKLDPVSSPDGVAGGFAGISNDSLIFAGGAGFKGSRENYQNGKNYAHEGLKKSYSADIHLWYNGKWDKSGELSQGRAYGVSLPWNNSLLIIGGETAGGKAVMDSVLISVKDNKVTVQN

SEQ ID NO: 23757 - protein, 241 aa, Escherichia coli TA271; identical to SEQ ID NO: 6143

SEQ ID NO: 23758 - protein, 878 aa, Escherichia coli TA271
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMELNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSNSKSQWRHASASYSMSHDLNGRMTNLVGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 23759 - protein, 784 aa, Escherichia coli TA271; identical to SEQ ID NO: 6283

SEQ ID NO: 23760 - protein, 765 aa, Escherichia coli TA271
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARLSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 23761 - protein, 246 aa, Escherichia coli TA271; identical to SEQ ID NO: 6342

SEQ ID NO: 23762 - protein, 747 aa, Escherichia coli TA271; identical to SEQ ID NO: 6343

SEQ ID NO: 23763 - protein, 266 aa, Escherichia coli TA271; identical to SEQ ID NO: 5772

SEQ ID NO: 23764 - protein, 161 aa, Escherichia coli TA271; identical to SEQ ID NO: 5769

SEQ ID NO: 23765 - protein, 221 aa, Escherichia coli TA271; identical to SEQ ID NO: 8014

SEQ ID NO: 23766 - protein, 351 aa, Escherichia coli TA271; identical to SEQ ID NO: 19439

SEQ ID NO: 23767 - protein, 230 aa, Escherichia coli TA271; identical to SEQ ID NO: 8315

SEQ ID NO: 23768 - protein, 869 aa, Escherichia coli TA271; identical to SEQ ID NO: 8316

SEQ ID NO: 23769 - protein, 746 aa, Escherichia coli TA271; identical to SEQ ID NO: 6296

SEQ ID NO: 23770 - protein, 193 aa, Escherichia coli TA271; identical to SEQ ID NO: 6300

SEQ ID NO: 23771 - protein, 332 aa, Escherichia coli TA271; identical to SEQ ID NO: 5757

SEQ ID NO: 23772 - protein, 760 aa, Escherichia coli TA271; identical to SEQ ID NO: 16205

SEQ ID NO: 23773 - protein, 203 aa, Escherichia coli TA271; identical to SEQ ID NO: 6414

SEQ ID NO: 23774 - protein, 362 aa, Escherichia coli TA271; identical to SEQ ID NO: 5809

SEQ ID NO: 23775 - protein, 233 aa, Escherichia coli TA271; identical to SEQ ID NO: 6327

SEQ ID NO: 23776 - protein, 866 aa, Escherichia coli TA271; identical to SEQ ID NO: 8332

SEQ ID NO: 23777 - protein, 226 aa, Escherichia coli TA271
MIFAVLSLLVAGELQAGVVVGGTRFIFPADKESIAILLTNTSQESWLINSKINRPTRWAGGEVSTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAIAPCHVAWRAINDYGGLSAKKEQNLP

SEQ ID NO: 23778 - protein, 243 aa, Escherichia coli TA271; identical to SEQ ID NO: 6463

SEQ ID NO: 23779 - protein, 816 aa, Escherichia coli TA271; identical to SEQ ID NO: 6462

SEQ ID NO: 23780 - protein, 430 aa, Escherichia coli TA271; identical to SEQ ID NO: 5758

SEQ ID NO: 23781 - protein, 517 aa, Escherichia coli TA271; identical to SEQ ID NO: 6817

SEQ ID NO: 23782 - protein, 191 aa, Escherichia coli TA271; identical to SEQ ID NO: 5748

SEQ ID NO: 23783 - protein, 232 aa, Escherichia coli TA271; identical to SEQ ID NO: 5747

SEQ ID NO: 23784 - protein, 729 aa, Escherichia coli TA271; identical to SEQ ID NO: 6500

SEQ ID NO: 23785 - protein, 213 aa, Escherichia coli TA271; identical to SEQ ID NO: 5744

SEQ ID NO: 23786 - protein, 207 aa, Escherichia coli TA271; identical to SEQ ID NO: 5743

SEQ ID NO: 23787 - protein, 541 aa, Escherichia coli TA271; identical to SEQ ID NO: 6286

SEQ ID NO: 23788 - protein, 700 aa, Escherichia coli TA271; identical to SEQ ID NO: 7945

SEQ ID NO: 23789 - protein, 865 aa, Escherichia coli TA271
MPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYYSGSSNSSDSNKWQHINTSAERDIIPLRSRLTVGDSYTDGDIFDSVNFRGLKINSTEAMLPDSQHGFAQVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 23790 - protein, 236 aa, Escherichia coli TA271
MQTTRTPYSISFMATVLLLLLFACHSTVANAAVALGAKRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDITHAATGDISFQTINDYGALTPRIKATMQ

SEQ ID NO: 23791 - protein, 119 aa, Escherichia coli TA271; identical to SEQ ID NO: 5986

SEQ ID NO: 23792 - protein, 732 aa, Escherichia coli TA271; identical to SEQ ID NO: 8819

SEQ ID NO: 23793 - protein, 231 aa, Escherichia coli TA271
MLRNITAIIVAFLVINVANASVILNNTRIVIDNAKMEKNVQFTNSGDNPVLVQIQAQENGENDCPPFIALPAVFRMLPGAGQTVKVSLTKRDIPKDRESLFYMDYIEVPSVKKDDQNRNKLYLIIRSRVKVIFRPEGLVFSVNKLHKQLSYEQFGNIVTIKNNSPFYANIRSFYLTGKTGNINYPGSVTVPPYGESRVQVKKVGETYAGLKMTALIINDFGADEKVDIAKK

SEQ ID NO: 23794 - protein, 839 aa, Escherichia coli TA271
MKKISFIHPFLLPGFILLTCSVQAAETVNDYIFDPSLLRDAIPGRISVTNGANDPYFQPGTYDVDIYLNGKYQSTASLDLIRDKGKISVCLPPRLYRAFAVREAYLAALPEKECSNPEYLLKGTSVSVDTASLRVDVIIPQAMLDIRPDDYISPENLTAGSTMGFINYNVNQFYSNYKNADHFESTYLGFNDGINIGKWRFRQQGNFTHNEYGNHWQHTRTWLQRAFPSLRSEISVGDIFSSGGQFNAVSYRGIRLSSDARMLPDSLRGYAPEVRGMAGSNARVSVWQGKQQIYQTTVPPGPFVIDNLSPVSYGGDLNVEVQESDGRHRRFRVPYAILPESLRPGRTDYSFSAGKVGDYTRYNNFVEMTVKRGLTNALTMNGGLRLANNYRSVLAGGVWASELGAFGLNSAFSSADFRNGESSRGWRYELNYSRTFAPTNTTLTFAGYRYSTQGYRDLNDVIVLNNNSIPGSDGSSSEYLQRNRMQLTLNQPLGDLGSLYVSWAQQNYYDHRSHDTQYQIGYGTVLPGNISMNFTMARQYSVMARHSDIRQNLAAQTNEYNEYRKDMHFQINFSIPLSNASDSSYLTLGGSSDNSYNASLSGLMGENNKMSYSININRDQQQRDTAFSGSLNRKTNLMNLTTTASKSSKFSQMSVNAMGAAVLHSGGLSLGNYLSDSFALVEAKGAHGARIMGQGIEIDHNGYALVPSLMPYHYNTIALDSSGSNRQVEVLSSQKTVAPYAGAMVRVKFQTLQGYAVMMKASTNRDENVPMGADVIDANGKTIGTFGQGSNAYLRLNDTKGTLKAVWGDAPGQSCQINYQIPAPKPDAVITYANAVCRF

SEQ ID NO: 23795 - protein, 254 aa, Escherichia coli TA271
MKKIAYMLVALSVSCQATVMPQQSRVIFHPGEVKRSLLLVNNEDAPVLVQSWVDLGRPDKKPGEKNFPFVALPAVFRLNKAEKRVITLIRSAQSASLPADRESLYWLNIYEISAVKKNIAQQKLNKFNLAMNTQLKIINRPFRDSYNFRERTQKLKFQTQQMAGKIMLTVINPTPYYFTPGQMNITIGSWQNKVYLGADKAVAPFSDKAFPLTIHSGVLPAGKATLHFSAIDDDGALQYFTYDLNRQKSLRFSG

SEQ ID NO: 23796 - protein, 338 aa, Escherichia coli TA271
MHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKTGSVLSTFQNFLGTALSSMKIDELIKKQKSGSNVSSSELAKASIELINQLVDTAASLNNNVNSFSQQLNKLGSVLSNTKHLNGVGNKLQNLPNLDNIGAGQRNATQACHMGGQDPSRRISQLLRLITQSEGLAEAARLTFSSKGAHSPCVEGVNTAKLQAGRSAELQRLSEELIFGHYQPMPARWGYIPKSNGKLRPLGIPAMRYCSAGHADGDGADMEE

SEQ ID NO: 23797 - protein, 845 aa, Escherichia coli TA271
MSHYSLSGLKYRVIYLCCLSGLYMLSVPLWAAEDAEFDPSFLSRTPGSSVIDVRRFMHGNPVPSGNYYSDIYLNGEWKGNAELSFRDMSSSQEESVLCVTPELLSILDVSPEAVAREPDTGNGRCMPFSAVVPDAKIRFDLSLLRLNVEIPQAMLVSRPRGYISPSQWQTGVPAAFVSYDVNHWRYRTPDMENNQSYLGLRAGFNAGGWAFRHRGTESWSDSHAEGYRSIETNLQHDIAMLRAQLTLGDFTTTGELMDSNSLRGIRLASDDRMLPGSLRGYAPVVRGMAGSNARVTVRQNGNIIYETTVPAGPFSISDLYPSGYGGDLTVTVTESDGQTRSFIVPFASVAQLVRPGFSRWQVAAGRYRYGNRTFSDTVFQGTLQYGLTNDITLNTGMSTAPHYLSGLGGVAFNTPLGAVATDITLARTTFPGSDTTHRGYSLHAGYSARIPETSTNVTLAAYRYSSRDFWSLRDAILTRNRDVINDSSVRSATGYRPRNQLQLTVNQSLGEGWGNLYLTGATYHYWGHTGTFNEYQAGYNNVWKKMSYQIGFSQTRRSGDYHHDNRFFFSFSLPLSDTGRTLLSTTVNVSDKNSNSIQSSISGVSGDDNQLSYGVSLNTQENGPTGYAVNGSYRSPVATLQATAGNDSRHNRQISAGISGAIVAHPFGVTASNDLGDTFTVIHADGAGGAVINNAPGNRLDPWGNGIVPYVTPYEKNYISIDPTALAADVELSATEREIIPRANSTTMVTFTTKTGKAMLFDVKMQDGTPPPMAAEALTADGKSAGYIAQGGRLFVRDLDAEKGMLRVVWGSGQNDSCVIHYSASGENARGNAVPENHHVVCMRQ

SEQ ID NO: 23798 - protein, 823 aa, Escherichia coli TA271
MTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 23799 - protein, 224 aa, Escherichia coli TA271; identical to SEQ ID NO: 6435

SEQ ID NO: 23800 - protein, 200 aa, Escherichia coli TA271; identical to SEQ ID NO: 6311

SEQ ID NO: 23801 - protein, 518 aa, Escherichia coli TA271; identical to SEQ ID NO: 7565

SEQ ID NO: 23802 - protein, 116 aa, Escherichia coli TA271
MKKQIEGMTMKKVLALVVAAAMGLSSAAFAAETATTPAPTATTTKAAPAKTTHHKKQHKAAPAQKAQAAKKHHKNTKAEQKAPEQKAQAAKKHAGKHSHQQPAKTCCTTRSVSFQQ

SEQ ID NO: 23803 - protein, 118 aa, Escherichia coli TA271 [sequence omitted]

SEQ ID NO: 23804 - protein, 641 aa, Escherichia coli TA271; identical to SEQ ID NO: 7954

SEQ ID NO: 23805 - protein, 828 aa, Escherichia coli TA271; identical to SEQ ID NO: 7891

SEQ ID NO: 23806 - protein, 162 aa, Escherichia coli TA271; identical to SEQ ID NO: 5896

SEQ ID NO: 23807 - protein, 374 aa, Escherichia coli TA271; identical to SEQ ID NO: 5608

SEQ ID NO: 23808 - protein, 274 aa, Escherichia coli TA271; identical to SEQ ID NO: 6549

SEQ ID NO: 23809 - protein, 250 aa, Escherichia coli TA271; identical to SEQ ID NO: 7896

SEQ ID NO: 23810 - protein, 880 aa, Escherichia coli TA271; identical to SEQ ID NO: 15455

SEQ ID NO: 23811 - protein, 432 aa, Escherichia coli TA271; identical to SEQ ID NO: 5727

SEQ ID NO: 23812 - protein, 359 aa, Escherichia coli TA271; identical to SEQ ID NO: 6332

SEQ ID NO: 23813 - protein, 686 aa, Escherichia coli TA271; identical to SEQ ID NO: 6453

SEQ ID NO: 23814 - protein, 678 aa, Escherichia coli TA271; identical to SEQ ID NO: 22925

SEQ ID NO: 23815 - protein, 813 aa, Escherichia coli TA271
MVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDAKGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 23816 - protein, 231 aa, Escherichia coli TA271; identical to SEQ ID NO: 6351

SEQ ID NO: 23817 - protein, 249 aa, Escherichia coli TA271; identical to SEQ ID NO: 6450

SEQ ID NO: 23818 - protein, 834 aa, Escherichia coli TA271; identical to SEQ ID NO: 8715

SEQ ID NO: 23819 - protein, 412 aa, Escherichia coli TA271; identical to SEQ ID NO: 6284

SEQ ID NO: 23820 - protein, 243 aa, Escherichia coli TA271; identical to SEQ ID NO: 15477

SEQ ID NO: 23821 - protein, 208 aa, Escherichia coli TA271; identical to SEQ ID NO: 5717

SEQ ID NO: 23822 - protein, 614 aa, Escherichia coli TA271; identical to SEQ ID NO: 7971

SEQ ID NO: 23823 - protein, 446 aa, Escherichia coli TA271; identical to SEQ ID NO: 6459

SEQ ID NO: 23824 - protein, 237 aa, Escherichia coli TA271; identical to SEQ ID NO: 6533

SEQ ID NO: 23825 - protein, 478 aa, Escherichia coli TA271; identical to SEQ ID NO: 5711

SEQ ID NO: 23826 - protein, 255 aa, Escherichia coli TA271; identical to SEQ ID NO: 6247

SEQ ID NO: 23827 - protein, 837 aa, Escherichia coli TA271
MMAACTLLYTGNTEARTYSFDASMLKGGGKGVDLTLFEEGAQLPGIYPVDIILNGSRVDSRDMAFRTEKDAEGKTYLKTCLTREMLARYGVMTEEYPELFHGDDGKEAEACAELSVIPQATETYQFASQQLLLSIPQVALRPPLRGIAPEALWDDGIPAFLLNWQANTSRSEYRGYGKSVTDNYWVTLEPGINLGPWRVRNLTTWNRSSGQPGQWESAYIRAERGINSLRSRLTLGEDYTPSDIFDSVPFRGVMLGADESMVPYNQREFAPVVRGIARTQARIEVRQNGYLIDSRTVAPGAFALTDLPLTGSGGDLQVTVQESDGTAQVFTVPYTTPAIALREGYMKYSIAGGEYRSSDDAVEHSPLGQMSVMYGLPWGLTAFGGAQMSSHYQSAALGLGWSMGRLGAVSVDGIHSRGQQKGRDTETGETWRLRYNKSFELTNTDLTAARYQYTSSGFHTLSDVLSTFRNDNFRAYSYSGDRSRRTTLRLNQSLGSLGYMSFYGSRDEFRHNRQKQDSFGMSYGTSWKNISWYVNWSRNYSTNAYYQRGHIEDSINLWMNIPLGQWIGGRDNDINVTTQTQRTTGQNTWYETGLNGRAFDRRLYWDVSERIAPGSENNVDSSRLNLRWFGTYGELAGMYSYSSYIRQMSAGISGGMVLHNEGITLGQKGEDTVALVVAPGVNGASVGSLPGVRTDTRGYTLVNHVSPYQENLITLDPTTFPENVEVSQTDTRVVPTKGAVVRAKFITRVGGRALITLSRSDGSRLPFGAVVTEEGKKGQMPGGAGVVGDNGEVYLSGLDETGQLKVQWGRNSSCRANYRLPEEKEATGIFLVRTVCM

SEQ ID NO: 23828 - protein, 241 aa, Escherichia coli TA280; identical to SEQ ID NO: 6138

SEQ ID NO: 23829 - protein, 878 aa, Escherichia coli TA280
MSYLNLRLYQRNTQCLHIRKHLLAGFFVRLFVACAFAAQAPLSSAELYFNPRFLADDPQAVADLSRFENGQELPPGTYRVDIYLNNGYMATRDVTFNTGDSEQGIVPCLTRAQLAGMGLNTASVSGMNLLADDACVPLTTMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIVTQDGVIQVKPKFTDYYNLAYNKRGKLQLTVTQQLGRSSTLYLSGSHQTYWGTNNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 23830 - protein, 784 aa, Escherichia coli TA280
MKKRIPTLLATMIATALYSQQGLAADLASQCMLGVPSYDRPLLQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 23831 - protein, 234 aa, Escherichia coli TA280
MKVSVPGMPATLLNMSNNDIYKMVSGDKMDMKMNIFQRLWETLRHLFWSDKQPEAYKLLFDFVNNQTGNINASKYFTGAVDENEKEKFIHSLELFNELKTCAKNPDEMVAKGKMRWVAEIYGDIELSVTFLIENNEICTLTLQLCKGLGSLGVDLRNAYLPGVDMRNCYLGKKTIIDNNVLYLEPGWNANLEGAILDSTDAIIINKITTKKIATEEITTQQSTAEEIIANAIIE

SEQ ID NO: 23832 - protein, 891 aa, Escherichia coli TA280
MILAAQLKAMSICKTRDLMQQEANVMKTTTSTKRHNLTRIAMYCSIMYSGATIGAESVEYDPTFLMGGNASSIDVSRYSDGNPTLPGVYDVSIYVNEQPVANLEIPFIAIPDKKNAQACITLKNLLQLHIKTPPADEENTILLPRDETLGNCLDLSLAIPKSSVNYDPSEQRLDINVPQAWVMKNYQNYVDPSLWENGINAAMLSYNINAYRSENSNYTNDSVYTSFNGGVNLGAWRLRSSGNYSWRNDAGSDVEFMNRYVQRDITAIRSQLIMGESYTTGETFDSVSIRGIRLYSDSRMLPPVLANFAPTIRGVANTNAKVSITQSGYKIYETTVPPGPFVIDDLSPSGYGSDLIVTIEEADGSKRTFSQPFSSVIQMLRPGVSRWDISGGQINKDDLHHEPNLLQATYYRGLSNLFTGYTGFQVTDNHYAAGLLGIGMNTSVGAISFDVTHSSVDIPDDKRYQGQSYRISWNKFFDLTDTSLNIAAYRYSTQDYLGLNDALTLIDEVEHPTQDLDPKTMRNYGHMKNQFTVSINQPLRFGKDDYGSFYTSGSWSDYWGGGKSRSNYSIGYSNSASWGSYSISAQRSWDEYSQTENSIYLSFSIPIEKLMGTEHRDSGFQSIDTQLSTNMDGNNQFNMSSSGYSNDNRVSYSVNAGYGMNKTGKDLSNIGGYASYESPWGTLAGSVSATSDNNRQYSVNTDGGFVLHSGGLTFSNDSFSDNDTIALVKAPGAKGARINYGNNTVDRWGYGVTSALSPYQENKIALDTENLENDIEMKSTSTVAVPRQGSVIFAGFETNQGQSAIMNIKRSDGKGIPFAADIHDETNAIIGNVGQGGQAFVRGIQQQGTIKITWLEASMPKTCIAQYQQPNVTSEKIQQTIILNNILCQLQ

SEQ ID NO: 23833 - protein, 747 aa, Escherichia coli TA280
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFSWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSQFATGDIDHTLLTGVDFMRMRNDINAWFGYDDSIPLLDLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 23834 - protein, 266 aa, Escherichia coli TA280; identical to SEQ ID NO: 5772

SEQ ID NO: 23835 - protein, 161 aa, Escherichia coli TA280; identical to SEQ ID NO: 5769

SEQ ID NO: 23836 - protein, 353 aa, Escherichia coli TA280; identical to SEQ ID NO: 15872

SEQ ID NO: 23837 - protein, 230 aa, Escherichia coli TA280; identical to SEQ ID NO: 6360

SEQ ID NO: 23838 - protein, 869 aa, Escherichia coli TA280; identical to SEQ ID NO: 8606

SEQ ID NO: 23839 - protein, 766 aa, Escherichia coli TA280
MLMTTMPDSCNSWQKCRNKTMNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDLAPLQSLELEAGYSRQGNLYAGDTQNTNSDSYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 23840 - protein, 193 aa, Escherichia coli TA280; identical to SEQ ID NO: 6300

SEQ ID NO: 23841 - protein, 243 aa, Escherichia coli TA280
MTFMKGLPLLLLIASLCSYAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPSALRKKAGEKVELQLQVSQQGNQLNLKNPTGYYLTIAYLGRNEQGVLPGFKTVMVAPFSTVITNTGSYSGSQFYLGYMDDYGALRMTTLNCNGHCRLQAVEAKK

SEQ ID NO: 23842 - protein, 430 aa, Escherichia coli TA280
MKQALRVAFGFLILWASVLHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNVNGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 23843 - protein, 760 aa, Escherichia coli TA280
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQAIGDTTAVRLNVMGEKTHDAGRDKIKNERYGVAPSVAFGLGTANRLYLNYLHVTQHNTPDGGIPTIGLPGYSAPSAGTVALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 23844 - protein, 204 aa, Escherichia coli TA280
MMKKIAITCALLSSLVASRVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 23845 - protein, 729 aa, Escherichia coli TA280
MLSTQFNRDNQYQAITKPSLLAGCIVLALLPSAAFAAPATEETVIVEGSATAPDDGKNDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSGNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 23846 - protein, 213 aa, Escherichia coli TA280; identical to SEQ ID NO: 5744

SEQ ID NO: 23847 - protein, 517 aa, Escherichia coli TA280
MKHKLQMMKMRWLSAAVMLTLYTSSSWAFSIDDVAKQAQSLAGKGYEAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVVPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 23848 - protein, 191 aa, Escherichia coli TA280; identical to SEQ ID NO: 14954

SEQ ID NO: 23849 - protein, 235 aa, Escherichia coli TA280
MIAMQKNAAHTYAISSLLVLSLTSCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 23850 - protein, 207 aa, Escherichia coli TA280
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKKWKVVYGGYDTKTQPAMPANMELTDGGQRIKLKMDNWIVK

SEQ ID NO: 23851 - protein, 551 aa, Escherichia coli TA280; identical to SEQ ID NO: 5742

SEQ ID NO: 23852 - protein, 753 aa, Escherichia coli TA280
MGMVIIIFSNVEHFLPLRLQFSQLLNVSCRFVFHKFTILLPWRRFPILNLVFFMKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGAMGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYITPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWEQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKGYVGSVIVNESNGRYYEPAPGRNYGVGMNIAWRFE

SEQ ID NO: 23853 - protein, 366 aa, Escherichia coli TA280; identical to SEQ ID NO: 7432

SEQ ID NO: 23854 - protein, 871 aa, Escherichia coli TA280
MHQVLLLPRFARLTIALGLATAVFPVDAEYYFNPRFLSNDLAESVDLSAFTKGREAPPGTYRVDIYLNDEFMTSRDITFIAGDNNADLIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSIKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMNGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNSSIVAENGQVYLTGLPQSGKLQVSWGKDKNSNCIVEYKLPEVSPGTLLNQQTAICR

SEQ ID NO: 23855 - protein, 239 aa, Escherichia coli TA280
MHQMQTTRIPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 23856 - protein, 122 aa, Escherichia coli TA280; identical to SEQ ID NO: 5737

SEQ ID NO: 23857 - protein, 224 aa, Escherichia coli TA280
MKGLLALLISSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPSGIAPVNKATFKKLLVNRSGNGLVIKNDSANWVTISDVKANNVKVNYETIMIAPLESQSINVKSNNANNWYLTIIDDHGNYISDKI

SEQ ID NO: 23858 - protein, 690 aa, Escherichia coli TA280
MLPYARGRKEDVSDTHFIFVVTSWRYGMFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSISHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 23859 - protein, 828 aa, Escherichia coli TA280
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWEQAFDVMEDKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKYPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 23860 - protein, 162 aa, Escherichia coli TA280
MKTILPAVLFAAFATTSAWAADSVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRIWKAEEKIDNAVVR

SEQ ID NO: 23861 - protein, 373 aa, Escherichia coli TA280
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRSTDFFGLVDGLNFAVQYQGKNGSPEGEGMTNNGREALRQNGDGVGGSITYDYEGFGIGAAVSSSKRTDDQNFGLNRYDERYIGNGDRAETYTGGLKYDANNIYLAAQYTQTYNATRVGNLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 23862 - protein, 219 aa, Escherichia coli TA280; identical to SEQ ID NO: 15738

SEQ ID NO: 23863 - protein, 274 aa, Escherichia coli TA280; identical to SEQ ID NO: 8643

SEQ ID NO: 23864 - protein, 249 aa, Escherichia coli TA280
MTKYLSAKTLTTVLSLLAATVSFSTQASVTPDRTRLIFNESDKSISVTLRNNDPKLPYLAQSWIEDEKGVKISSPLAVLPPVQRIEAMMNGQVKIQGLPDIHKLPADRESMFYFNVREIPPKSNKSNTLQIALQTRIKLFWRPKALEKTTTQNPWQHKVTLTRNGQEFTVNNPTPYYVIFSNASAQKNGNPAAGFSPIVMSPKTSAPLNVKMGSVPVLTYVNDYGARMPLFFTCNGNSCQVDEEQSRKG

SEQ ID NO: 23865 - protein, 883 aa, Escherichia coli TA280
MDTPMPEHSFLRLRGLSWWIALAISGSPFNALADDTIQFDGRFLDLKGNTKIDLGRFSQKGYVEPGKYNLRVHVNNQPLPDDYDIYWYATENDPNKSYACLSPELVAQFGLKEDIAKNLQWIRDGQCLNMALLAGTEISGDLGQSALLVSLPQAYLEYTDSEWDPPSRWDDGIPGLIADYSINAQTRHENGGDDTNDISGNGTVGVNVGPWRLRADWQSDYQHTRSNDDGDTDDSGTQKNWEWSRYYAWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKNYMTMSEYLDANDDDRARTGNDKEMYTVTYNQNFTDARVSVYLNYSHHTYWDRQDQTNYNMMLSHYFNLGSLRNLSVSLTGYRYEYDKSADKGVYLSLSLPWGDNSTISYNGNYGSGADSNQVSLYHRIDDASHYTLSAGTSENHSSVDGYYSHDGTLAKVDLSANYHEGQYTSAGISLQGGATLTAHGGALHRTQNMGGTRLLIDADGVANVPVEGNGSAVYTNMFGKAVVADVNDYYRNQAYIDLNKLPENAEATKSVVQATLTEGAIGYRKFAVISGEKAMAVLRLQDGSHPPFGAEVKNDNQQQVGLVDDEGNVYLAGVKPGEHMTVFWEGESHCDISLPDPLPNDLFNGLLLPCQQKGGSSSVIPHDIQPVIQEQTQQVAPMEPPMSVSSNQ

SEQ ID NO: 23866 - protein, 518 aa, Escherichia coli TA280; identical to SEQ ID NO: 6358

SEQ ID NO: 23867 - protein, 96 aa, Escherichia coli TA280
MAWRGVCNPKALSRLAAFSPLLLLGMGQMAHATDLLAGGKDDVKATFGADSFVIMCIYIAEIVIGVATYIRTKNLLILLGLVVVIVFTTVGLTFVS

SEQ ID NO: 23868 - protein, 432 aa, Escherichia coli TA280; identical to SEQ ID NO: 5727

SEQ ID NO: 23869 - protein, 567 aa, Escherichia coli TA280; identical to SEQ ID NO: 6075

SEQ ID NO: 23870 - protein, 360 aa, Escherichia coli TA280
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPGSVDLYSDVDDITISKEPFLYGQVVDNTGQPIRWEGRASNFADYLLKNRLQSRSNGLRIIYSVTINMVPNHLDKRAHKYLGMVRQASRKYGIDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 23871 - protein, 840 aa, Escherichia coli TA280
MNNKNTFTGDKLSHAIKIALSGVVCSLLFVLPVHAVEFNVDMVDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDAGIAGFILDYNLYASQYAPHHGDSTQNVSSYGTLGFNLGAWRLRSDYQYNQNFADGRSVNHDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSDNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGVEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSILHLTWGDNTCEVTPPNQSNISESAIILPCKTVK

SEQ ID NO: 23872 - protein, 249 aa, Escherichia coli TA280; identical to SEQ ID NO: 5852

SEQ ID NO: 23873 - protein, 678 aa, Escherichia coli TA280
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRIWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPAATTAAVSAPANPSAELKIYDTSSQPLSQILNQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 23874 - protein, 654 aa, Escherichia coli TA280
MDSVMKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGAGDELVTRIVPLENVPARDLAPLLRQMMDGGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNSRKPSSTSAMDNVAITADEQTNSLVITADQPVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHTPAPSAR

SEQ ID NO: 23875 - protein, 900 aa, Escherichia coli TA280
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGDAVTPVDPTPETPETPVTPTPDNNEPSTPADSGNDYSLQAWSGQEGSEIYHVIFNGNIYQNAWWVGSEDCPRGTSAENSNNPWRLVRTATAAELSQYGNPTTCEIDNGGVIVADGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGANYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLSILPTGLTPEGMNVLSDAKAKGVELAGVNVMTMDYGNAICQSANTEGQNIHGKCATSAITNLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 23876 - protein, 258 aa, Escherichia coli TA280
MLQFPLSSLMINVLICILMCCTNAQAGVVVGGTRFVYPEKQSSISVELKNTASKDMLVKISVTPDDGRQLKGTLESQPLLPDKAFIATPPLLVLKQDKNTKIRINRVGGQLPIDRESLFILNVAALPAQEQNSQLKNENQLQVAVRNRMKIFYRPETLSGNPLDAYQQLRWSRKNEAVTVFNPTPWYVTLYNLSIDGKSINGGMVAPFSHRQQDWCQRQGYCEINWQTLDLYNNALPVWSVKLNVLQNNVMSAVAIHG

SEQ ID NO: 23877 - protein, 250 aa, Escherichia coli TA280
MRWISKNKCFTNRNINSLQKTQYVIRAGALFLLSAISINAIAAGGFGLGSTRLVYPSDSQQITLSVQNGGANTSYLIQSWIDDNQSSKKSQDFVVTPPLFMLPTRKEASLRIMFIGKSQLPTDRETLFWMNVKAIPPTDEKNTQKNTLQLALQNRIKLFYRPTNLPVQAGKARDMLRFKYEGKQLRVINPSPYYLTVTGIRVQGAKLPNAFVPPKSDVTVSSPVTLAGEITYQTINDYGATTARQKGTMQ

SEQ ID NO: 23878 - protein, 660 aa, Escherichia coli TA280; identical to SEQ ID NO: 6837

SEQ ID NO: 23879 - protein, 208 aa, Escherichia coli TA280; identical to SEQ ID NO: 5717

SEQ ID NO: 23880 - protein, 628 aa, Escherichia coli TA280
MKPAASFFYCGCFTMIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNIIIGHGNIGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLNPEKSKQWEGAFEGLTAGVNWRISGYRNDVSDLIDYDDHTLKYYNEGKARIKGVEATANFDTGPLTHTVSYDYVDARNAITDVPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 23881 - protein, 478 aa, Escherichia coli TA280; identical to SEQ ID NO: 8063

SEQ ID NO: 23882 - protein, 678 aa, Escherichia coli TW10509
MVPSTFSRLKAARCLPVVLAALIFAGCGTHTPDQSTAYMQGTAQADSAFYLQQMQQSADDTRINWQLLAIRALVKEGKTGQAVELFNQLPQELNDYQRREKTLLAVEIKLAQKDFAGAQTLLAKITPADLDQYQQARYWQAKIDASQGRPSIDLLRALIAQEPLLGAKEKQQNIDATWQALSSMTQDQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQATAAPIADVAEQPQPQTVDGVASPAQASVSDLTGEETAAQPVPVSAPAASTAAVSAPANPSAELKIYDTSSQPLSQILNQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSASELRAGVNGGSGIALTGSPITPRETTDPGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 23883 - protein, 246 aa, Escherichia coli TW10509
MKSLLTATGMICLLGICNFAQATVSPDRTRIIFNASNKSATVRLTNQSKIDPYLAQSWIEDASGKKTRDYISTLPPMERIEANEQVQIRLMALASLNNLPQDRETLFYYNVREIPPRAKEQNVMQIAMQSRLKLFWRPKAIELKEGEMVPLQKVTITRTAAGLTLNNPTPYHITVGYIGTNGKTLMPGANSIMVAPFASATQHLNNLPSIFQLGFVADYGGLEMFKVVCNSVQSLCQSTPAKKGKI

SEQ ID NO: 23884 - protein, 840 aa, Escherichia coli TW10509
MNNKNTFTGDRLSHAIKNALSGVVCSLLFVLPVHAVEFNVDMIDAEDRENIDISRFEKKGYITPGKYLVRVQINKNILPKALILEWVKADNESGSLLCLTRENLINFGLHTDFIESLQSTAGSECLDLSQRQELSARLDKSTMILSLSIPQAWLKYQATNWTPPEFWDDGITGFILDYNVYASQYDPHHGDSTQNISSYGTLGFNLGAWRLRSDYQYNQNFADGRSVNHDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTNTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQHSDNLRGFSYRFNYAKHFESTGSQITFAGYRFSDKNYVSMNEYLNSRNGDESIDNEKESYVISLNQYFETLELNSYLNVTRNTYWDSPSNTNYSISVSKNFDIGDFKGISASLAVSRIRWDDDEENQYYFSFSLPLQQSRNISYSMQRTDGSNTSQMISWYDSSDRNNVWNISASATDDNIRDGEPTLRGSYQHYSPWGRLNINGSVQPNQYNSVTAGWYGSLTATRHGVALHDYSYGDNARMMVDTDGISGVEINSNRTVTNGLGIAVVPSLSNYTTSMLRVNNNDLPEGVDVENSVIRTTLTQGAIGYAKLNATTGYQIVGIIRQENGRFPPLGVNVTDKATGKDVGLVAEDGFVYLSGIQENSTLRLTWGDNSCEITPPNQSNISESAIILPCKTVN

SEQ ID NO: 23885 - protein, 686 aa, Escherichia coli TW10509
MFWRDITLSVWRKKTTGLKTKKRLLPLVLAAVLCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISAAKPQKGSTVISENGATIINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 23886 - protein, 360 aa, Escherichia coli TW10509; identical to SEQ ID NO: 6702

SEQ ID NO: 23887 - protein, 567 aa, Escherichia coli TW10509
MKIKLRITIILISALCIFNGLLTPGAYAAAANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGGGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFASRNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 23888 - protein, 432 aa, Escherichia coli TW10509; identical to SEQ ID NO: 5727

SEQ ID NO: 23889 - protein, 518 aa, Escherichia coli TW10509
MKKLKINYLFIGILALLLAVALWPSIPWFGKADNRIAAIQARGELRVSTIHTPLTYNEINGKPFGLDYELAKQFAEYLGVKLKVTVRQNISQLFDDLDNGNADLLAAGLVYNSERVKNYQPGPTYYSVSQQLVYKVGQYRPRTLGNLTAEQLTIAPGHVVVNDLQTLKETKFPELSWKVDDKKGSAELMEDVIEGKLDYTIADSVAISLFQRVHPELAVALDITDEQPVTWFSRLDGDNTLSAALLDFFNEMNEDGTLARIEEKYLGHGADFDYVDTRTFLRAVDTVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 23890 - protein, 397 aa, Escherichia coli TW10509; identical to SEQ ID NO: 15767

SEQ ID NO: 23891 - protein, 122 aa, Escherichia coli TW10509; identical to SEQ ID NO: 5737

SEQ ID NO: 23892 - protein, 111 aa, Escherichia coli TW10509; identical to SEQ ID NO: 5889

SEQ ID NO: 23893 - protein, 236 aa, Escherichia coli TW10509
MQTTRTPYSVSFMATVLLSLVFLCHSTIANAAVALGATRVIFPANQKQVLLPVTNNDPASVYLIQSWIENAGDQKDTQFVITPPLFSMQGKKENTLRIINATNHQLPSDRESLFWVNVKAIPAMEKDQKNANTLQLAIISRIKMFYRPTNLAMAPDQAPEMLRFRRSGSKLTLINPTPYFITVTNMKAGNNDLPNTMVPPKGEISVDIPHGASGDISFQTINDYGALTPRIKATMQ

SEQ ID NO: 23894 - protein, 871 aa, Escherichia coli TW10509
MHHVLLLPRFARLTFALGLATAVFPVEAEYYFNPRFLSNDLAESVDLSAFAKGREAPPGTYRVDIYLNDEFMTTRDVTFVADDNNADLTPCLSTDLLVSLGIKKSALLANKDHLAGKNVPDNNACTPLQDRLADASTEFDVGQQHLSLSVPQIYVGRMARGYVSPDLWEEGINAGLLNYSFNGNSINNRSNHNASKTNYAYLNLQSGINIGSWRLRDNSTWSYNSGSNNPSDSNKWQHINTSAERDIIPLRSRLTVGDSYTDSDIFESVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALALGEYRSGNNLQSSPKFIQGSVMHGLEGNWTPYGGMQIAEDYQAFNVGIGKDLGLLGAFSVDITQANTTLADDTRHSGQSVKSVYSKSFYQTGTNIQVAGYRYSTQGFYNLSDSAYSRMSGYTVKPPTVDTNEQIQFIDYFNLYYSKRGQEQISISQQLGNYGTTFFSASRQSYWNTSRSDQQISFGLNVPFGDITTSLNYSYSSNIWQNDRDHLLAFTLNVPFSHWMRTDSQSAFRNSNASYSMSNDLKGGMTNLSGVYGTLLPDNNLNYSVQVGNTRGGNASSGTSGYSSLNYRGAYGNTNVGYSRNGDSNQIYYGMSGGIIAHADGVTFGQPMGDTMVLVKAPGAENVKIENQTGIHTDWRGYAILPFATEYRENRVALNANSLADNVELDETVVTVIPTHGAIARATFNAQIGGKVLMTLKYGNKPVPFGAIVTHGDNNNGSIVAENGQVYLTGLPQSGKLQVSWGNNANAKCVVNYKLPEVSPGNLLSQQTAVCR

SEQ ID NO: 23895 - protein, 366 aa, Escherichia coli TW10509; identical to SEQ ID NO: 15832

SEQ ID NO: 23896 - protein, 878 aa, Escherichia coli TW10509
MPDHSLFRLRALPWCVAVVISGCHINAWADEDIQFDSRFLELKGDTKIDLKRFSSQGYVEPGKYSLQVEVNKQPLPGEYDIYWYAAENDANKTYACLSPDLVALLGFKEDIAKNLQWVHDGKCLKPGQFDGLEMRVDLSQSALLISLPQAYLEYSDVDWDPPSRWDDGISGLIADYSINAQTRHEENGGDDSNDISGNGTVGVNLGPWRLRADWQSDYQHTRSNDEETEDSTERNWDWSRYYAWRALPSLKAKLALGEDYLDSDIFDGFNYIGGSISTDDQMLPPNLRGYAPDISGVAHTAAKVTVSQAGRVIYETQVPAGPFRIQDLADFSSGTLHVRIEEVNGQVQEYDISTASMPFLTRPGQVRYKIMMGRPQEWGHHVQGGFFSGGEASWGIANGWSLYGGALGDENYQSAALGIGRDLSVFGAMAFDITHSHTRLDDSTAYGKSTLDGNSFRVSYSKDFDELNSRVTFAGYRFSEENYMTMSEYLDANDSAMVRSGNDKEMYTATYNQNFRDAGVSVYLNYTRHTYWDREEQTNYNVMLSHYFNMGGIRNMSISLTGYRYEYDDSADKGVYISLSMPWGDSSVVSYNGNYGSGSDSSQVGYFSRIDDASHYQINVGNSENHSSVDGYYSRDGSMAHVDLNANYHEGQYTSAGLSLQGGATLTAHGGALHRTQNMGGTRLLIDADGVADVPVEGNGAAVYTNMFGKAVVADVNNYYRNQATIDLTRLPEDAEATQSVVQATLTEGAIGYRQFAVISGQKAMAVLRMSDGSYPPFGAEVRNEHDQQVGLVDDDGNVYLAGVKAGEHMRVSWNGEPHCEISLPDPLPADLFNGLLLPCKQQGAVMPAAPSDIKPMIQEQTQQVTPGAEPMAISANQ

SEQ ID NO: 23897 - protein, 250 aa, Escherichia coli TW10509
MYTLTRSATRAAPALALLVAATSFTTHASVTPDRTRLVFNEGDKSISVTLRNNDPKQPYLAQSWMEDEKGNKISSPLTVLPPVQRIDAMMNGQVKVQGMPDINKLPADRESMFYFNVREIPPKSNKPNTLQIALQTRIKLFWRPKALAKIDMREPWQHKVTLTRNGQAFTVNNPTPYYVIISNASTQKNGNPAAGFTPLVMPPKSSAPLNVKMDTVPVLTYVNDYGARLSLNFKCTGNNCQVDAEQSRKG

SEQ ID NO: 23898 - protein, 274 aa, Escherichia coli TW10509
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKKRWTSAQLLRPQALDLVSRDGKHVVPTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 23899 - protein, 200 aa, Escherichia coli TW10509
MLAFCRSSLKSKKYIIILLALAAIAGLGTHAAWSSNGLPRIDNKTLARLAQQHTVVVLFRHAERCDRSANQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 23900 - protein, 366 aa, Escherichia coli TW10509
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRSALRQNGDGVGGSITYDYEGFGIGAAVSSSKRTDDQNSIAYIGNGDRAETYTGGLKYDANNIYLAAQYTQTYNATRVGTNNWGWANKAQNFEVVAQYQFDFGLRPSLAYLQSKGKNLGRGYDDEDLLKYVDVGATYYFNKNMSTYVDYKINLLDDNQFTRAAGINTDDIVALGLVYQF

SEQ ID NO: 23901 - protein, 162 aa, Escherichia coli TW10509
MKTILPAVLFAAFATTSAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRIWKAEEKIDNAVVL

SEQ ID NO: 23902 - protein, 828 aa, Escherichia coli TW10509; identical to SEQ ID NO: 6558

SEQ ID NO: 23903 - protein, 659 aa, Escherichia coli TW10509
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWAGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGSSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEDGWLEGVESSVTVFRNDVKDRISISRTSDVNAAPGYQNFVGFTADGVPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 23904 - protein, 224 aa, Escherichia coli TW10509
MKGLLALLISSMVLPAHAGIVIYGTRIIYPAENKEVMVQLMNQGNRSSLLQAWIDDGDTSLPPEKIQVPFMLTPPVAKIGANSGQQVKIKIMSNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSINVKSNNANNWYLTIIDDHGNYISDKI

SEQ ID NO: 23905 - protein, 826 aa, Escherichia coli TW10509
MLRMTPLASAIVALLLGIEAYAAEETFDTHFMIGGMKDQQVANIRLDDNQPLPGQYDIDIYVNKQWRGKYEIIVKDNPQETCLSREIIKRLGINTDNFASGKQCLTFEQLVHGGSYTWDIGVFRLDFSVPQAWVEELESGYVPPENWERGINAFYTSYYVSQYYSDYKASGNSKSTYVRFNSGLNLLGWQLHSDASFSKTNSNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTTFDDQGFASNNTGLSGTVGSRDQFNYGVNLSHQHQGNETTAGANLTWNAPVATVNGSYSQSSTYRQAGASLSGGIVAWSGGVNLANRLSETFAVMNAPGIKDAYVNGQKYRTTNRNGVVVYDGMTPYRENHLMLDVSQSDSEAELRGNRNIAAPFRGAVVLVNFDTDQRKPWFIKALRADGQPLTFGYEVNDIHGHNIGVVGQGSQLFIRTNDVPPSVNVAIDKQQGLSCTITFGKEIDENRNYICQ

SEQ ID NO: 23906 - protein, 551 aa, Escherichia coli TW10509; identical to SEQ ID NO: 5742

SEQ ID NO: 23907 - protein, 207 aa, Escherichia coli TW10509; identical to SEQ ID NO: 5743

SEQ ID NO: 23908 - protein, 565 aa, Escherichia coli TW10509
MKATAPPRPQKIALIPACVLLCFAALAAQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVTNFAHEIDTYGHIPNGNRSYYLSRSQPPFFALMVELLAQHDGDVALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVAKEGLQNYGQKEVAMDISWHFLTNVQHTYDREKKLVEKYDVSTTGTGGGGGEYPLQDGFGWTNGVTLKMLDLICPKEQPCDNVPATRPLSESTTQPVKQKEAEPTP

SEQ ID NO: 23909 - protein, 656 aa, Escherichia coli TW10509
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTRNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 23910 - protein, 700 aa, Escherichia coli TW10509
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSSQDDMSVMMYAGERETTQYQSIPMAPQLNPSHAGGVITLQRHYQGIDSRWTHRGELGVPVTFTTGLNYENMSENRKGYNNFRLNSGVPEYGQKGELRRDERNLMWNVDPYLQTQWQLTEKLSLDAGVRYSSVLFDSNDHYVTPGNGDDSGDASYHKWLPVGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRIKASWTWLDATYRSNVCNDQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGIGVNVAWRFE

SEQ ID NO: 23911 - protein, 213 aa, Escherichia coli TW10509
MIKMSRYALIAALAMFLAGCVGQREPAPVEEVKPAPEQPAEPQQPVPTVPSVPTIPQQPGPIEHEDQTAPPAPHIRYYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 23912 - protein, 729 aa, Escherichia coli TW10509
MLSTQFNRDNQHQTTSKPSLLAACIALALLPSAAFAAPATEETVIVEGSATTPVDDENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQNLAQDDTTHMKSLYAVTRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 23913 - protein, 232 aa, Escherichia coli TW10509; identical to SEQ ID NO: 5747

SEQ ID NO: 23914 - protein, 191 aa, Escherichia coli TW10509
MKKSLLGLTFASMMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 23915 - protein, 517 aa, Escherichia coli TW10509; identical to SEQ ID NO: 6817

SEQ ID NO: 23916 - protein, 362 aa, Escherichia coli TW10509; identical to SEQ ID NO: 5813

SEQ ID NO: 23917 - protein, 203 aa, Escherichia coli TW10509; identical to SEQ ID NO: 6414

SEQ ID NO: 23918 - protein, 760 aa, Escherichia coli TW10509
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTALRLNVMGEKTHDAGRDKVKNERYGVAPSVAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAVTCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 23919 - protein, 331 aa, Escherichia coli TW10509
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLVAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGNEAGHE

SEQ ID NO: 23920 - protein, 430 aa, Escherichia coli TW10509; identical to SEQ ID NO: 5758

SEQ ID NO: 23921 - protein, 819 aa, Escherichia coli TW10509
MDTVNIYRLSFVSCLVMAMPSAMAVEFNLNVLDKSMRERIDISLLKEKGVIAPGEYFVSVAVNNNQISNGQKINWQKKGDTTIPCINDLLVDKFGLKPEVRQSLPLINQCVDFSSRPEMLFNFDQASQQLNITIPQAWLAWQSDNWTPPSTWKEGVPGVLMDYNLFASSYRPQDGSNSTNLNAYGTAGINAGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRTSMSHQTENETFFSNEVSWGMLSNTSLYGGLLISGDDYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNLNLYANLLHQTWWNADASTTANITAGFNVDIGNWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDLSGTYAANDYSSVSSSWSGSFTATQYGAAFHRRSSTNEPRLMVSTDGVADIPVQGNLDYTNHFGIAVVPLVSSYQPSTVAVNMNDLPDGVTVTENVIKETWIEGAIGYKSLASRSGKDINVIIRNASGQFPPLGADIRQDGSSISVGMVGEEGHAWLSGVAENQKFTVVWGDSQRCSIHLPEHMEDTANRLILPCH

SEQ ID NO: 23922 - protein, 243 aa, Escherichia coli TW10509; identical to SEQ ID NO: 15781

SEQ ID NO: 23923 - protein, 193 aa, Escherichia coli TW10509; identical to SEQ ID NO: 6560

SEQ ID NO: 23924 - protein, 746 aa, Escherichia coli TW10509
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPMQSLELEAGYSRQGNLYAGDTQNTNSDSYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 23925 - protein, 780 aa, Escherichia coli TW10509
MKIPTTTDIPQRYTWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLFGLGRNLGNWGAVSLDVTHARSQLADDSRHEGESIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYAYFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKILAALCRRKARWFVPILIPA

SEQ ID NO: 23926 - protein, 230 aa, Escherichia coli TW10509
MMTKIKLLMPIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 23927 - protein, 221 aa, Escherichia coli TW10509
MKNYLWLVALLPLLSGCESQAILVKKDDAYFAPPKTEAPPPADGRAGGVFETGYNWSLTADRRAYRVGDILTVILEESTQSSKQAKTNFGKSNSVDITAPTVFGHTKNNLSGSIDANRDFDGSATSQQQNSLRGEITVSVHAVQPNGILEIRGEKWLTLNQGDEYIRLSGLVRADDIQNDNSVSSQRIADARISYAGRGALSDANAAGWLTRLFNHPLFPI

SEQ ID NO: 23928 - protein, 161 aa, Escherichia coli TW10509; identical to SEQ ID NO: 5769

SEQ ID NO: 23929 - protein, 266 aa, Escherichia coli TW10509
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARAPQAIIITGGPDQIPKIKQYWGEQLKIPVIPLTSDWFERASPRIILAAQQLCNALSQVD

SEQ ID NO: 23930 - protein, 747 aa, Escherichia coli TW10509
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEIQFKAGTDSLFQTGFDFSDALDDDGVYSYRLTGLARSANAQQKGAEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESHNRVEGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 23931 - protein, 238 aa, Escherichia coli TW10509
MSVSYRFFLGFTFLLTAIQAQASVVLGGTRIVYPSNQNEVQITLKNKDVHARYLVQSWVSNIDGSKAPFLITPPVYKLEENRQTLLHVVFTGNKESLPQDRESLFLANIKSISAMPEELKDKNTLQFAMKVRLKLFWRPDSLSNSDALTAWEKLTFHKESGRLIVKNPTPFYISFNELTVSGESITAVEEKSEPGALSMMVGPFSENRFSLPAGAGSVVEWSVITDYGSSSGKRQQKL

SEQ ID NO: 23932 - protein, 246 aa, Escherichia coli TW10509
MFFNTKHTAALCFATCVAFSSSAIADIVISGTRVIYKSDQKSVSVRLENKGNNPLLVQSWLDTGDDNAEPGSITVPFTATPPVSRIDAKRGQTIKLMYTASSVLPKDRESVFWFNVLEVPPKPDAATATNQSLLQLAFRTRIKLFYRPEGLKGNPSDAPLALKWSWATAGGQTALQVTNPTPYYVSFSSGDLETSSKRYPLDVKMIAPFSNDVIKVNGMSGKSSSAKVHFYAINDFGGAIEGNATL

SEQ ID NO: 23933 - protein, 865 aa, Escherichia coli TW10509
MQKITIIHPHNLTQIATLCALLYSSFSISAEHVEYDHTFLMGRDASNIDLSRYSEGNPTLPGIYDVNVYVNDQPVINQSIPFVVIDGKKNAQACITQKNILQFHITQPDIDSENAVLLERDEELGDCLNLTEIIPQSSVRYDVNDQRLDIDVPQAWVMKNYQNYVDPSLWENGINAAMLSYNVNGYHSESPGRKNDSIYASFNGGVNLGAWRMRASGNYNWMNDSGSDYNFQNRYLQRDIASLRSQLIIGESYTTGETFDSVSIRGVRLYSDSRMLPPALASFAPVIHGVANTNAKVTITQSGYKIYETTVPPGAFTIDDLSPSGYGSDLIVTIEEADGSKRTFSQPFSSVVQMLRPGVGRWDISGGQVLKDDIQDEPNLFQASYYYGLNNYLTAYTGIQLTDNNYTAGLLGLGLNTSLGAFSFDVTHSNVRIPEDKTYQGQSYRLSWNKLFEDTSTSLNIAAYRYSTQNYLGLNDALTLIDEVKHPEQELEPQSMRNYSRMKNQVTVSINQPLKFEKKDYGSFYLSGSWSDYWASGQNQSNYSIGYSNSASWGSYSISAQRSWNEDGETDDSIYLSFTIPIEKLLGTEHRDSGFQNIDTQLNSDFKGNNQLNISSSGYNDNNRISYSVNTGYTMNKSTDDLSYIGGYASYESPWGTLAGSVSASSDNSRQFSLNTDGGFVLHSGGLTFSNDSFSDSDTLAVVQAPGAKGARINYGNSTVDRWGYGVTSALSPYHENRIALDINDLENDVELKSTSTVAVPRQGSVIFAGFETVQGQSAIMNIKRSDGRNIPFAADIYDEQGNNIGNVGQGGQAFVRGISQQGNIQIKWLEAGKPVNCLAHYQQNAEAEKIAQTIIINGINCQIQ

SEQ ID NO: 23934 - protein, 784 aa, Escherichia coli TW10509; identical to SEQ ID NO: 6283

SEQ ID NO: 23935 - protein, 136 aa, Escherichia coli TW10509
MPNNLPHNKESLFYLNVIDIPPNNPQNAGKNKIKLALQNRIKLFWRPEGVAPVDKKSLSQLTIKKKDNAISINNETANWITITTIKAQNVKVNNESILLPPFSNNDITLKNNNASEYELTVVDDYGNNINSKIAAK

SEQ ID NO: 23936 - protein, 372 aa, Escherichia coli TW10509
MALMLFIPPIIYSQYRSYDSNNNSNTASYGRFNSGLNLFSWQLHSDASYSKPDDMKGTWQSNTLYLERGWSQILSTVQIGENYTSSLIFDSLRFSGIRLFRDMQMLPDSMQNFTPLVQSVAQSNGLITVSQNGYIIYQKEVPPGPFTIADLQLSGSGSDLDVSIKEADGSVRSFLVPYSSVPNMLQPGVSNFDFIAGRSKIYGVNNQEDFLEANYLYGLNNLVTLYGGTILTDNYNAITLGNGWNTPLGAISFDATRSSSKLNNDKIHEGTSYQVAYNKYLVQTTTRFSVAAWRYASQDYRTFSDHLYENDKHNHHSEYDDFYDIGRKNSLSANIMQPLSTGIKIALNDEQNLFCTITFKNVIDENKTYICQ

SEQ ID NO: 23937 - protein, 878 aa, Escherichia coli TW10509
MSYLNLRLYQRNTQCLHIRKHRLAGFFVRFFVACAFAAQAPLSSAELYFNPRFLADDPQAVADLSRFENGQELPPGTYRVDIYLNNGYMATRDVTFNTGDSEQGIVPCLTRAQLAGMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAAGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 23938 - protein, 241 aa, Escherichia coli TW10509; identical to SEQ ID NO: 6143

SEQ ID NO: 23939 - protein, 368 aa, Escherichia coli TW10509
MNKTITALAIMMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVRNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 23940 - protein, 774 aa, Escherichia coli TW10509
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNGDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 23941 - protein, 478 aa, Escherichia coli TW10509
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTVGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIPIPDISTKEKAQQAIGLNMEQIKAEKQDFIKTVIPQWEEQARKNGLLSQ

SEQ ID NO: 23942 - protein, 237 aa, Escherichia coli TW10509
MRKITQALSAVCLLFALNSSAVALASSPSPLNPGTNVARLAEQAPVHWVSVTQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAAREVGARGIRILRASNSTYKPLPQAGAFGEEVIVNSEY

SEQ ID NO: 23943 - protein, 446 aa, Escherichia coli TW10509; identical to SEQ ID NO: 15805

SEQ ID NO: 23944 - protein, 221 aa, Escherichia coli TW10509
MLLSAFLFRPALTYAGVVIGGTRVVYASNNAGKSISVFSKEEKIPYLIQAWVDPFNKDDKTKAPFIVIPPVSRLEPAQEKILRIVHTKGLSLPEDRESVFWLNIKNIPPSASNKEANSLEIAVKTRIKLFWRPASIRMIPENAAPKVKWHREGRNLIAENPNPIHISVMDVIVDGHDVPLNMIRPFETLTLPLPANSSGSQMTWRFINDYGAISEPIKQAL

SEQ ID NO: 23945 - protein, 412 aa, Escherichia coli TW10509
MKQWIAALLLMLIPSVQAAKPQKVTLMVDDVPVAQVLQALAEQEKLNLVVSPDVSGTVSLHLTDVPWKQALQTVVKSAGLITRQEGNILSVHSVAWQNDNIARQEAEQARVQASLPLENRSITLQYADAGELAKAGEKLLSAKGSMTVDKRTNRLLLRDNKAALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 23946 - protein, 121 aa, Escherichia coli TW10509; identical to SEQ ID NO: 8720

SEQ ID NO: 23947 - protein, 72 aa, Escherichia coli TW10509; identical to SEQ ID NO: 5952

SEQ ID NO: 23948 - protein, 265 aa, Escherichia coli TW10509
MIYKFSSMKNITFIFFILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLRKYQSKVKRQIFSDYQSEVDIYNRIRDEL

SEQ ID NO: 23949 - protein, 73 aa, Escherichia coli TW10509
MAGKREMVIITFKSGATFQVEVPGSQHIDSQKKAIERMKDTLRITYLTETKIDKLCVWNNKTPNSIAAISMEN

SEQ ID NO: 23950 - protein, 233 aa, Escherichia coli TW10509
MRYQYSVLFVFLFSGVVQAAESFGPRESRLLFEEKKGNTFYRIDNSDKKLPWLVQAWVEDASEKKTTALTATPMVFRVEPSSVFTVRVVKTGALPEDRETLFWAVSNSLPGGVSTKQDNEEGKISAKLSLAYRFKVPLIYRPAALDNFRQEPEKLEWTYNGKDGLKLYNPTRYVVQLHNVTANGREFKGKGVSFILLPMSGKNVSAAVNKGTRIKYGVINDYGAVKEYDGVVK

SEQ ID NO: 23951 - protein, 785 aa, Escherichia coli TW10509
MEGEQEVAIYVNDEFYSRNTLFFKNTLDKGLLPEFTPGFFDELLSGDFLVSEEDKTISSSDFLKKVPYSDINFNQGMSRVNISIPQAYLGDGAKLISSPDTWEYGGPAFLLDYNISGNRNDSGNYDSRSLYISSQMGVNLMKWRLRTSSSYSNYKTNSVWGGARSEQNSFYNTYAERDISSLRAILRLGEVSTAGLILDSVPFRGVKLSSSDDMLGMRLRNYTPTVRGMASSQAVVTITQNGRQVYQTNVPAGPFELNDFYLSGYSGDMLVTVREADGSEHSFLQPYSTLPEMKREGVSGFEVSVGRYDNNGAEHYYDAESFVYGNWSRGFARGVTFFAETLQAEKYQSLGGGSTLSLGRLGAASADISLSRADKYGDIRIGQSYGFKYSKSQIETGTTVTLATYRYSTENFYTFRDFVSKTDTARYIWENKLKSRMTFSLSQSLGEYGYLSANASQQDYWNSREVSRNYSLTHSFSWNDIYFSTTLSMDDQRGRETGHLSNKQAGIYASVPLSKLLPRTDPTSSSLTWSTSHADHKVRNSVTLDGKVPESDVRYRVGGSWGNGTTEGSRMASVSWTGDHASTSLGYTRVGKYRTLDYSMSGAAVMYPWGIAVGNSSVTGDGAIVVETPGAKGVRTSTGYKTSWLGTALISSPQKYTENRINLYPDGLPSDTVLGETSKTAVPAKGAVVVLDYTVFRGSQVVFTLRQTDGNPLPFGTVITLDGVSRGKENSGIVGEEGRVYMAGIPEKGTLTASWGLNKTCSIPFRINQHKAEAVIREVQGVCRV

SEQ ID NO: 23952 - protein, 208 aa, Escherichia coli TW10509; identical to SEQ ID NO: 5869

SEQ ID NO: 23953 - protein, 614 aa, Escherichia coli TW10509
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDQPGTEISAGWGSNNYQNYDVSTQQQLGDKTRVTLLGDYAHTHGYDVVAYGNTGTQAQPDNDGFLSKTLYGALEHNFTDVWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLEPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSWPYQTVKMGGVSLWDLAVAYPVTSHLTVRGKIANLFDKDYETVYGYQTAGREYTLSGSYTF

SEQ ID NO: 23954 - protein, 784 aa, Escherichia coli TX1999; identical to SEQ ID NO: 12980

SEQ ID NO: 23955 - protein, 170 aa, Escherichia coli TX1999 [sequence omitted]

SEQ ID NO: 23956 - protein, 765 aa, Escherichia coli TX1999; identical to SEQ ID NO: 12982

SEQ ID NO: 23957 - protein, 230 aa, Escherichia coli TX1999; identical to SEQ ID NO: 7855

SEQ ID NO: 23958 - protein, 703 aa, Escherichia coli TX1999; identical to SEQ ID NO: 13201

SEQ ID NO: 23959 - protein, 266 aa, Escherichia coli TX1999; identical to SEQ ID NO: 5772

SEQ ID NO: 23960 - protein, 161 aa, Escherichia coli TX1999; identical to SEQ ID NO: 5769

SEQ ID NO: 23961 - protein, 351 aa, Escherichia coli TX1999; identical to SEQ ID NO: 5767

SEQ ID NO: 23962 - protein, 222 aa, Escherichia coli TX1999; identical to SEQ ID NO: 10109

SEQ ID NO: 23963 - protein, 820 aa, Escherichia coli TX1999; identical to SEQ ID NO: 12991

SEQ ID NO: 23964 - protein, 746 aa, Escherichia coli TX1999; identical to SEQ ID NO: 7355

SEQ ID NO: 23965 - protein, 193 aa, Escherichia coli TX1999; identical to SEQ ID NO: 6300

SEQ ID NO: 23966 - protein, 243 aa, Escherichia coli TX1999; identical to SEQ ID NO: 6463

SEQ ID NO: 23967 - protein, 819 aa, Escherichia coli TX1999; identical to SEQ ID NO: 16267

SEQ ID NO: 23968 - protein, 430 aa, Escherichia coli TX1999; identical to SEQ ID NO: 5758

SEQ ID NO: 23969 - protein, 331 aa, Escherichia coli TX1999; identical to SEQ ID NO: 12995

SEQ ID NO: 23970 - protein, 760 aa, Escherichia coli TX1999; identical to SEQ ID NO: 12996

SEQ ID NO: 23971 - protein, 203 aa, Escherichia coli TX1999; identical to SEQ ID NO: 6414

SEQ ID NO: 23972 - protein, 361 aa, Escherichia coli TX1999; identical to SEQ ID NO: 7868

SEQ ID NO: 23973 - protein, 224 aa, Escherichia coli TX1999; identical to SEQ ID NO: 7869

SEQ ID NO: 23974 - protein, 591 aa, Escherichia coli TX1999; identical to SEQ ID NO: 13216

SEQ ID NO: 23975 - protein, 130 aa, Escherichia coli TX1999; identical to SEQ ID NO: 13139

SEQ ID NO: 23976 - protein, 191 aa, Escherichia coli TX1999; identical to SEQ ID NO: 5748

SEQ ID NO: 23977 - protein, 232 aa, Escherichia coli TX1999; identical to SEQ ID NO: 5747

SEQ ID NO: 23978 - protein, 729 aa, Escherichia coli TX1999; identical to SEQ ID NO: 13004

SEQ ID NO: 23979 - protein, 213 aa, Escherichia coli TX1999; identical to SEQ ID NO: 5744

SEQ ID NO: 23980 - protein, 360 aa, Escherichia coli TX1999; identical to SEQ ID NO: 8317

SEQ ID NO: 23981 - protein, 120 aa, Escherichia coli TX1999; identical to SEQ ID NO: 12975

SEQ ID NO: 23982 - protein, 119 aa, Escherichia coli TX1999; identical to SEQ ID NO: 13266

SEQ ID NO: 23983 - protein, 539 aa, Escherichia coli TX1999; identical to SEQ ID NO: 6525

SEQ ID NO: 23984 - protein, 700 aa, Escherichia coli TX1999; identical to SEQ ID NO: 13012

SEQ ID NO: 23985 - protein, 236 aa, Escherichia coli TX1999; identical to SEQ ID NO: 6472

SEQ ID NO: 23986 - protein, 203 aa, Escherichia coli TX1999; identical to SEQ ID NO: 6347

SEQ ID NO: 23987 - protein, 565 aa, Escherichia coli TX1999; identical to SEQ ID NO: 13144

SEQ ID NO: 23988 - protein, 207 aa, Escherichia coli TX1999; identical to SEQ ID NO: 13010

SEQ ID NO: 23989 - protein, 102 aa, Escherichia coli TX1999; identical to SEQ ID NO: 6285

SEQ ID NO: 23990 - protein, 118 aa, Escherichia coli TX1999 [sequence omitted]

SEQ ID NO: 23991 - protein, 204 aa, Escherichia coli TX1999
MNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLREYQSKVKRQIFSDYQSEVDIYNRIRDEL

SEQ ID NO: 23992 - protein, 673 aa, Escherichia coli TX1999; identical to SEQ ID NO: 6170

SEQ ID NO: 23993 - protein, 826 aa, Escherichia coli TX1999; identical to SEQ ID NO: 13157

SEQ ID NO: 23994 - protein, 154 aa, Escherichia coli TX1999
MLTPPVAKIGANSGQQVKIKIMPNKLPTNKESIFYLNVLDIPPNSPEQEGKNALKFAMQNRIKLFYRPAGIAPVNKATFKKLLVSRSGNGLVIKNDSANWVTISDVKANNVKVNYETIMIAPLESQSVNVKSNNANNWYLTIIDDHGNYISDKI

SEQ ID NO: 23995 - protein, 650 aa, Escherichia coli TX1999
MSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSFNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 23996 - protein, 828 aa, Escherichia coli TX1999; identical to SEQ ID NO: 6558

SEQ ID NO: 23997 - protein, 162 aa, Escherichia coli TX1999; identical to SEQ ID NO: 5896

SEQ ID NO: 23998 - protein, 367 aa, Escherichia coli TX1999; identical to SEQ ID NO: 5784

SEQ ID NO: 23999 - protein, 200 aa, Escherichia coli TX1999; identical to SEQ ID NO: 6311

SEQ ID NO: 24000 - protein, 274 aa, Escherichia coli TX1999; identical to SEQ ID NO: 6489

SEQ ID NO: 24001 - protein, 250 aa, Escherichia coli TX1999; identical to SEQ ID NO: 6317

SEQ ID NO: 24002 - protein, 881 aa, Escherichia coli TX1999; identical to SEQ ID NO: 13025

SEQ ID NO: 24003 - protein, 518 aa, Escherichia coli TX1999; identical to SEQ ID NO: 6358

SEQ ID NO: 24004 - protein, 432 aa, Escherichia coli TX1999; identical to SEQ ID NO: 5727

SEQ ID NO: 24005 - protein, 359 aa, Escherichia coli TX1999; identical to SEQ ID NO: 5847

SEQ ID NO: 24006 - protein, 686 aa, Escherichia coli TX1999; identical to SEQ ID NO: 6453

SEQ ID NO: 24007 - protein, 834 aa, Escherichia coli TX1999; identical to SEQ ID NO: 13027

SEQ ID NO: 24008 - protein, 231 aa, Escherichia coli TX1999; identical to SEQ ID NO: 8991

SEQ ID NO: 24009 - protein, 1024 aa, Escherichia coli TX1999; identical to SEQ ID NO: 13192

SEQ ID NO: 24010 - protein, 224 aa, Escherichia coli TX1999
MIITLLCSFCIGQALAGGIVLQRTRVIYDASRKEAALPVANKGAETPYLLQSWVDNIDGTSRAPFIITPPLFRLEAGDDSSLRIIKTADNLPENKESLFYINVRAIPAKKKSDNVNANELTLVFKTRIKMFYRPAHLKGRVNDAWKSLEFKRSDHSLNIYNPTEYYVVFAGLAVDKTDLTSKIEYIAPGEHKQLPLPASGGKNVKWAAINDYGGSSGTETRPLQ

SEQ ID NO: 24011 - protein, 298 aa, Escherichia coli TX1999
MINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYSGLLGSEDYYALGIGIGGTLGRLAP

SEQ ID NO: 24012 - protein, 678 aa, Escherichia coli TX1999; identical to SEQ ID NO: 13031

SEQ ID NO: 24013 - protein, 903 aa, Escherichia coli TX1999; identical to SEQ ID NO: 13035

SEQ ID NO: 24014 - protein, 654 aa, Escherichia coli TX1999; identical to SEQ ID NO: 13034

SEQ ID NO: 24015 - protein, 386 aa, Escherichia coli TX1999; identical to SEQ ID NO: 13036

SEQ ID NO: 24016 - protein, 45 aa, Escherichia coli TX1999; identical to SEQ ID NO: 10025

SEQ ID NO: 24017 - protein, 130 aa, Escherichia coli TX1999; identical to SEQ ID NO: 9060

SEQ ID NO: 24018 - protein, 258 aa, Escherichia coli TX1999; identical to SEQ ID NO: 6001

SEQ ID NO: 24019 - protein, 777 aa, Escherichia coli TX1999
MKNWICPLVRGGGRVNPEVWAALNGSYAPGRYLVDLSLNGKEAGKQILDVTPQDSNELCLTEAWLTKAGVYVSADYFREGYDATRQCYVLTKAPSVKVDFDVSTQSLALSIPQKGLVKMPENVDWDYGTSAFRVNYNANANTGRNNTSAFGSADLKANIGHWVVSSSATASGGDSGDNSTTINMFTAARAIRALSADLAVGKTSTGDSLLGSTGTYGVSLSRNNSMKPGNLGYTPVFSGIANGPSRVTLTQNGRLLHSEMVPAGPFSITDVPLYTSGDVTMKITGEDGREQVQNFPLSVMAGQLSPGQHEFSVAAGLPDDDSDLKGGVFAASYGYGLDGLTLRAGGVFNQDWQGASAGVVAGLGYLGAVSADGAYATAKYRDGSHSGNKVQLSWSKQLETTNTGLRVSWSRQSEEYEGMSSFDPTELWSQSNHGRRTKDEWNAGISQPVGGLFSLSVSGWQRSYYPASMTGSYRYSDDNGKETGITGSLSTQIKGVSLNLGWSGSRNSRGENNWSASASVSVPFTLFDRRYSSSASVSTSKGGGTGFSTGVSGSLNDRFSYGLGGGRDGDGGTSSYLNASYSGDRAYLNGVLNHSQSGGTSGSVSVSGSVLAVPAAKDIMFSRTTGDTVAVVNVKDTPGVKVTSGDGQTDSDGNLVVPLNSYDWNTVTIDAGTLPLSTELTNTSQKVVPTDKAVVWMPFDALKVKRYLLQVKQRDGEFVPGGTWARDSKNTPLGFVANNGVLMINTVDAPGDITLGQCRIPAARLQDTEKLQEITCE

SEQ ID NO: 24020 - protein, 208 aa, Escherichia coli TX1999; identical to SEQ ID NO: 5717

SEQ ID NO: 24021 - protein, 614 aa, Escherichia coli TX1999; identical to SEQ ID NO: 7971

SEQ ID NO: 24022 - protein, 446 aa, Escherichia coli TX1999; identical to SEQ ID NO: 6459

SEQ ID NO: 24023 - protein, 237 aa, Escherichia coli TX1999; identical to SEQ ID NO: 13043

SEQ ID NO: 24024 - protein, 368 aa, Escherichia coli TX1999; identical to SEQ ID NO: 7728

SEQ ID NO: 24025 - protein, 216 aa, Escherichia coli TX1999; identical to SEQ ID NO: 8786

SEQ ID NO: 24026 - protein, 878 aa, Escherichia coli TX1999; identical to SEQ ID NO: 14500

SEQ ID NO: 24027 - protein, 92 aa, Escherichia coli TX1999
MLRLVRAVIPVAVLMMLFPELAMAAGKGDLMAKGNDTVKATFGKDSSIVKWVVLAEVLVGAVMYMMTKNVKFLAGFAIISVFIAVGMAVVGL

SEQ ID NO: 24028 - protein, 331 aa, Escherichia coli UMNF18; identical to SEQ ID NO: 6551

SEQ ID NO: 24029 - protein, 102 aa, Escherichia coli UMNF18; identical to SEQ ID NO: 6385

SEQ ID NO: 24030 - protein, 359 aa, Escherichia coli UMNF18; identical to SEQ ID NO: 5847

SEQ ID NO: 24031 - protein, 793 aa, Escherichia coli UMNF18; identical to SEQ ID NO: 6397

SEQ ID NO: 24032 - protein, 446 aa, Escherichia coli UMNF18 [sequence omitted]

SEQ ID NO: 24033 - protein, 660 aa, Escherichia coli UMNF18; identical to SEQ ID NO: 7981

SEQ ID NO: 24034 - protein, 432 aa, Escherichia coli UMNF18; identical to SEQ ID NO: 5727

SEQ ID NO: 24035 - protein, 686 aa, Escherichia coli UMNF18; identical to SEQ ID NO: 6339

SEQ ID NO: 24036 - protein, 203 aa, Escherichia coli UMNF18; identical to SEQ ID NO: 6414

SEQ ID NO: 24037 - protein, 834 aa, Escherichia coli UMNF18; identical to SEQ ID NO: 7680

SEQ ID NO: 24038 - protein, 249 aa, Escherichia coli UMNF18; identical to SEQ ID NO: 6407

SEQ ID NO: 24039 - protein, 654 aa, Escherichia coli UMNF18; identical to SEQ ID NO: 6425

SEQ ID NO: 24040 - protein, 897 aa, Escherichia coli UMNF18; identical to SEQ ID NO: 6392

SEQ ID NO: 24041 - protein, 386 aa, Escherichia coli UMNF18; identical to SEQ ID NO: 7993

SEQ ID NO: 24042 - protein, 361 aa, Escherichia coli UMNF18; identical to SEQ ID NO: 7868

SEQ ID NO: 24043 - protein, 224 aa, Escherichia coli UMNF18; identical to SEQ ID NO: 7705

SEQ ID NO: 24044 - protein, 851 aa, Escherichia coli UMNF18; identical to SEQ ID NO: 14331

SEQ ID NO: 24045 - protein, 229 aa, Escherichia coli UMNF18; identical to SEQ ID NO: 23378

SEQ ID NO: 24046 - protein, 118 aa, Escherichia coli UMNF18 [sequence omitted]

SEQ ID NO: 24047 - protein, 231 aa, Escherichia coli UMNF18; identical to SEQ ID NO: 6400

SEQ ID NO: 24048 - protein, 838 aa, Escherichia coli UMNF18
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTRQQSIVDEGGILYLSGISSKSQSWTVRWGNQADQQCQFAFSTPDSEPTTSVLQGTAQCH

SEQ ID NO: 24049 - protein, 678 aa, Escherichia coli UMNF18; identical to SEQ ID NO: 6398

SEQ ID NO: 24050 - protein, 208 aa, Escherichia coli UMNF18; identical to SEQ ID NO: 5717

SEQ ID NO: 24051 - protein, 360 aa, Escherichia coli UMNF18
MKKLTVAISAVAASVLMAMSAQAAEIYNKDSNKLDLYGKVNAGHYFSSNDKHDGDKTYARLGFKGETQINDQLTGFGQWEYEFKGNRAESQGSSADKTRLAFAGLKFGDYGSIDYGRNYGVAYDIGAWTNVLPEFGGDTWTQTDVFMTERTTGVATYRNNDFFGLVEGLNFAAQYQGKNDHTDVTQANGDGFGFSTTYEYEGFGVGATYAKSDRTNNKVIYGNNSLNASGQNAEVWAAGLKYDANNIYLATTYSETQNMTVFADRFVANKAQNVEAVAQYQFDFGLRPSVAYLQSKGKDLGVWGAQDLVKYVDVGATYYFNKNMSTFVDYKINLIDKSDFTKASGVATDDIVAVGMVYQF

SEQ ID NO: 24052 - protein, 368 aa, Escherichia coli UMNF18; identical to SEQ ID NO: 8795

SEQ ID NO: 24053 - protein, 241 aa, Escherichia coli UMNF18; identical to SEQ ID NO: 6143

SEQ ID NO: 24054 - protein, 856 aa, Escherichia coli UMNF18; identical to SEQ ID NO: 8935

SEQ ID NO: 24055 - protein, 784 aa, Escherichia coli UMNF18
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEPPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKDYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 24056 - protein, 170 aa, Escherichia coli UMNF18 [sequence omitted]

SEQ ID NO: 24057 - protein, 517 aa, Escherichia coli UMNF18; identical to SEQ ID NO: 6406

SEQ ID NO: 24058 - protein, 191 aa, Escherichia coli UMNF18; identical to SEQ ID NO: 5748

SEQ ID NO: 24059 - protein, 865 aa, Escherichia coli UMNF18; identical to SEQ ID NO: 6375

SEQ ID NO: 24060 - protein, 246 aa, Escherichia coli UMNF18; identical to SEQ ID NO: 6964

SEQ ID NO: 24061 - protein, 266 aa, Escherichia coli UMNF18; identical to SEQ ID NO: 5772

SEQ ID NO: 24062 - protein, 161 aa, Escherichia coli UMNF18; identical to SEQ ID NO: 5769

SEQ ID NO: 24063 - protein, 232 aa, Escherichia coli UMNF18; identical to SEQ ID NO: 5747

SEQ ID NO: 24064 - protein, 729 aa, Escherichia coli UMNF18; identical to SEQ ID NO: 6402

SEQ ID NO: 24065 - protein, 213 aa, Escherichia coli UMNF18; identical to SEQ ID NO: 5744

SEQ ID NO: 24066 - protein, 351 aa, Escherichia coli UMNF18; identical to SEQ ID NO: 6367

SEQ ID NO: 24067 - protein, 826 aa, Escherichia coli UMNF18
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYSWDIGVFRLDFSVPQAWVEELESGYVPPENWERGINAFYTSYYVSQYYSDYKASGNNKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYLSRDYRTFNDHVWANNKDNYRRDINDIYDIADYYQNDFGRKNSFSANMSQSLPEGWGSVSLSTLWRDYWGRSGSSKDYQLSYSNNWRRISYTLAASQAYDENHHEEKRFNIFISIPFDWGDDVTTPRRQIYMSNSTTFDDQGVASNNTGLSGTVGSRDQFNYGVNLSYQHQENETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 24068 - protein, 224 aa, Escherichia coli UMNF18; identical to SEQ ID NO: 23393

SEQ ID NO: 24069 - protein, 650 aa, Escherichia coli UMNF18; identical to SEQ ID NO: 9042

SEQ ID NO: 24070 - protein, 203 aa, Escherichia coli UMNF18; identical to SEQ ID NO: 6396

SEQ ID NO: 24071 - protein, 565 aa, Escherichia coli UMNF18
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVANMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTEGGGGEYPLQDGFGWTNGVTLKMLDLICPKEQPCDNVPATRPTVKSATTQPSTKEAQPTP

SEQ ID NO: 24072 - protein, 207 aa, Escherichia coli UMNF18; identical to SEQ ID NO: 5743

SEQ ID NO: 24073 - protein, 828 aa, Escherichia coli UMNF18
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRCGDKVKVVSRRGEVISIVETRGRNRPPQGLVYMPFFDAAQLVNKLTLDATDPLSKETDFKKCAVKLEKV

SEQ ID NO: 24074 - protein, 230 aa, Escherichia coli UMNF18; identical to SEQ ID NO: 6360

SEQ ID NO: 24075 - protein, 869 aa, Escherichia coli UMNF18; identical to SEQ ID NO: 12649

SEQ ID NO: 24076 - protein, 87 aa, Escherichia coli UMNF18; identical to SEQ ID NO: 6104

SEQ ID NO: 24077 - protein, 162 aa, Escherichia coli UMNF18; identical to SEQ ID NO: 6365

SEQ ID NO: 24078 - protein, 367 aa, Escherichia coli UMNF18; identical to SEQ ID NO: 5789

SEQ ID NO: 24079 - protein, 200 aa, Escherichia coli UMNF18; identical to SEQ ID NO: 6363

SEQ ID NO: 24080 - protein, 354 aa, Escherichia coli UMNF18
MKKLTVAISAVAASVLMAMSAQAAEIYNKDSNKLDLYGKVNAKHYFSSNDADDGDTTYAHLGFKGETQINDQLTGFGQWEYEFKGNRAESQGSSKDKTRLAFAGLKFGDYGSIDYGRNYGVAYDIGAWTDVLPEFGGDTWTQTDVFMTQRATGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTD

SEQ ID NO: 24081 - protein, 746 aa, Escherichia coli UMNF18
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTLGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 24082 - protein, 193 aa, Escherichia coli UMNF18; identical to SEQ ID NO: 6300

SEQ ID NO: 24083 - protein, 274 aa, Escherichia coli UMNF18; identical to SEQ ID NO: 6362

SEQ ID NO: 24084 - protein, 250 aa, Escherichia coli UMNF18; identical to SEQ ID NO: 6361

SEQ ID NO: 24085 - protein, 881 aa, Escherichia coli UMNF18; identical to SEQ ID NO: 7317

SEQ ID NO: 24086 - protein, 242 aa, Escherichia coli UMNF18; identical to SEQ ID NO: 6420

SEQ ID NO: 24087 - protein, 815 aa, Escherichia coli UMNF18; identical to SEQ ID NO: 6927

SEQ ID NO: 24088 - protein, 430 aa, Escherichia coli UMNF18; identical to SEQ ID NO: 5758

SEQ ID NO: 24089 - protein, 539 aa, Escherichia coli UMNF18; identical to SEQ ID NO: 6391

SEQ ID NO: 24090 - protein, 700 aa, Escherichia coli UMNF18; identical to SEQ ID NO: 6388

SEQ ID NO: 24091 - protein, 518 aa, Escherichia coli UMNF18; identical to SEQ ID NO: 6358

SEQ ID NO: 24092 - protein, 119 aa, Escherichia coli UMNF18
MDAVLSVQGASAPIKKKSFFSKFTRLNMLRLARAVIPAAVLMMFFPQLAMASGGQDLMQSGNSTVKATFGKDSSVVKWVVLAEVLVGAVMYMMTKNVKFLAGFAIISVFIAVGMAVVGL

SEQ ID NO: 24093 - protein, 209 aa, Escherichia coli UMNF18
MAAFVLNGTRFIYEEGKKNVSFEVTNNADKTYGGQVWIDNTNQGNGVYMVPQPPFFKVGAKQKQIIRIINTDSNLPKDRESLFWLNVQEVPPKPEVKDSDEGVLAIAMNSRVKLIYRPASIKNGRQDAEKQLKMELRGDTTWLKNPTPYYMAIISVKHDGKDISLSDNVMKEIAQLRPFSDVNLGRVVRDKISVDAVNDWGGVQSYEIP

SEQ ID NO: 24094 - protein, 804 aa, Escherichia coli UMNF18
MKKRYIFKLSLLALSICSQFSVATELNLDFIHGISAIPSILKTDTTLPAGQYVVDVLVNNERTGRANLVITEEDEKNNHLCLSHEWLDSAGVMMKKDAYDYAFDREKQCYVLTRNSHTKVDFDYGAQTLKFNIPQAYLLSKTDPARWDYGLNGGRLKYYTNFNKNVYDDVNVFGNLDATINLGRWVLSSNMNMSHDRDKTEITSSDLTLSTAISQVQGDLLLGKSQTRTELFSDFNFYGVALRSNSNMRPWESRGYAPGITGIASTPSRITVKQNGYTVYSKMVPAGPYRLDDLRPMGNGELVVTVEDESGNKTEQVYPVTTLPTLLRPGEFQYNVAVGKKNNNNELDKAFHSDTGLFWLGSLDYGFSTTTLNSAFILNDDYQAAGLGGTQMLGGLGALSLSANMSKASYDNGEVKTGESFSAKYAKSFTDRTDLQLLTYRYQSKGYVEFADFNPKDIWSYARYGGQRSRYEARLSHRFDGTYLSGSYWRQDYWMREGTDTGSTLSFSTSVFDSVSVFLNGAYSKYAWSDKADYAVSLSLSVPFDLKGTRHYSSNSVGYTRTGGTTFNTSVSAMPTERLNYSLSANAGSTGDRGASASASYAFDAIQTNLGVSRSYNKHGNSHTSFSGSVSGSVLGTSESGPLFTKESSDTVGIVSIPGVEGVSVNGSMPTNRDGNTVVWLSEYSENNININMDNVPDDMEFETTSFNVVPTEKAMVYRKFGFENVLRYILRVKNAQGNYLTGGDAKTEQGLNAGFISNNGVLLMNMLAEPKAVSVNIGNGKQCRFSTAGLKANTNKVQEVRCE

SEQ ID NO: 24095 - protein, 1024 aa, Escherichia coli UMNF18
MTTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGGAENIGDNLGKAGGILSTFQNFLGTALSSMKIDELIKKQKSGGNVSSSEMAEASIELINQLVDTVASLNNNVNSFSQQLNTLGSVLSNTKHLNGVGNKLQNLPNLDNIGAGLDTVSGILSAISASFILSNADADTRTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTMISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGAVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDLIEGNDGNDRLYGDKGNDTLSGGNGDDQLYGGDGNDKLIGGAGNNYLNGGDGDDELQVQGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKGGRIITPDSLKKALEYQQRNNKASYVYGNDALAYGSQGDLNPLINEISKIISAAGNFDVKEERTAASLLQLSGNASDFSYGRNSITLTTSA

SEQ ID NO: 24096 - protein, 144 aa, Escherichia coli UMNF18
MVLCRIDLTCQYRSGFFVNNINGVFMNLSLFKGGRPASVKNRAWHYCQMAWRGVCNQKALSRLAALSPLLLLGMGQMAHATDLLAGGKDDVKATFGADSFVIMCIYIAEIVIGVATYIRTKNLLILLGLVVVIVFTTVGLTFVS

SEQ ID NO: 24097 - protein, 118 aa, Escherichia coli UMNK88 [sequence omitted]

SEQ ID NO: 24098 - protein, 359 aa, Escherichia coli UMNK88
MKKYLALALIAPLLISCSTTKKGDIYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 24099 - protein, 446 aa, Escherichia coli UMNK88; identical to SEQ ID NO: 8470

SEQ ID NO: 24100 - protein, 361 aa, Escherichia coli UMNK88; identical to SEQ ID NO: 7868

SEQ ID NO: 24101 - protein, 224 aa, Escherichia coli UMNK88
MTVSLTAILLSCSSAWAAGKGGIGLAATRLVYSEGEEQISLGVRNTSPDVPYLIQSWVMTPDNKKSADFIITPLLFVLNPANENLLRIMYIGAPLAKDRETLFFTSVRAVPSTTKREEGNTLKIATQSVIKLFWRPKGLAYPLAEAPAKLRCTSSADMVTVSNPTPYFITLTDLKIGGKVVKNQMISPFDKYQFSLPKGAKNSSVTYRTINDYGAETPQLNCKS

SEQ ID NO: 24102 - protein, 851 aa, Escherichia coli UMNK88
MPSFIGGLVVFVSAAFNAQAETWFDPAFFKDDPSMVADLSRFEKGQKITPGVYRVDIVLNQTIVDTRNVNFVELTPEKGIAACLTTESLDAMGVNTDAFPAFKQLDKQECALLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHTGARVLMKTSKQGIPLRFGAIATLDGVQANSGIIDDDGSLYMAGLPAKGTISVRWGEAPDQICHINYELTEQQINSAITRMDAICR

SEQ ID NO: 24103 - protein, 229 aa, Escherichia coli UMNK88
MALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQLSVNGEALSNAGVVPPKSQRQTSWCQAIAPCHVAWRAINDYGGLSAKKEQNLP

SEQ ID NO: 24104 - protein, 686 aa, Escherichia coli UMNK88; identical to SEQ ID NO: 6339

SEQ ID NO: 24105 - protein, 696 aa, Escherichia coli UMNK88; identical to SEQ ID NO: 6320

SEQ ID NO: 24106 - protein, 834 aa, Escherichia coli UMNK88
MYKKLKLTTISELIKNIYCSLSVIIIGCASAYAVEFNKDLIEAEDRENVNLSQFETDGQLPVGKYSLSTLINNKRTPIHLDLQWVLINNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLCTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTKRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 24107 - protein, 249 aa, Escherichia coli UMNK88; identical to SEQ ID NO: 6407

SEQ ID NO: 24108 - protein, 517 aa, Escherichia coli UMNK88; identical to SEQ ID NO: 6406

SEQ ID NO: 24109 - protein, 191 aa, Escherichia coli UMNK88; identical to SEQ ID NO: 5748

SEQ ID NO: 24110 - protein, 199 aa, Escherichia coli UMNK88; identical to SEQ ID NO: 8009

SEQ ID NO: 24111 - protein, 678 aa, Escherichia coli UMNK88
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFASAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPVS

SEQ ID NO: 24112 - protein, 784 aa, Escherichia coli UMNK88; identical to SEQ ID NO: 6283

SEQ ID NO: 24113 - protein, 170 aa, Escherichia coli UMNK88
MSGILTRWRQFGKRYFWPHLLLGMVAASLGLPALSNAAEPNAPAKATTRNHEPSAKVNFGQLALLEANTRRPNSNYSVDYWHQHAIRTVIRHLSFAMAPQTLPVAEESLPLQAQHLALLDTLSALLTQEGTPSEKGYRIDYAHFTPQAKFSTPVWISQAQGIRAGPQRLC

SEQ ID NO: 24114 - protein, 232 aa, Escherichia coli UMNK88; identical to SEQ ID NO: 5747

SEQ ID NO: 24115 - protein, 729 aa, Escherichia coli UMNK88; identical to SEQ ID NO: 6402

SEQ ID NO: 24116 - protein, 213 aa, Escherichia coli UMNK88; identical to SEQ ID NO: 5744

SEQ ID NO: 24117 - protein, 826 aa, Escherichia coli UMNK88
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSEFVQVGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYTLAASQAYDENHHEEKRFNIFISIPFDWGDDVTTPRRQIYMSNSTTFDDQGFASNNTGLSGTVGSRDQFNYGVNLSYQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSGSEAELRGNRKIAAPYRGAVVLVNFDTDQRKPWFIKALRADGQPLMFGYEVNDIHGHNIGVVGQGSQLFIRTNEVPLSVNVAIDKQQGLSCTITFGKEIDESRNYICQ

SEQ ID NO: 24118 - protein, 224 aa, Escherichia coli UMNK88
MKGLLSLLIFSMVLPAHAGIVIYGTRIIYPAENKEVMVQLMNQGNCSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWHLTIIDDHGNYISDKI

SEQ ID NO: 24119 - protein, 631 aa, Escherichia coli UMNK88
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRGVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 24120 - protein, 793 aa, Escherichia coli UMNK88; identical to SEQ ID NO: 13095

SEQ ID NO: 24121 - protein, 774 aa, Escherichia coli UMNK88; identical to SEQ ID NO: 6382

SEQ ID NO: 24122 - protein, 246 aa, Escherichia coli UMNK88; identical to SEQ ID NO: 6964

SEQ ID NO: 24123 - protein, 747 aa, Escherichia coli UMNK88; identical to SEQ ID NO: 6343

SEQ ID NO: 24124 - protein, 266 aa, Escherichia coli UMNK88; identical to SEQ ID NO: 5772

SEQ ID NO: 24125 - protein, 161 aa, Escherichia coli UMNK88; identical to SEQ ID NO: 5769

SEQ ID NO: 24126 - protein, 828 aa, Escherichia coli UMNK88; identical to SEQ ID NO: 6366

SEQ ID NO: 24127 - protein, 162 aa, Escherichia coli UMNK88; identical to SEQ ID NO: 6365

SEQ ID NO: 24128 - protein, 376 aa, Escherichia coli UMNK88
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLIDGLNFAVQYQGKNGSVSGEGMTNNGRVALRQNGDGVGGSITYDYEGFGIGAAVSSSKRTDDQNGSYTSNGVARNYIGTGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 24129 - protein, 203 aa, Escherichia coli UMNK88; identical to SEQ ID NO: 6396

SEQ ID NO: 24130 - protein, 565 aa, Escherichia coli UMNK88
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTFGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLISHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 24131 - protein, 207 aa, Escherichia coli UMNK88; identical to SEQ ID NO: 5743

SEQ ID NO: 24132 - protein, 200 aa, Escherichia coli UMNK88; identical to SEQ ID NO: 6363

SEQ ID NO: 24133 - protein, 654 aa, Escherichia coli UMNK88; identical to SEQ ID NO: 6425

SEQ ID NO: 24134 - protein, 897 aa, Escherichia coli UMNK88; identical to SEQ ID NO: 6392

SEQ ID NO: 24135 - protein, 386 aa, Escherichia coli UMNK88
MVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSNE

SEQ ID NO: 24136 - protein, 351 aa, Escherichia coli UMNK88; identical to SEQ ID NO: 6367

SEQ ID NO: 24137 - protein, 274 aa, Escherichia coli UMNK88
MNKTAIALLALLASSACLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVPTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 24138 - protein, 250 aa, Escherichia coli UMNK88
MSDLLCSAKLGAMTLALLLSATSLSALASVTPDRTRLIFNESDKSISVTLRNNDPKLPYLAQSWIEDEKGNKITSPLTVLPPVQRIDSMMNGQVKVQGMPDINKLPADRESMFYFNVREIPPKSNKPNTLQIALQTRIKLFWRPKALEKVSMKSPWQHKVTLTRSGQAFTVNNPTPYYVIISNASAQKNGNPATGFSPLVIEPKTTVPLNVKMDSVPVLTYVNDFGARMPLFFRCDGNTCQVDKDQSLKG

SEQ ID NO: 24139 - protein, 881 aa, Escherichia coli UMNK88
MPDHSLFRLRILPWCIALAMSGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGMEIKADLSQSALVISLPQAYLEYTWPDWDPPSRWDDGISGIIADYSITAQTRHEENGGDDSNEISGNGTVGVNLGPWRMRADWQTNYQHTRSNDDDEEFSGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSISGTLHVRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNVGTSDKHTSVDSYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAETTQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTDPPVSVSANQ

SEQ ID NO: 24140 - protein, 230 aa, Escherichia coli UMNK88; identical to SEQ ID NO: 6360

SEQ ID NO: 24141 - protein, 869 aa, Escherichia coli UMNK88
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGVNIAPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 24142 - protein, 539 aa, Escherichia coli UMNK88; identical to SEQ ID NO: 6525

SEQ ID NO: 24143 - protein, 700 aa, Escherichia coli UMNK88
MKIFSVRQTVLPALLALSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTVEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTVNELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 24144 - protein, 746 aa, Escherichia coli UMNK88; identical to SEQ ID NO: 6561

SEQ ID NO: 24145 - protein, 518 aa, Escherichia coli UMNK88; identical to SEQ ID NO: 6358

SEQ ID NO: 24146 - protein, 193 aa, Escherichia coli UMNK88; identical to SEQ ID NO: 6300

SEQ ID NO: 24147 - protein, 243 aa, Escherichia coli UMNK88
MTFMKGLPLLLLVASLCSHAALQPDRTRIVFNANDKATSLRVDNRSDKLPYLAYSWLENEKGEKSDDLLVALPPIQRLEPKATTQVRIVKQASTAKLPGDRETLFFYNMREIPPAPEKNSGHAVLQVAIQSRIKVFWRPAALRKKAGEKVELQLQVSQQGNQLTLKNPTAYYLTIAYLGRNEKGVFPGFKTVMIAPFSTVNTNTGSYSGSQFYLGYMDDYGALRMTTLNCSGECRLQAVEAKK

SEQ ID NO: 24148 - protein, 816 aa, Escherichia coli UMNK88; identical to SEQ ID NO: 6649

SEQ ID NO: 24149 - protein, 102 aa, Escherichia coli UMNK88; identical to SEQ ID NO: 6385

SEQ ID NO: 24150 - protein, 430 aa, Escherichia coli UMNK88; identical to SEQ ID NO: 5758

SEQ ID NO: 24151 - protein, 331 aa, Escherichia coli UMNK88; identical to SEQ ID NO: 6551

SEQ ID NO: 24152 - protein, 208 aa, Escherichia coli UMNK88; identical to SEQ ID NO: 5717

SEQ ID NO: 24153 - protein, 760 aa, Escherichia coli UMNK88
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 24154 - protein, 432 aa, Escherichia coli UMNK88; identical to SEQ ID NO: 5727

SEQ ID NO: 24155 - protein, 203 aa, Escherichia coli UMNK88; identical to SEQ ID NO: 6414

SEQ ID NO: 24156 - protein, 813 aa, Escherichia coli UMNK88
MPMKKYVTTKSVQPVAFRLTTLSLVMSAVLGSASVIAGEKLDMSFIQGGGVNPEVWAALNGSYAPGRYLVDLSLNGKEAGKQILDVTPQDSNELCLTEAWLTKAGVYVSADYFREGYDATRQCYVLTKAPSVKVDFDVSTQSLALSIPQKGLVKMPENVDWDYGTSAFRVNYNANANTGRNNTSAFGSADLKANIGHWVVSSSATASGGDSGDNSTTINMFTATRAIRALSADLAVGKTSTGDSLLGSTGTYGVSLSRNNSMKPGNLGYTPVFSGIANGPSRVTLTQNGRLLHSEMVPAGPFSITDVPLYTSGDVTMKITGEDGREQVQNFPLSVMAGQLSPGQHEFSVAAGLPDDDSDLKGGVFAASYGYGLDGLTLRAGGVFNQDWQGASAGVVAGLGYLGAVSADGAYATAKYRDGSHSGNKVQLSWSKQLETTNTGLRVSWSRQSEEYEGMSSFDPTELWSQSNHGRRTKDEWNAGISQPVGGLFSLSVSGWQRSYYPASMTGSYRYSDDNGKETGITGSLSTQIKGVSLNLGWSGSRNSRGENNWSASASVSVPFTLFDRRYSSSASVSTSKGGGTGFSTGVSGSLNDRFSYGLGGGRDGDGGTSSYLNASYSGDRAYLNGVLNHSQSGGTSGSVSVSGSVLAVPAAKDIMFSRTTGDTVAVVNVKDAPGVKVTSGDGQTDSDGNLVVPLNSYDWNTVTIDAGTLPLSTELTNTSQKVVPTDKAVVWMPFDALKVKRYLLQVKQRDGEFVPGGTWARDSKNTPLGFVANNGVLMINTVDAPGDITLGQCRIPAARLQDTEKLQEITCE

SEQ ID NO: 24157 - protein, 286 aa, Escherichia coli UMNK88
MRRVISPWASAGYLRPDCRILRNYRRLRVSKRNAVTTFFTNRVTKALGMTLALMMTCQSAMASLAVDQTRYIFRGDKDALTITVTNNDKERTFGGQAWVDNIVEKDTRPTFVVTPSFFKVKPNGQQTLRIIMASDHLPKDKESVYWLNLQDIPPALEGSGIAVALRTKLKLFYRPKALLEGRKGAEEGISLQSRPDGRTMLVNTTPYIFAIGSLLDGNGKKIATDNGTTQKLLMFMPGDEVQVKGNVVKVDSLNDYGELQTWTINKKKPAAPEAAKAEKADTAEQK

SEQ ID NO: 24158 - protein, 119 aa, Escherichia coli UMNK88; identical to SEQ ID NO: 5803

SEQ ID NO: 24159 - protein, 276 aa, Escherichia coli UMNK88
MALSFSGLSSCMIYKFSSMKNITFIFFILLASPLYANGDRLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLREYQSKVKRQIFSDYQSEVDIYNRIRDEL

SEQ ID NO: 24160 - protein, 124 aa, Escherichia coli UMNK88; identical to SEQ ID NO: 6005

SEQ ID NO: 24161 - protein, 119 aa, Escherichia coli UMNK88; identical to SEQ ID NO: 6116

SEQ ID NO: 24162 - protein, 1024 aa, Escherichia coli UMNK88
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGGILSTFQNFLGTALSSMKIDELINKQKSGGNVSSSEMAEASIELINQLVDTAASLNNNVNSFSQQLNTLGSVLSNTKHLNGVGNKLQNLPNLDNIGAGLDTVSGILSAISASFILSNADADTRTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGAVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDLIEGNDGNDRLYGDKGNDTLSGGNGDDQLYGGDGNDKLIGGAGNNYLNGGDGDDELQVQGNSLAKNVLFGGKGNDKLYGSEGADLLDGGEGNDLLKGGYGNDIYRYLSGYGHHIIDDDGGKEDKLSLADIDFRDVAFKREGNDLIMYKAEGNVLSIGHENGITFRNWFEKESGDISNHQIEQIFDKGGRIITPDSLKKALEYQQRNNKASYVYGNDALAYGSQDDLNPLINEISKIISAAGNFDVKEERTAASLLQLSGNASDFSYGRNSITLTTSA

SEQ ID NO: 24163 - protein, 240 aa, Escherichia coli Vir68
MKHILLFIFTVLLSLPSYGSVVIMGTRVIYPAEQKSINVRLNNGDSTPSLIQAWLDTGDPSSPPDSVRVPFIITPPVFRVEPLSGQTMRIMYTGENLPADRESLFWLNVLDIPAKPSFAGKSEKAQGYNYLQFAVRSRIKFFFRPDGLPFSPDDAYKKVTWQLTGGDTLQASNPTPYFITFSTVSVGQGAQKVSSTQGGMAAPFSSVTFRLKQKVSPSGKVEWTVVNDNGGYQKGESVVK

SEQ ID NO: 24164 - protein, 845 aa, Escherichia coli Vir68
MSHYSLSGLKYRVIYLCCLSGLYMLSVPLWAAEDAEFDPSFLSRTPGSSVIDVRRFTHGNPVPSGNYYSDIYLNGEWKGNAELSFRDMSSLQEESVLCVTPELLSILDVSPEAVAREPDTGNDRCMPFSAVVPDAKIRFDLSLLRLNVEIPQAMLVSRPRGYISPSQWQTGVPAAFVSYDVNHWRYRTPDMENNQSYLGLRAGFNAGGWAFRHRGTESWSDSHAEGYRSIETNLQHDIAMFRAQLTLGDFTTTGELMDSNSLRGIRLASDDRMLPGSLRGYAPVVRGMAGSNARVTVRQNGNIIYETTVPAGPFSISDLYPSGYGGDLTVTVTESDGQTRSFIVPFASVAQLVRPGFSRWQVAAGRYRYGNRTFSDTVFQGTLQYGLTNDITLNTGMSTAPHYLSGLGGVAFNTPLGAVATDITLARTTFPGSDTTHRGYSLHAGYSARIPETSTNVTLAAYRYSSRDFWSLRDAILTRNRDVINDSSVRSATGYRPRNQLQLTVNQSLGEGWGNLYLTGATYHYWGHTGTFNEYQAGYNNVWKKMSYQIGFSQTRRSGDYHHDNRFFFSFSLPLSDMGRTLLSTTVNVSDKNSNSIQSSISGVSGDDNQLSYGVSLNTQENGPTGYAVNGSYRSPVATLQATAGNDSRHNRQISAGISGAIVAHPFGVTASNDLGDTFTVIHADGAGGAVINNAPGNRLDPWGNGIVPYVTPYEKNYISIDPTALAADVELSATEREIIPRANSTTMVTFTTKTGKAMLFDVKMPDGTPPPMAAEALTADGKSAGYIAQGGRLFVRDLDAEKGMLRIVWGSGQNDSCVIHYSASGENARGNAVPENHHVVCMRQ

SEQ ID NO: 24165 - protein, 121 aa, Escherichia coli Vir68
MDVVLSVQGASAPVKKKSFFSKFTRLNMLRLARAVLPAAVLMMFFPQLAMAAGSSGQDLMASGNTTVKATFGKDSSVVKWVVLAEVLVGAVMYMMTKNVKFLAGFAIISVFIAVGMAVVGL

SEQ ID NO: 24166 - protein, 233 aa, Escherichia coli Vir68
MLRNITAIIVAFLVINVANASVILNNTRIVIDNAKMEKNVQFTNSGDNPVLVQIQAQENGENDCPPFIALPAVFRMLPGAGQTVKVSLTKRDIPKDRESLFYMDYIEVPSVKKDDQNRNKLYLIIRSRVKVIFRPEGLVFSVNKLHKQLSYEQFGNIVTIKNNSPFYANIRSFYLTGKTGNINYPGSVTVPPYGESRVQVKKVGETYAGLKMTALIINDFGADEKVDIAKKIT

SEQ ID NO: 24167 - protein, 839 aa, Escherichia coli Vir68; identical to SEQ ID NO: 23794

SEQ ID NO: 24168 - protein, 254 aa, Escherichia coli Vir68; identical to SEQ ID NO: 23795

SEQ ID NO: 24169 - protein, 255 aa, Escherichia coli Vir68
MTIFAPQLDKLLQKYQKAGNKLGGSAENIGDNLGKTGSVLSTFQNFLGTALSSMKIDELIKKQKSGSNVSSSELAKASIELINQLVDTAASLNNNVNSFSQQLNKLGSVLSNTKHLNGVGNKLQNLPNLDNIGAGQRNATQACHMGGQDPSRRISQLLRLITQSEGLAEAARLTFSSKGAHSPCVEGVNTAKLQAGRSAELQRLSEELIFGHYQPMPARWGYIPKSNGKLRPLGIPAMRYCSAGHADGDGADMEE

SEQ ID NO: 24170 - protein, 729 aa, Escherichia coli WV_060327; identical to SEQ ID NO: 6821

SEQ ID NO: 24171 - protein, 266 aa, Escherichia coli WV_060327; identical to SEQ ID NO: 5772

SEQ ID NO: 24172 - protein, 747 aa, Escherichia coli WV_060327; identical to SEQ ID NO: 7499

SEQ ID NO: 24173 - protein, 246 aa, Escherichia coli WV_060327; identical to SEQ ID NO: 5857

SEQ ID NO: 24174 - protein, 862 aa, Escherichia coli WV_060327
MTIKSTNHLTHIATFCALLYSNSALCAELVEYDHTFLMGKDASNIDLSRYTDGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTLHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIEHLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVLRQGAVVFADFETVQGQSAIMNIVRSDGKNIPFAADIYDEQNNIIGNVGQGGQAFVRGIEQEGNIRITWIEDGKPVSCFAHYQQNTTSEKIAQSIILNGLRCQIQ

SEQ ID NO: 24175 - protein, 386 aa, Escherichia coli WV_060327
MVDDVPVAQVLQALAEQEKLNLVVSPDVSGTVSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKAALSALEQWVAQMDLPVGQVELSAHIVTINEKSLRELGVKWTLADAQHAGGVGQVTALGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 24176 - protein, 351 aa, Escherichia coli WV_060327; identical to SEQ ID NO: 8304

SEQ ID NO: 24177 - protein, 360 aa, Escherichia coli WV_060327
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNNQVIYGNNGLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGMVYQF

SEQ ID NO: 24178 - protein, 161 aa, Escherichia coli WV_060327; identical to SEQ ID NO: 5769

SEQ ID NO: 24179 - protein, 614 aa, Escherichia coli WV_060327
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGKLIKSQLISSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGTYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 24180 - protein, 208 aa, Escherichia coli WV_060327; identical to SEQ ID NO: 5869

SEQ ID NO: 24181 - protein, 362 aa, Escherichia coli WV_060327; identical to SEQ ID NO: 5874

SEQ ID NO: 24182 - protein, 203 aa, Escherichia coli WV_060327; identical to SEQ ID NO: 6414

SEQ ID NO: 24183 - protein, 760 aa, Escherichia coli WV_060327
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSITDTATMRFEHDINDNATIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 24184 - protein, 331 aa, Escherichia coli WV_060327
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGEEAGHE

SEQ ID NO: 24185 - protein, 232 aa, Escherichia coli WV_060327; identical to SEQ ID NO: 5747

SEQ ID NO: 24186 - protein, 191 aa, Escherichia coli WV_060327; identical to SEQ ID NO: 5748

SEQ ID NO: 24187 - protein, 274 aa, Escherichia coli WV_060327; identical to SEQ ID NO: 5899

SEQ ID NO: 24188 - protein, 250 aa, Escherichia coli WV_060327
MTYKLSCPMLVSTALMALLTTASLTAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRKPWQFKVTLTRSGQDYTVNNPTPYHVIISDASTQKKGLTAAGFKPLVMPPKTSQPLKAKLASAPVLTYINDYGARMPLIFRCEGNTCKVDEDQSSKG

SEQ ID NO: 24189 - protein, 518 aa, Escherichia coli WV_060327; identical to SEQ ID NO: 6358

SEQ ID NO: 24190 - protein, 826 aa, Escherichia coli WV_060327
MLRMTPLASAIVALLIGIEAYAAEETFDTHFMIGGMKDQQVANIRLEDNQPLPGPYDIDIYVNKQWRGKYEIIVKDNPQETCLSREMIKRLGINTDSFASGKQCLTFKQLIQGGSYTWDIGVFRLDFSVPQAWVEDLESGYVPPENWERGINAFYTSYYVSQYYSDYKASGNSKSTYVRFNSGLNLQGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSIQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGFASNNTGLSGTVGSRDQFNYGVNLSYQYQGNETTAGVNLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 24191 - protein, 224 aa, Escherichia coli WV_060327
MKGLLALLISSMVLPAHAGIVIYGTRIIYPAEHKEVMVQLMNQGNRSSLMQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKVTFKKLLINRSGNGLVIKNDSANWVTISDVKANNVKVNYETIMIAPLESQSVNVKSNNANNWHLTIIDDHGNYISDKI

SEQ ID NO: 24192 - protein, 650 aa, Escherichia coli WV_060327
MSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 24193 - protein, 828 aa, Escherichia coli WV_060327
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGSNMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 24194 - protein, 162 aa, Escherichia coli WV_060327; identical to SEQ ID NO: 5896

SEQ ID NO: 24195 - protein, 373 aa, Escherichia coli WV_060327; identical to SEQ ID NO: 23861

SEQ ID NO: 24196 - protein, 200 aa, Escherichia coli WV_060327; identical to SEQ ID NO: 5898

SEQ ID NO: 24197 - protein, 236 aa, Escherichia coli WV_060327; identical to SEQ ID NO: 7624

SEQ ID NO: 24198 - protein, 883 aa, Escherichia coli WV_060327
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDSKEHSAEKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTQGGNTSSGTSGYSSLNYRGAYANTNVGYSRSGDSSQIYYGMSGGIIAHADGITFGQPLGDTMVLVKATGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPVVSPGTLLNQQTAICR

SEQ ID NO: 24199 - protein, 700 aa, Escherichia coli WV_060327
MKIFSVRQTVLPALLVLSPVVFAADEQTMIVSAAPQVVSELDIPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 24200 - protein, 539 aa, Escherichia coli WV_060327; identical to SEQ ID NO: 7564

SEQ ID NO: 24201 - protein, 207 aa, Escherichia coli WV_060327; identical to SEQ ID NO: 7443

SEQ ID NO: 24202 - protein, 565 aa, Escherichia coli WV_060327
MKSPAPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILSRASKAAGDNAMANQYETLANARQKGIEKYLWNDQQGWYADYDLKSHKVRNQLTAAALFPLYVNAAAKDRASKMATATKTHLLQSGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 24203 - protein, 656 aa, Escherichia coli WV_060327
MRLKKRYLCTVLSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSQDNAYDMHASLAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQPAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 24204 - protein, 203 aa, Escherichia coli WV_060327; identical to SEQ ID NO: 7450

SEQ ID NO: 24205 - protein, 111 aa, Escherichia coli WV_060327; identical to SEQ ID NO: 5889

SEQ ID NO: 24206 - protein, 241 aa, Escherichia coli WV_060327; identical to SEQ ID NO: 6139

SEQ ID NO: 24207 - protein, 856 aa, Escherichia coli WV_060327
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 24208 - protein, 713 aa, Escherichia coli WV_060327
MAMFTPSFSGLKGRALFSLLFAAPMIHATDSVTTKDGETITVTADANSATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 24209 - protein, 840 aa, Escherichia coli WV_060327
MNNKNTFSRDKLSHAIKNALSGVVCSLLFVLPVHAVEFNVDMIDAEDRENIDISRFEKKGYIPPGRYLVRVQINKNMLPQTLILEWVKADNESGSLLCLTKENLTNFGLNTEFIGSLQNIAGSECLDLSQRQELTTRLDKATMILSLSVPQAWLKYQATNWTPPEFWDTGIAGFILDYNVYASQYAPHHGDSTQNVSSYGTLGFNLGAWRLRSDYQYNQNFADGRPVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGIEINSNRTVTNGLGIAVMPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSTLHLTWGDNTCEVTPPNQSNISESAIILPCKTVK

SEQ ID NO: 24210 - protein, 246 aa, Escherichia coli WV_060327
MKSPLITTGMIYLLGICNFAQATVSPDRTRIIFNASNKSATVRLTNQSKIDPYLAQSWIEDASGKKTRDYISTLPPMERIEPDEQVQIRLMALASLNNLPQDRETLFYYNVREIPPRTKEQNVMQIAMQSRLKLFWRPKAIELKEGQMVPLQKVTITRTAAGLTLNNPTPYHITVGYIGTNGKTLMPGADSIMVAPFTSATQHLSSLPSTFQLGFVADYGGLEMFKVECNSVQSLCQSSPAKKGKI

SEQ ID NO: 24211 - protein, 312 aa, Escherichia coli WV_060327
MYKKTTLAVLIALLTGATTVHAQTDISSIESRLAALEQRLKNAESRAQAAEARAKTAELQVQKLAETQQQNQLTTQEVAQRTVQLEQKSAENSGFEFHGYARSGLLMNDAASSSKSGPYLTPAGETGGAVGRLGNEADTYVELNVEHKQTLDNGATTRFKAMLADGQRDYNDWTGSSSNLNIRQAFAELGALPSFTGAFKDSTVWAGKRFDRDNFDIHWLDSDVVFLAGTGGGIYDVKWNDTFRSNFSLYGRNFGDLDDIDNNVQNYILTMNHYAGPFQLMVADYGQKIMMIEKMPMVISFKLMLQILAYMR

SEQ ID NO: 24212 - protein, 109 aa, Escherichia coli WV_060327
MTFNTRLIKEVTQNFALAFEGSYQYMDLKPKGYQNHNAVNGSFYKLTFAPTLKANDINNFFSRPELRLFATWMDWSSKLDDFASNDAFGSSGFNTGGEWNFGVQMETWF

SEQ ID NO: 24213 - protein, 432 aa, Escherichia coli WV_060327; identical to SEQ ID NO: 5727

SEQ ID NO: 24214 - protein, 359 aa, Escherichia coli WV_060327; identical to SEQ ID NO: 5847

SEQ ID NO: 24215 - protein, 686 aa, Escherichia coli WV_060327; identical to SEQ ID NO: 7831

SEQ ID NO: 24216 - protein, 678 aa, Escherichia coli WV_060327; identical to SEQ ID NO: 17769

SEQ ID NO: 24217 - protein, 360 aa, Escherichia coli WV_060327
MKKLTVAISAVAASVLMAMSAQAAEIYNKDSNKLDLYGKVNAKHYFSSNDADDGDTTYVRLGFKGETQINDQLTGFGQWEYEFKGNRAESQGSSKDKTRLAFAGLKLGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 24218 - protein, 122 aa, Escherichia coli WV_060327; identical to SEQ ID NO: 5737

SEQ ID NO: 24219 - protein, 193 aa, Escherichia coli WV_060327; identical to SEQ ID NO: 6300

SEQ ID NO: 24220 - protein, 746 aa, Escherichia coli WV_060327; identical to SEQ ID NO: 6783

SEQ ID NO: 24221 - protein, 512 aa, Escherichia coli WV_060327; identical to SEQ ID NO: 6120

SEQ ID NO: 24222 - protein, 660 aa, Escherichia coli WV_060327; identical to SEQ ID NO: 6837

SEQ ID NO: 24223 - protein, 250 aa, Escherichia coli WV_060327; identical to SEQ ID NO: 14682

SEQ ID NO: 24224 - protein, 258 aa, Escherichia coli WV_060327
MRQYRLLSPMIKVVIVLFSLLFSTAQAGLVIGGTRFAYPENQSSISVELKNTSDRDMLVKVAVSPDDARHLTGTVESLPSFSGTVFIATPPLFVLKPDKNTKIRINRVGGSLPADRESLFILNVAALPTLENSHSVKTDNQLQIAVRNRMKIFYRPSNLSEDPNMSYQKLRWARKNEIVTVYNPGPRYVTLYNLHADGKVMDGGMIAPFSHRQQSWCKAQGVCEIAWQTLDIYNNVLPILKVKLNPSQLDVTGFVFSQ

SEQ ID NO: 24225 - protein, 368 aa, Escherichia coli WV_060327
MNKTITALTIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTTIDKINAHYFDKKAEDYFFNKFLLSFDPSTQQWSYAGESPWYGTAGAAVVNKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 24226 - protein, 446 aa, Escherichia coli WV_060327; identical to SEQ ID NO: 5873

SEQ ID NO: 24227 - protein, 237 aa, Escherichia coli WV_060327
MRKITQALSAVCLLFALNSSAVALASSPSPLNPGTNVAKLAEQVPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 24228 - protein, 118 aa, Escherichia coli XH001; identical to SEQ ID NO: 6381

SEQ ID NO: 24229 - protein, 129 aa, Escherichia coli XH001
MYAETRNMTPYGGGEFDNGESRSAIANKTQNFEVVAQYQFDFGLRPSIAYLQSKGKDLGGWAHDGNGDPRYTNKDLVKYVDIGATYYFNKNMSTYVDYKINLLDNDDDFYEANGIATDDIVAVGLVYQF

SEQ ID NO: 24230 - protein, 111 aa, Escherichia coli XH001; identical to SEQ ID NO: 8122

SEQ ID NO: 24231 - protein, 331 aa, Escherichia coli XH001; identical to SEQ ID NO: 6417

SEQ ID NO: 24232 - protein, 760 aa, Escherichia coli XH001; identical to SEQ ID NO: 6415

SEQ ID NO: 24233 - protein, 203 aa, Escherichia coli XH001; identical to SEQ ID NO: 6414

SEQ ID NO: 24234 - protein, 362 aa, Escherichia coli XH001; identical to SEQ ID NO: 5809

SEQ ID NO: 24235 - protein, 233 aa, Escherichia coli XH001; identical to SEQ ID NO: 6411

SEQ ID NO: 24236 - protein, 866 aa, Escherichia coli XH001; identical to SEQ ID NO: 6410

SEQ ID NO: 24237 - protein, 229 aa, Escherichia coli XH001; identical to SEQ ID NO: 7707

SEQ ID NO: 24238 - protein, 559 aa, Escherichia coli XH001; identical to SEQ ID NO: 6433

SEQ ID NO: 24239 - protein, 250 aa, Escherichia coli XH001; identical to SEQ ID NO: 6361

SEQ ID NO: 24240 - protein, 274 aa, Escherichia coli XH001; identical to SEQ ID NO: 6362

SEQ ID NO: 24241 - protein, 200 aa, Escherichia coli XH001; identical to SEQ ID NO: 6363

SEQ ID NO: 24242 - protein, 367 aa, Escherichia coli XH001; identical to SEQ ID NO: 5789

SEQ ID NO: 24243 - protein, 162 aa, Escherichia coli XH001; identical to SEQ ID NO: 6365

SEQ ID NO: 24244 - protein, 828 aa, Escherichia coli XH001; identical to SEQ ID NO: 6366

SEQ ID NO: 24245 - protein, 432 aa, Escherichia coli XH001; identical to SEQ ID NO: 5727

SEQ ID NO: 24246 - protein, 518 aa, Escherichia coli XH001; identical to SEQ ID NO: 6358

SEQ ID NO: 24247 - protein, 266 aa, Escherichia coli XH001; identical to SEQ ID NO: 5772

SEQ ID NO: 24248 - protein, 190 aa, Escherichia coli XH001
MKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 24249 - protein, 246 aa, Escherichia coli XH001; identical to SEQ ID NO: 6964

SEQ ID NO: 24250 - protein, 865 aa, Escherichia coli XH001; identical to SEQ ID NO: 6375

SEQ ID NO: 24251 - protein, 170 aa, Escherichia coli XH001 [sequence omitted]

SEQ ID NO: 24252 - protein, 784 aa, Escherichia coli XH001; identical to SEQ ID NO: 6283

SEQ ID NO: 24253 - protein, 161 aa, Escherichia coli XH001; identical to SEQ ID NO: 5769

SEQ ID NO: 24254 - protein, 207 aa, Escherichia coli XH001; identical to SEQ ID NO: 5743

SEQ ID NO: 24255 - protein, 565 aa, Escherichia coli XH001; identical to SEQ ID NO: 6395

SEQ ID NO: 24256 - protein, 203 aa, Escherichia coli XH001; identical to SEQ ID NO: 6396

SEQ ID NO: 24257 - protein, 359 aa, Escherichia coli XH001; identical to SEQ ID NO: 5847

SEQ ID NO: 24258 - protein, 614 aa, Escherichia coli XH001; identical to SEQ ID NO: 6387

SEQ ID NO: 24259 - protein, 208 aa, Escherichia coli XH001; identical to SEQ ID NO: 5717

SEQ ID NO: 24260 - protein, 663 aa, Escherichia coli XH001; identical to SEQ ID NO: 6307

SEQ ID NO: 24261 - protein, 224 aa, Escherichia coli XH001; identical to SEQ ID NO: 6372

SEQ ID NO: 24262 - protein, 826 aa, Escherichia coli XH001; identical to SEQ ID NO: 6373

SEQ ID NO: 24263 - protein, 412 aa, Escherichia coli XH001; identical to SEQ ID NO: 6390

SEQ ID NO: 24264 - protein, 213 aa, Escherichia coli XH001; identical to SEQ ID NO: 5744

SEQ ID NO: 24265 - protein, 729 aa, Escherichia coli XH001; identical to SEQ ID NO: 6402

SEQ ID NO: 24266 - protein, 232 aa, Escherichia coli XH001; identical to SEQ ID NO: 5747

SEQ ID NO: 24267 - protein, 191 aa, Escherichia coli XH001; identical to SEQ ID NO: 5748

SEQ ID NO: 24268 - protein, 511 aa, Escherichia coli XH001; identical to SEQ ID NO: 6694

SEQ ID NO: 24269 - protein, 793 aa, Escherichia coli XH001; identical to SEQ ID NO: 6397

SEQ ID NO: 24270 - protein, 678 aa, Escherichia coli XH001; identical to SEQ ID NO: 6398

SEQ ID NO: 24271 - protein, 838 aa, Escherichia coli XH001; identical to SEQ ID NO: 6399

SEQ ID NO: 24272 - protein, 231 aa, Escherichia coli XH001; identical to SEQ ID NO: 6400

SEQ ID NO: 24273 - protein, 878 aa, Escherichia coli XH001; identical to SEQ ID NO: 6378

SEQ ID NO: 24274 - protein, 241 aa, Escherichia coli XH001; identical to SEQ ID NO: 6379

SEQ ID NO: 24275 - protein, 193 aa, Escherichia coli XH001; identical to SEQ ID NO: 6300

SEQ ID NO: 24276 - protein, 746 aa, Escherichia coli XH001; identical to SEQ ID NO: 6422

SEQ ID NO: 24277 - protein, 822 aa, Escherichia coli XH001
QMSGNIGANPVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 24278 - protein, 249 aa, Escherichia coli XH001; identical to SEQ ID NO: 6407

SEQ ID NO: 24279 - protein, 237 aa, Escherichia coli XH001; identical to SEQ ID NO: 6384

SEQ ID NO: 24280 - protein, 446 aa, Escherichia coli XH001 [sequence omitted]

SEQ ID NO: 24281 - protein, 700 aa, Escherichia coli XH001; identical to SEQ ID NO: 6388

SEQ ID NO: 24282 - protein, 551 aa, Escherichia coli XH001; identical to SEQ ID NO: 6971

SEQ ID NO: 24283 - protein, 351 aa, Escherichia coli XH001; identical to SEQ ID NO: 6367

SEQ ID NO: 24284 - protein, 430 aa, Escherichia coli XH001; identical to SEQ ID NO: 5758

SEQ ID NO: 24285 - protein, 815 aa, Escherichia coli XH001; identical to SEQ ID NO: 6927

SEQ ID NO: 24286 - protein, 242 aa, Escherichia coli XH001; identical to SEQ ID NO: 6420

SEQ ID NO: 24287 - protein, 478 aa, Escherichia coli XH001
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWTRGGPEIVNNLGCADCHNTASPEFAKGKPELTLSRPYAARAMETIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 24288 - protein, 897 aa, Escherichia coli XH001; identical to SEQ ID NO: 6392

SEQ ID NO: 24289 - protein, 650 aa, Escherichia coli XH001; identical to SEQ ID NO: 6393

SEQ ID NO: 24290 - protein, 867 aa, Escherichia coli XH001; identical to SEQ ID NO: 6359

SEQ ID NO: 24291 - protein, 230 aa, Escherichia coli XH001; identical to SEQ ID NO: 6360

SEQ ID NO: 24292 - protein, 368 aa, Escherichia coli XH001; identical to SEQ ID NO: 6380

SEQ ID NO: 24293 - protein, 774 aa, Escherichia coli XH001
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVESEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 24294 - protein, 505 aa, Escherichia coli XH001; identical to SEQ ID NO: 6157

SEQ ID NO: 24295 - protein, 233 aa, Escherichia coli XH001; identical to SEQ ID NO: 5662

SEQ ID NO: 24296 - protein, 828 aa, Escherichia coli XH001; identical to SEQ ID NO: 5672

SEQ ID NO: 24297 - protein, 375 aa, Escherichia coli XH001
MNIYRAVTSFFNNSSKKGLTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTQRATGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKEGANKSLI

SEQ ID NO: 24298 - protein, 118 aa, Escherichia coli XH140A; identical to SEQ ID NO: 6381

SEQ ID NO: 24299 - protein, 518 aa, Escherichia coli XH140A; identical to SEQ ID NO: 6358

SEQ ID NO: 24300 - protein, 203 aa, Escherichia coli XH140A; identical to SEQ ID NO: 6414

SEQ ID NO: 24301 - protein, 362 aa, Escherichia coli XH140A; identical to SEQ ID NO: 5809

SEQ ID NO: 24302 - protein, 233 aa, Escherichia coli XH140A; identical to SEQ ID NO: 6411

SEQ ID NO: 24303 - protein, 866 aa, Escherichia coli XH140A; identical to SEQ ID NO: 6410

SEQ ID NO: 24304 - protein, 229 aa, Escherichia coli XH140A; identical to SEQ ID NO: 7707

SEQ ID NO: 24305 - protein, 161 aa, Escherichia coli XH140A; identical to SEQ ID NO: 5769

SEQ ID NO: 24306 - protein, 266 aa, Escherichia coli XH140A; identical to SEQ ID NO: 5772

SEQ ID NO: 24307 - protein, 747 aa, Escherichia coli XH140A; identical to SEQ ID NO: 6343

SEQ ID NO: 24308 - protein, 246 aa, Escherichia coli XH140A; identical to SEQ ID NO: 6964

SEQ ID NO: 24309 - protein, 865 aa, Escherichia coli XH140A; identical to SEQ ID NO: 6375

SEQ ID NO: 24310 - protein, 170 aa, Escherichia coli XH140A [sequence omitted]

SEQ ID NO: 24311 - protein, 203 aa, Escherichia coli XH140A; identical to SEQ ID NO: 6396

SEQ ID NO: 24312 - protein, 565 aa, Escherichia coli XH140A; identical to SEQ ID NO: 6395

SEQ ID NO: 24313 - protein, 207 aa, Escherichia coli XH140A; identical to SEQ ID NO: 5743

SEQ ID NO: 24314 - protein, 826 aa, Escherichia coli XH140A; identical to SEQ ID NO: 6373

SEQ ID NO: 24315 - protein, 224 aa, Escherichia coli XH140A; identical to SEQ ID NO: 6372

SEQ ID NO: 24316 - protein, 663 aa, Escherichia coli XH140A; identical to SEQ ID NO: 6307

SEQ ID NO: 24317 - protein, 213 aa, Escherichia coli XH140A; identical to SEQ ID NO: 5744

SEQ ID NO: 24318 - protein, 729 aa, Escherichia coli XH140A; identical to SEQ ID NO: 6402

SEQ ID NO: 24319 - protein, 232 aa, Escherichia coli XH140A; identical to SEQ ID NO: 5747

SEQ ID NO: 24320 - protein, 191 aa, Escherichia coli XH140A; identical to SEQ ID NO: 5748

SEQ ID NO: 24321 - protein, 511 aa, Escherichia coli XH140A; identical to SEQ ID NO: 6694

SEQ ID NO: 24322 - protein, 446 aa, Escherichia coli XH140A [sequence omitted]

SEQ ID NO: 24323 - protein, 237 aa, Escherichia coli XH140A; identical to SEQ ID NO: 6384

SEQ ID NO: 24324 - protein, 478 aa, Escherichia coli XH140A; identical to SEQ ID NO: 5711

SEQ ID NO: 24325 - protein, 208 aa, Escherichia coli XH140A; identical to SEQ ID NO: 5717

SEQ ID NO: 24326 - protein, 242 aa, Escherichia coli XH140A; identical to SEQ ID NO: 6420

SEQ ID NO: 24327 - protein, 815 aa, Escherichia coli XH140A; identical to SEQ ID NO: 6927

SEQ ID NO: 24328 - protein, 430 aa, Escherichia coli XH140A; identical to SEQ ID NO: 5758

SEQ ID NO: 24329 - protein, 331 aa, Escherichia coli XH140A; identical to SEQ ID NO: 6417

SEQ ID NO: 24330 - protein, 760 aa, Escherichia coli XH140A; identical to SEQ ID NO: 6415

SEQ ID NO: 24331 - protein, 412 aa, Escherichia coli XH140A; identical to SEQ ID NO: 6390

SEQ ID NO: 24332 - protein, 578 aa, Escherichia coli XH140A; identical to SEQ ID NO: 6950

SEQ ID NO: 24333 - protein, 250 aa, Escherichia coli XH140A; identical to SEQ ID NO: 6361

SEQ ID NO: 24334 - protein, 274 aa, Escherichia coli XH140A; identical to SEQ ID NO: 6362

SEQ ID NO: 24335 - protein, 774 aa, Escherichia coli XH140A; identical to SEQ ID NO: 6382

SEQ ID NO: 24336 - protein, 368 aa, Escherichia coli XH140A; identical to SEQ ID NO: 6380

SEQ ID NO: 24337 - protein, 241 aa, Escherichia coli XH140A; identical to SEQ ID NO: 6379

SEQ ID NO: 24338 - protein, 878 aa, Escherichia coli XH140A; identical to SEQ ID NO: 6378

SEQ ID NO: 24339 - protein, 432 aa, Escherichia coli XH140A; identical to SEQ ID NO: 5727

SEQ ID NO: 24340 - protein, 793 aa, Escherichia coli XH140A; identical to SEQ ID NO: 6397

SEQ ID NO: 24341 - protein, 700 aa, Escherichia coli XH140A; identical to SEQ ID NO: 6388

SEQ ID NO: 24342 - protein, 551 aa, Escherichia coli XH140A; identical to SEQ ID NO: 6971

SEQ ID NO: 24343 - protein, 746 aa, Escherichia coli XH140A; identical to SEQ ID NO: 6422

SEQ ID NO: 24344 - protein, 784 aa, Escherichia coli XH140A; identical to SEQ ID NO: 6283

SEQ ID NO: 24345 - protein, 231 aa, Escherichia coli XH140A; identical to SEQ ID NO: 6400

SEQ ID NO: 24346 - protein, 838 aa, Escherichia coli XH140A; identical to SEQ ID NO: 6399

SEQ ID NO: 24347 - protein, 678 aa, Escherichia coli XH140A; identical to SEQ ID NO: 6398

SEQ ID NO: 24348 - protein, 359 aa, Escherichia coli XH140A; identical to SEQ ID NO: 5847

SEQ ID NO: 24349 - protein, 650 aa, Escherichia coli XH140A; identical to SEQ ID NO: 6393

SEQ ID NO: 24350 - protein, 897 aa, Escherichia coli XH140A; identical to SEQ ID NO: 6392

SEQ ID NO: 24351 - protein, 351 aa, Escherichia coli XH140A; identical to SEQ ID NO: 6367

SEQ ID NO: 24352 - protein, 867 aa, Escherichia coli XH140A; identical to SEQ ID NO: 6359

SEQ ID NO: 24353 - protein, 230 aa, Escherichia coli XH140A; identical to SEQ ID NO: 6360

SEQ ID NO: 24354 - protein, 249 aa, Escherichia coli XH140A; identical to SEQ ID NO: 6407

SEQ ID NO: 24355 - protein, 820 aa, Escherichia coli XH140A
SGNIGANPVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 24356 - protein, 200 aa, Escherichia coli XH140A; identical to SEQ ID NO: 6363

SEQ ID NO: 24357 - protein, 367 aa, Escherichia coli XH140A; identical to SEQ ID NO: 5789

SEQ ID NO: 24358 - protein, 111 aa, Escherichia coli XH140A; identical to SEQ ID NO: 8122

SEQ ID NO: 24359 - protein, 193 aa, Escherichia coli XH140A; identical to SEQ ID NO: 6300

SEQ ID NO: 24360 - protein, 162 aa, Escherichia coli XH140A; identical to SEQ ID NO: 6365

SEQ ID NO: 24361 - protein, 828 aa, Escherichia coli XH140A; identical to SEQ ID NO: 6366

SEQ ID NO: 24362 - protein, 614 aa, Escherichia coli XH140A; identical to SEQ ID NO: 6387

SEQ ID NO: 24363 - protein, 374 aa, Escherichia coli XH140A
MNIYRAVTSFFNNSSKKGLTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTQRATGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKEGANKSL

SEQ ID NO: 24364 - protein, 374 aa, Fusarium anthophilum
MVRNIAIAALLPAAWALPSSSLQERDACTVTDYSGLATAVSSCTNIVLNGFQVPTGKQLDLSKLKAGTTVTFKGKATFATTADNDFDPIVISGSGITITGASGHVIDGNGQAYWDGQGSNNADNPKPDHFIVVKKVTGTSKITNLNIQNWPVHCFDITGSSDLTISGVILDNRAGDKPNSKSGGLPAAHNSDGFDISSCDHVTLDNNHVYNQDDCVAVTSGTNIVVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTCPS

SEQ ID NO: 24365 - protein, 98 aa, Fusarium culmorum
MKFSLAAVALLGAVVSALPANEKRQAYIPCSGLYGTSQCCATDVLGVADLDCGNPPSSPTDADNFSAVCAEIGQRARCCVLPILDQGILCNTPTGVQD

SEQ ID NO: 24366 - protein, 62 aa, Fusarium culmorum
GSTSYIYDTSAGSGTYAYIVDTGIITSHNGFNWAANDIISKSYSNYGTVLDIFAPGTSVLSS

SEQ ID NO: 24367 - protein, 230 aa, Fusarium oxysporum
MKFSIISTLLAATASALPAGQDAAALEARQLGGSITRNDLANGNSGSCPGVIFIYARGSTESGNLGTLGPRVASKLEAKYGKNGVWIQGVGGAYRATLGDNALPRGTSSAAIREMLGHFNDANQKCPDAVLIAGGYSQGAALAAASVTDVDPGIREKIAGVVLFGYTKNLQNRGKIPSYPEDRTKVFCNTGDLVCTGSLIVAAPHLAYQSAASGAAPEFLIQKADAAGAA

SEQ ID NO: 24368 - protein, 248 aa, Fusarium oxysporum
MVKFASVVALVAPLAAAAPQEIPNIVGGTSASAGDFPFIVSISRNGGPWCGGSLLNANTVLTAAHCVSGYAQSGFQIRAGSLSRTSGGITSSLSSVRVHPSYSGNNNDLAILKLSTSIPSGGNIGYARLAASGSDPVAGSSATVAGWGATSEGGSSTPVNLLKVTVPIVSRATCRAQYGTSAITNQMFCAGVSSGGKDSCQGDSGGPIVDSSNTLIGAVSWGNGCARPNYSGVYASVGALRSFIDTYA

SEQ ID NO: 24369 - protein, 376 aa, Fusarium oxysporum
MRSYTLLALAGPLAVSAASGSGHSTRYWDCCKPSCSWSGKAAVNAPALTCDKNDNPISNTNAVNGCEGGGSAYACTNYSPWAVNDELAYGFAATKISGGSEASWCCACYALTFTTGPVKGKKMIVQSTNTGGDLGDNHFDLMMPGGGVGIFDGCTSEFGKALGGAQYGGISSRSECDSYPELLKDGCHWRFDWFENADNPDFTFEQVQCPKALLDISGCKRDDDSSFPAFKGDTSASKPQPSSSAKKTTSAAAAAQPQKTKDSAPVVQKSSTKPAAQPEPTKPADKPQTDKPVATKPAATKPAQPVNKPKTTQKVRGTKTRGSCPAKTDATAKASVVPAYYQCGGSKSAYPNGNLACATGSKCVKQNEYYSQCVPN

SEQ ID NO: 24370 - protein, 462 aa, Fusarium oxysporum
MAYKLILAAFAATALAAPVEERQSCSNGVWAQCGGQNWSGTPCCTSGNKCVKLNDFYSQCQPGSAEPSSTAAGPSSTTATKTTATGGSSTTAGGSVTSAPPAASDNPYAGVDLWANNYYRSEVMNLAVPKLSGAKATAAAKVADVPSFQWMDTYDHISLMEDTLADIRKANKAGGKYAGQFVVYDLPNRDCAAAASNGEYSLDKDGANKYKAYIAKIKGILQNYSDTKVILVIEPDSLANLVTNLNVDKCAKAESAYKELTVYAIKELNLPNVSMYLDAGHGGWLGWPANIGPAAKLYAQIYKDAGKPSRVRGLVTNVSNYNGWKLSTKPDYTESNPNYDEQRYINAFAPLLAQEGWSNVKFIVDQGRSGKQPTGQKAQGDWCNAKGTGFGLRPSTNTGDALADAFVWVKPGGESDGTSDTSAARYDYHCGLDDALKPAPEAGTWFQAYFEQLLDNANPSFL

SEQ ID NO: 24371 - protein, 514 aa, Fusarium oxysporum
MYRIVATASALIAAARAQQVCSLNTETKPALTWSKCTSSGCSDVKGSVVIDANWRWTHQTSGSTNCYTGNKWDTSICTDGKTCAEKCCLDGADYSGTYGITSSGNQLSLGFVTNGPYSKNIGSRTYLMENENTYQMFQLLGNEFTFDVDVSGIGCGLNGAPHFVSMDEDGGKAKYSGNKAGAKYGTGYCDAQCPRDVKFINGVANSEGWKPSDSDVNAGVGNLGTCCPEMDIWEANSISTAFTPHPCTKLTQHSCTGDSCGGTYSSDRYGGTCDADGCDFNAYRQGNKTFYGPGSNFNIDTTKKMTVVTQFHKGSNGRLSEITRLYVQNGKVIANSESKIAGNPGSSLTSDFCSKQKSVFGDIDDFSKKGGWNGMSDALSAPMVLVMSLWHDHHSNMLWLDSTYPTDSTKVGSQRGSCATTSGKPSDLERDVPNSKVSFSNIKFGPIGSTYKSDGTTPNPPASSSTTGSSTPTNPPAGSVDQWGQCGGQNYSGPTTCKSPFTCKKINDFYSQCQ

SEQ ID NO: 24372 - protein, 385 aa, Fusarium oxysporum
MHTLSVLLALAPVSALAQAPIWGQCGGNGWTGATTCASGLKCEKINDWYYQCVPGSGGSEPQPSSTQGGGTPQPTGGNSGGTGLDAKFKAKGKQYFGTEIDHYHLNNNPLINIVKAQFGQVTCENSMKWDAIEPSRNSFTFSNADKVVDFATQNGKLIRGHTLLWHSQLPQWVQNINDRSTLTAVIENHVKTMVTRYKGKILQWDVVNNEIFAEDGNLRDSVFSRVLGEDFVGIAFRAARAADPAAKLYINDYNLDKSDYAKVTRGMVAHVNKWIAAGIPIDGIGSQGHLAAPSGWNPASGVPAALRALAASDAKEIAITELDIAGASANDYLTVMNACLAVPKCVGITVWGVSDKDSWRPGDNPLLYDSNYQPKAAFNALANAL

SEQ ID NO: 24373 - protein, 98 aa, Fusarium oxysporum
  strain Fo5176
MQFSLAIVTLLATAVSALPTEEKRQAYIPCSGLYGTSQCCATDVLGVADLDCGNPPSTPANATDFSAVCSAIGQRARCCVLPILDQGILCNTPTGVQD

SEQ ID NO: 24374 - protein, 232 aa, Fusarium oxysporum
  strain Fo5176
MKFTIITALLAASASALPTDQDTAAAIEARQFGGSSTRNDLSNGNSASCPPVIFIYARGSTETGNLGTLGPNIASKLEAKYGKSGVWIQGVGGAYRATLGDNALPRGTSTVAIREMVGLFNTANTKCPDATLIAGGYSQGAALAAASITDIGSAIREKIAGTVLFGYTKNQQNNGRIPSYPTERTKVFCNAGDLVCTGSLIIAGPHLMYQIAAAGAAPEFLIQRVAAVQGSS

SEQ ID NO: 24375 - protein, 477 aa, Fusarium oxysporum
  strain Fo5176
MPTNGSQIKTYAAPEGVAVADAFLIYARSVDSEPWIPVSTYAVDVAEVNTTRNEFDKHPISVASFDMDGPVEVQVKYTLNKVQSAAIRPKSLGIEAVIDGDNTITFSMDRPRDVMLEINYDKWQALHILTNGIDHNAPPSDSQEIWYFGPGINNGSSYGLVTDGNLFVPSNTMVYLAGGAFVTFKLNFIKVCNSGVRGHGFIYNGPNGGAILIERSENIVVENVTSLGATGFSLTTGEAKGVSISGYRSFSSHGNGDGVDLFCSSNILVENCFLRNSDDTIAIYGHRWDYYGDSSNIVIRNCTLLPDIAHPIHMGTHGNPAKPETISGIHISNIDILDHYENQMWYQGCISLSAGDENLIEDVHIQDVRVERISKGQLVNMRVMKNEMWTTAPGHGIRNATLKNISLDATNSQIVNPSQILGFDYTRKVENIVFENLNIGGQYIHDGMEKPRWYMVADLVPIFVNEHVTNVKFILTK

SEQ ID NO: 24376 - protein, 395 aa, Fusarium oxysporum
  strain Fo5176
MSYKTLFLLGLATIALALPSDRVSKEGLVAGKFIVALKPTANVDLDLHARWVSDVHGQALARRGVESGGIDKTFSFPGFQGYSGVFDDNTIEIIKANSSVLHVEREQSFTIASPVTQQSPPWGLSAISNANPSSSKASYTYDSTAGAGTFVYVLDSGIYLEHEEFQGRAVFGADTSGVSSKKQHGTLVAAIVNGATYGVAKKATVVDVQVLGDDGGSSSGVLAGLSWTVNDVVSKNRAGKAVINMSLSGANSVIFNEAVQKAIDAGIPVVAAAGNANEDASKSSPGNQPNVITVAASNKDYQRWAWSNWGPACDIFAPGEQITSAWPTSASATYIASGTSEASPHVAGVIAYLFALEGSRTPAQIWSRLQELAIKDKITDVKGVPNLLVYNGIGK

SEQ ID NO: 24377 - protein, 376 aa, Fusarium oxysporum
  strain Fo5176
MRSYTLLALAGPLAVSAASGSGHSTRYWDCCKPSCSWSGKAAVNAPALTCDKNDNPISNTNAVNGCEGGGSAYACTNYSPWAVNDELAYGFAATKISGGSEASWCCACYALTFTSGPVKGKKMIVQSTNTGGDLGDNHFDLMMPGGGVGIFDGCTSEFGKALGGAQYGGISSRSECDSFPELLKDGCHWRFDWFENADNPDFTFEQVQCPKALLDISGCKRDDDSSFPAYKGDTSASKPQPSSSAKKTTSAAAAAQPQKTKDSAPVVQKSSTKAAAQPEPTKPAEKPSAAKPAATKPAATKPAQPVNKPKTTQKVRGTKTRGSCPAKTDPTAKASVVPAYYQCGGSKSAYPNGNLACATGSKCVKQNEYYSQCIPN

SEQ ID NO: 24378 - protein, 345 aa, Fusarium oxysporum
  strain Fo5176
MHSSTTLLLLATATVNAIGIRDDCKDVHIFLAKGNNEPYPGRQGKLAGAICSGLKSCDYEDIQFQNALEDPFCDSVTEGVKNGIKQITAYNKKCPDSKLVVSGYSQGGQVVGDILGGGGGVFFQNCVEPDLQGLNPKTLPGSKIVAAMVFGDTRHTKDQPFNVLSGAGKNGLFPRPAGMLQNLASYGDVFRNYCVETDPICAQGDEVETHLNYFDVFTDDVAEWVKERVGEDSTTTTAATKTSTKAKSTAKETSTKDAETESTTEATSTTKDASKDSTTKDTTTAAASTTADSSSTTNASSAEGRATAGEASSDAAAPLSTDNAATSKGASLMGMIIGVAALLAI

SEQ ID NO: 24379 - protein, 234 aa, Fusarium oxysporum
  strain Fo5176
MLNTAFLASLFLIPLAIGAPAVDIEERQAPCQNVHIFLARGTDEPYPGRQSSLASAICSGLPSCGYENINYPANFNTYCTSIYAGITGGLSQITAYANRCPNSKIVLSGYSQGAQLIGDILGGGGGQSLGCTQQSNSALNPATSPGNKIAAALFFGDPRHAANQAYNTGTGASRNGINPRNGAQLTSLNRFSNKIRSWCLAGDNVCAQGTDPNAHTSYFNVFSQEAGAWVKTKV

SEQ ID NO: 24380 - protein, 457 aa, Fusarium oxysporum
  strain Fo5176
MLFNNVISAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLDLEAKSLNGVKIANSDGWDTYRSDRIVIQNSVIDNTDAADCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTSARDTTNG

SEQ ID NO: 24381 - protein, 394 aa, Fusarium oxysporum
  strain Fo5176
MHTLSVLLALAPVSALAQAPIWGQCGGNGWTGATTCASGLKCEKINDWYYQCVPGSGGSEPQPSSTQGGGTPQPTGGNSGGTGLDAKFKAKGKQYFGTEIDHYHLNNNPLINIVKAQFGQVTCENSMKWDAIEPSRNSFTFSNADKVVDFATQNGKLIRGHTLLWHSQLPQWVQNINDRSTLTAVIENHVKTMVTRYKGKILQWDVVNEIFAEDGNLRDSVFSRVLGEDFVGIAFRAARAADPAAKLYINDYNLDKSDYAKLTRGMVAHVNKWIAAGIPIDGIGSQGHLAAPSGWNPASGVPAALRALAASDAKEIAITELDIAGASANDYLTVMNACLAVPKCVGITVWGVSDKDSWRPGENPLLYDSNYQPKAAFNALVNALMEVTGYVLTI

SEQ ID NO: 24382 - protein, 147 aa, Fusarium oxysporum
  strain Fo5176
MHLGASLIALASAAGLVSAGINCNGAAGCPSVAGNLDQLINLANGIDDNRWYNSGQKIVCIQTNLGNTGLCAFQQNTGGAPGHSIKSLLRSLRDHGCKKCGSVPLFYPSDNNDSSHGILTVNVVGNTGGCAWGRMQVVNKVRLTRFK

SEQ ID NO: 24383 - protein, 407 aa, Fusarium oxysporum
  strain Fo5176
MRASTISAIFSGLAVSITAQSDLDGSVWKALLAEPQSKRGFSDMPRNRPVKRQSGWNPPADLKAPLQEVWEHYEKTYDGGLDANVNTGFHQIMANKGYLNICVRWDSSAAITEAQRTKIASAYNAQYQKWFKWLYGYNGFPYDDVKVNIVAYAVKDKSQLQGSTAGYEVYTELDADGVPMCPVACARDAHLDGDYSGCKAGADRHYDHSLWLKDGLEGGFGHNWGQEVGREYFMNNLDSDSIHILLHEMGHTFALDDFYDWTPTGVTKFIMLAGASMEITDFDGWMYRNWWYYLSQKNNWSSSKSSSNAAPVSSESKPSVNTAAPVKAPTKTASPKPSTSTTKATVAKPTSTKKATATKVPSTEKSSGAEAAAWGQCGGNNWTGATKCASGTKCTKHNDYYSQCVAN

SEQ ID NO: 24384 - protein, 300 aa, Fusarium oxysporum
  strain Fo5176
MQLTSIISFWLLALFSTVLGAEVVPRGQLKEVTSYGNNPTGTKMFLYVPKNLKSNPAVVVALHYCTGTAQAYYQGTKWASNAEKYGFIVVYPQTPYTPGNCWDVSSKMTLKHEGGGCSTSIANMAKFVLKEYNGDAKKVFVTGESSGAMMTNVMLATYPDVFAAGSAYAGVPAGCFVSQQNQAAAWNSTCSQGKSIYTQTQWANVVKNMYPGYNGARPKFQIYHGTADPTLNVQNYYEEIKQWTGVFGYSSNPQSSTPNTPASPFTRQVFGEKFQAFLGQGITHGVPHFDDNDLKWFGII

SEQ ID NO: 24385 - protein, 467 aa, Fusarium oxysporum
  strain Fo5176
MKLVLITGLFSAILATAQLTGPVGPLTALSQKTHECNILDYGAVNDNSTDIADAIEKTFKTCVLPHAGSRLIVPDGQYLIKRSVVLSNGTNWAFQLDGLITLAYGGNWTVDRDGQFLQNGLTIINPVDFEFYSQNGKGAIQGQGYIYRNLANTFRPRLVRIISPINTSVHDLILVDSPKFHIVFDFAENLEVYHLTIRGANLGSYDGVDVVGTNYWIHDIEVTNRDECVSVKSPSNHALIENLVCNQAGSGISIGSLNVSASIANIHARNINIIQGNNIAFIKTYPGGSGHVTNITFENFRSKASLYGLDINQYWQNTFEPDTGAVALSNLVFKNFSGSVADGSKRPPLFLVANDLSFATNVTVEDFSIWTESGSSVVNKISNIFGHGDNSYGQANGIKSLSSGQAPTAYTSTYTVTATPTGWAAPSFPTWAAASTGYGTDVPIPVYTPAALWKPEGDYDKHYWGSF

SEQ ID NO: 24386 - protein, 336 aa, Fusarium oxysporum
  strain Fo5176
MKASMFLLGASAILASASPIRNALEKREIEKREMKTEWVYEVVTVTVVAGDEPETTAPAATKPTGVVFMEAPAPKYTAPSTTKEAAKPKKVKKPVSKPSTTKEAPKVTVVTVEPQPESTKETVYESPAPVVEKPKTTVEKVVAKPTKAAEPKVEVPASGGDDLSLDGAYNTVMLAYHNIHRLNHSASALEWDDELAGYAENTANGCVFEHDMKQGNGGYGQNLASWGATSDIDGLKNKAAAGGITNQWYNNEMANWAFYGQENPPADMNIDLYGHFTQVVWKDSTKVGCATVKCPAGTVLSFPSWYTVCNYNPQGNFGGRYGDNVLKPKGEKRVTV

SEQ ID NO: 24387 - protein, 334 aa, Fusarium oxysporum
  strain Fo5176
MRKAALLTIANFGSAFAALQFYNQCGGGAYTGDTTCPSGSTCVEASKWYSQCIPDAKAGPSPKAAAVEKSDVDLPSFGFPEFPEAPGSGSGNQNGGENDENASLPPIVSAPAEEADESSKKPVETPIDSPVANPTEAPVANPDAGSGSGSGAGGITRTIPASSGASAAATAIPVSGEFDGKMTYYDRSPAVCQDQVETGEADAMFILEDGATLRNVIIGPGQAEGVHCKGTCTLENVWFEDVCEDAITLKQKSGTSTIRGGGAFHAADKVVQFNGRGTVEISDFYVEDYGKLVRSCGNCKDNGGPRNVVIDNVAAVNGGVLCGSKSHRRHQSSL

SEQ ID NO: 24388 - protein, 263 aa, Fusarium oxysporum
  strain Fo5176
MHFLSILLLAGSALAAPRAAQSSPHQPRGDSIDDMLPPIVPINTRSGDRDLISKIITAPTQAERVKLLNQPGDYVFDFKAGTGAGEASGKGGKSVSATALTMPALIGNGASMTVAFLGPCGMNTAHVHNRATELNIIVKGRLVTNFVVENGAKPIANTMDTFQMSVFPQGAIHQEFNPDCEDAVFVAAFDNADPGVNQIAQNFFSLNGDVVKATLGGVQTIDGKDIESFRAHIPANIALGIDACLNKCGIKRNSKRDISELLN

SEQ ID NO: 24389 - protein, 423 aa, Fusarium oxysporum
  strain Fo5176
MKFASIVAAAFASAPALAWGTDHYADVKLGLQLAKDAGLKVMRTWAFHDNNRTYVSGGLPQYGTGAENTVMQFFEKDGSVKIDLSKLDVVIEAAEATNMKLILALTNNWADYGGMDVYTVNLGGRYHDDFYRLPAIKKAFKNYISAVVNRYKDSPAVFAWEIANEPRCGADGTRNLPRGPDCTPATITSWVSEMSTYIKSLDPNHLVTTGSEGGFNRQSDDWTYNGADGTDFDAEIKLPNIDFNTFHSYPQYWSKTTDWVVQWIKDHAAAGATAKKPVLHEEYGWTDKSTRIATLSKWQKASLDLEVSDMYWQFGTSKFSYGKNHDDRNTIYLEDDEAQPLVYEHAAAVNAANGGAAPTKPTTTATATSKPSTTLSTTSKPTVTGGPTVPRYGQCGGASWTGPTVCASPYTCKEQNQWYSQCL

SEQ ID NO: 24390 - protein, 233 aa, Fusarium oxysporum
  strain Fo5176
MHASSLLTLLTTLPAAMACLGYTGGVPKATGTKSLSAPQYLKKGQVFDAKWVRYDRGVKCSGQSEGGEKDAVFVLEDGATLRNVVIGANQKEGVHCLGACNLEFVWFEDVCEDAISIKGSGTANIIGGGAYKAADKIIQHNGCGHVNIVNFYANDYGKVYRSCGNCKGNSKCKRSVHMEGVTAVNGGELIGINTNLGDKATYSNNCYPKTQCQGYNGCDKSNGECEPSKAGKC

SEQ ID NO: 24391 - protein, 240 aa, Fusarium oxysporum
  strain Fo5176
MKYTAILALAGVSSAAVTKTLPKSAGATSFPTAVPVKGSYDGGMKRFERSPSVCQGQTETGEKDAMFILENGATLSNVIIGASQAEGVHCKGTCTLNNVWWADVCEDAVTLKQTSGTSYINGGGAFHASDKIVQFNGRGTVQIKDFYAEDYGKLVRSCGNCKDNGGPRNVVISGSVAVDGGVLCGINTNYGDTCKITSSCQNKGKYCDRYEGNSSGAEPSKIGSGPDGKYCTTSGVTTSC

SEQ ID NO: 24392 - protein, 374 aa, Fusarium oxysporum
  strain Fo5176
MKLTAFTSLWLLTLCYTALAAEVVPRSTFTEVTDYGDNPTGTRMWLYVPKTLAPKPAVVVGIHWCTGSAQAYYQGTRWAFYAETYGYIVIYPQTPYTQDKCWDVASKMTLTHDGGGASNSIANMAKFVIKEYSADSSRVFVTGTSSGAMMTNVMAAAYPDIFAAGIAYAGVPAGCFRSEDDIPDYWNSTCATGQSIYTQGQWANVVKNMYPGYNGPRPKMQIYHGSVDEVLNVQNYYETIKQWTGVFGYSAEPKSTTANVPRSPYTRFVFGDKLQTFLGQGITHSIDVFPEEDLKWFGFTLTNSQDPVTPSPTITATVPTNTGGSEGSPQWGQCGGMGWTGPKQKLQCATPYNCVKINDLPIIVPGTELCVRQY

SEQ ID NO: 24393 - protein, 616 aa, Fusarium oxysporum
  strain Fo5176
MAAVRICVCGDESTGKSSLIASLVKDQFVNNKIQPVLPQITIPPSIGTPENVSTTIVDTSARPQDRTTLRKEIRKCNVILLVYADHYSYERVALFWMPYFRSLGVNVPVVLCANKSDLAGQGTTPQVVEEELLPVMAEFREIDSCIRTSARDHRNVNEVFFLCQKAVTHPIAPLFDYKEGHLKPLCVDALRRIFYLCDKDQDGYLNEQEMRDFQARCFDKPLTADDLDNIKLSISKSLPTSDLEKGIDLPGFLQLNKLYAEKGRHETIWIILRKYHYTDSLSLEDKFIRPKFDVPEYSSAELSPAGYRFFVDLFLLFDKDNDGGLNDQELEALFAPAPGLPSSWTDSSFPSSTGWLAQWSMTTFIEPKTTIEYLAYLGFEPPNPKEPITAALKITKPRKRRRRPGRVERNVVLCYVLGASGAGKSALLDSFLNRPFDGLYHPTIKPRRAVNSVELPGGKQVYLILEELGELEPAILDNPAKLDACDLICYAYDSSDPDSFSHIVDLRNKYTHLDELPSIYTALKADKDKTNQRCELQPDQYTASLNMSLPLHVSVTWGSISELFVAFADAATNPSTAFPRSNEEGPDRTSLYIALGATACAGVAALTIWRRATNAL

SEQ ID NO: 24394 - protein, 565 aa, Fusarium oxysporum
  strain Fo5176
MKSKSIMAASTVMELALAQASAEPLCSTIINLQPIEYQFQQPVLIDSYFPANTDIVLDDGHVVHVTNAPTSLSTVLTDVSTSSTTLTSSASNVNGNPPDGGYLTFTVPANPDDIGNHPVTKTYPPTEPGQPGIVVIQVPTSPPGADGIPTSSVPYVTVTTTGDFPSLTGPVTTTITPDEPGATGSVIIEVPNTKIASPSASYVTVTTPGSLAPTDAPHTSTIPPSNPTDPGTVIVVVPSSQASSVSSIPFVTVTTTGSTLNPTDDPITSTISPSGSTGSGTVIVEVPPSSFPSGSGASSSPVSFVTRTVTGDDGNGEPSTTTITPTASSGPGTVIVEVPPPTNSPSATSSGSSMPGGPGSSGTGSSASQGPSDSAAPSSSTGDTGPSSVPESSSPSRATTDDAASSTSASAPASSSAASSTTQSETPSSAGAETSTPATSPASSSAPSTSDADTSSPVNPTTSSPASSAATSAPGSSTESAPSSSTSAAAANFDPCPDSLYGNPQCCSVDVLGVADVECDSPTESPTDAENFQAICAASGQRARCCVLPVLGQALVCLTPVGVSN

SEQ ID NO: 24395 - protein, 100 aa, Fusarium oxysporum
  strain Fo5176
MQFYTIVSLFLASTAYALPATSANGYEACPSGGLFGNPQCCSLNLVGVLSGDCRAPTKTPNSAKEFQAICAESGQKARCCGLSEILELGAFCQKPVGVSA

SEQ ID NO: 24396 - protein, 360 aa, Fusarium oxysporum
  strain Fo5176
MFSKSVLIALVPFAVAGPIAPRQGLGSGLGSGIPSFGGSTGGLPGLPSSGGSTGGLPSIPSLPSSGGSTGGLPSIPGLGSGGSSGGIPSIPGLPSSGGSTGGLPSLPIGGGGSSFLPGGSTGGDTTGDTTGDTSGSASTSAPASQPTGSSETPRAEGGSSTSPFGSFLGSAGGSSGGFGGSTQNGLSGDCKDVTVIFARGTTEMGNVGTAAGPPFFQALAQQLGSDKLAVQGVEYAASVGGIMQMGDQAGSQKMVSLVKEAYQKCPKTKVVMSGYSQGAMLVHNAAKSLPADTTSKIAAVVNFGDPFQRQAIQGVPADRVKIICHAGDGVCAGTAAITPDHLTYSQDANAAAQFVVSKVK

SEQ ID NO: 24397 - protein, 549 aa, Fusarium oxysporum
  strain Fo5176
MHKTTLLGLLASSPVSAQLHSLAQAAGLKYFGSAVDNGYLSDAPYSKLADDVEEFGQLVPENGQKWETVEPKQGDFVYTTADVVPDLAKKNGQILRCHALTWHSQLPTWVSSGAFSAEELTEVIEAHIANVVEHYKGDCYAWDVVNEAIDDNAEWRDSVFSRTLGTDFLGISFKAARKADPAAKLYYNDYNLEQNGAKTDKAVELVKLLQKEGAPIDGVGFQGHLIVGQTPSRSELAATFKRFTDLNVEVAITELDIRHESVPASAAELKTQGDEYADVVGACLDTKGCVGVTVWGITDKYSWIPGVFEGNGEALLYTDDYEKKPAWTSVSSLLAAAATKAPATSSVAPVETTAPATTLETKTKPVYTVPGTTNYMNTTAPQTEQTRTALATETDDNDDNCAETEAPFPTYAIPTNGTQVYPTKAPVDDDSDDDCAETEAPIPTQAPVPSGDCDEDDGEFEPTVAAIEPTTRVPVIRSSSAYTYKWNTETTAPQVPAPTGTAPAYPVGTGSGGVVKHYYQCGGKNYKGPTECEKPYKCVEHNEYYFQCV

SEQ ID NO: 24398 - protein, 397 aa, Fusarium oxysporum
  strain Fo5176
MRFSSAAGLMALATSTVAHPNSATSDLDGSVWKALTPLKSRSWTSIPRNRPTKRQSGWNPPSNLATPLKEVWDHEVKTYSDALGFKNYGWDQVIAGKGQLNVCVRWESSASVTAEQRTKVAAALQDSYSAWMKWVSGYDNFPYEEVKINVVGWAVKNKSLLQGSTEGLDIYTDTDAEGIPQCSEKCGRFFHQDGDYSSCPGGAERHYDNSLWLTDGMQGGAGGDWGQRIGREYFMDLLGQKDIHILEHEIGHTFALDDFYDWTPTGQTNFIMLAGSSTKVTDFDGWMLRNWWYELSRKRGWQSTASSSASKGTSSEKAVTPVSSKAASTKTAVAKPTTTTVKQAATQTAAKPAKDTASSATAAAYAQCGGGAGYTGPTKCASGLKCTKHSEWYSQCL

SEQ ID NO: 24399 - protein, 262 aa, Fusarium oxysporum
  strain Fo5176
MKPTQALIALAAIVYAAPVVEQTKALAPPLAELDTHFEHHIKRCGKDEPTFLGRFPFANETYNQLTDGTPCRNVTMIYARGSRQAGNVGKANNTGPALFNSLADRIGLENLAVQGVTYKARRRDYIFKGGCNEGSKTMARLINQAASQCPDTKIVIAGYSQGAQLLHKAAKNVTAGVTQHIAAAVTLGYPEKPMGKIAASRSLSVCRPGDSFCDKTIPWKPFVPFVGAPLWWFLTMLDTHGDYNENATAVANWIADRVTNIG

SEQ ID NO: 24400 - protein, 834 aa, Fusarium oxysporum
  strain Fo5176
MLPPESGIDAWLRYAPLSETLRSLHKPVSSIIALSTNPTCPVSVAGEELRCGLERILGQIVQVDSDLRADTKGSIVVGTLSALKANGGEDLVQSVPVLDEDGFWLDTNVDGNNNIHIVGQNERGALYGAFEYLSLLAQGKLAKTNVQQAYHPGAAIRYVNEWDNLDGSIERGYGGKSIFFRDGEILTDLSRVRQYARLLASVRINGCIVNNVNSSHNLLNNTNLDGLGRVADVMRPYGIRIGVSLFFDTPRGLAGLPTSDPLDPDVIKFWEEITAKLYKRVPDMLGYTIKANSEGQPGPLTYGRTLAQGANMFARALKPHGDGVVMYRAFVYNHHLDESDLKNDRANAAVEYFAHLDGEFEDNVIIQIKFGPIDFQVREPPSTLFAHLRKTPMICEFMVCQEYLGQQSHYVYMAPEWETILGFDMRIDDKPSLVRDIASGKVYGMNKGGYAAVTNIGDDLTWLGHHLSMSNLYAYGRLCWDAAAPAQDILLDWIRLTFTAENQKVIDTIREIGMESWPTYEAYSGNLGIQTLCDILYTHYGPSPGSQDGNGWGQWTRADSKALGMDRTAATGTGYAAQYPPQVAAQFERIETTPDDLLLWFHHVPYTHKLKSGKTIIQHIYDAHYEGSANAQTFVTRWASLKGLIDDARFEHVAFKLAYQAGHSLVWRDSVNNFYLAKCGIPDEKNRVGNYLWRIEAESMQLSGYTVVDVTPPEAASLGRAIVASSLERAVATTKLRFPSGKRDIAVNYFDHTGGHARYELLLDGKMVREWKSDLDTRLGHDFSEYLDGHSATRVYLRGVDVREGAELTIIGYPDGKDMASLDYISVLPEGVVD

SEQ ID NO: 24401 - protein, 254 aa, Fusarium oxysporum
  strain Fo5176
MKFSIVFAGLFASATMASPQGNITPNTMGALERRASFPIPASKGSVTYKKVQTISGVFDGGMKTYGRGVKCTGQAEGGDADAVFLLKNGATLKNVIIGADQIEGVHCEGSCTIENVWWKKVCEDALSLKGDGNALIKGGGATGAADKVIQHNGLGTVTIDGFTVVDFGKLYRSCGNCKKMGTRNVVVKNVKAFNGKVLTGINSNKGDVSTITGTCASSVKEICVEYEGTVPGKEPKKLGSGPSKACKYSSVKSC

SEQ ID NO: 24402 - protein, 467 aa, Fusarium oxysporum
  strain Fo5176
MAYKLILAAFAATALAAPVEERQSCSNGVWAQCGGQNWSGTPCCTSGNKCVKLNDFYSQCQPGTAEPSSTAAGPSSTTATKTTATGGSSTTAGGSVTSAPPAASGNPYSGVDLWANSYYRSEVMNLAVPKLSGAKATAAAKVADVPSFQWMDTYDHISLMEDTLADIRKANKAGGNYAGQFVVYDLPNRDCAAAASNGEYSLDKDGANKYKAYIAKIKGILQDYSDTKVILVIANSIAEPDSLANLVTNLNVDKCAKAESAYKELTVYAIKELNLPNVSMYLDAGHGGWLGWPANIGPAAKLYAQIYKDAGKPSRVRGLVTNVANYNGWKLSTKPDYTESNPNYDEQRYINAFAPLLAQEGWSNVKFIVDQGRSGKQPTGQKAQGDWCNAKGTGFGLRPSTNTGDALADAFVWVKPGGESDGTSDTSAARYDYHCGLDDALKPAPEAGTWFQAYFEQLLDNANPSFL

SEQ ID NO: 24403 - protein, 842 aa, Fusarium oxysporum
  strain Fo5176
MWLSTLLFALFTCVIAEDGIDGWLRYARLPSSVSINAKSLPRKIHIIGGSKKSPLGSAASELQKGFSGILNIDLKTETNSKSCDFSQSIVVTTEENLKKSCKGKLSHHKLEADGYWLSTSGNSVTIIGQNERGALYGAFEYLSMLGQGNFKKVEYASNPSAPIRWANQWDNLNASSTHGSIERGYGGPSIFFDGVKNVRKDLSRVPLFGRLLASIGINAVVINNVNADVRLFNSENRKGLIEIADLLRPWGVQVGLSLNFASPQLLGGLDTFDPLDEKVIKWWHELTDGLYDGIPDMAGYLVKANSEGQPGPITYNRTLADGANMFAKALEPHGGVVMFRAFVYDKLDWNDWKADRANAAVEFFKELDGKFDDNVVVQIKYGPIDFQIREPVSPLFSHLRKTNSAIELQISQEYLGQQCHLVYLPPLWKTILDFDMRIDGKKSQVRDIVSGKVFKRRLGGYAGVTNVGLDKTWLGSHLSMSNLYAFGRLAWDPTADSQEILEDWTRLTFGLDDKVRKAIADMSMASWPAYENYSGNLGIQTLTDILYAHYGPNPASQDNNGWGQWTRATRDHIGMDRTVKNGTGNAGQYPSEVAKRFESTETTPDDLMLWFHHVPYTFKLHSGKTVIQHFYDAHYKGAATAQTFHKTWASLKGKIDDDRLDHDLFRLKYQAGHSIVWRDAINEFYRNLSGIPDKQNRVRNHPYRIEAEKMELDGYKPVNVTPTETASKYVAIYTNSTGTASTTLKSPKGTYNLAVNYYDIVGGKSTWSVYLNKRLIGKWVGDNEERLGHWPSEFLDGHSATRITFEGVKIQPGDKLVIIGKADGKETAALDYVSVLPQGIVD

SEQ ID NO: 24404 - protein, 477 aa, Fusarium oxysporum
  strain Fo5176
MRSLQIISVLGALFLTTVQAVTLPAGVPRDISEFRDKHPYAPPKHEHRRIVRIRASRNNADDVSDEFRRGVRKANGGGTLHLAKGKTYVIGKALDLTGLEDIHIHLEGEIRFTNDVEYWQENAWYHPFQKSIMFWKWGGKDIKIYGNGVIEGQGQRWWNEFESGTGSILNPDNKYYRPILFYAENTTNLDVSGIHLKDSPCWNNFIVSSNNVKYTDVVATALSNNGSIIPKNTDFMNTMNTSAVRIERTWVNIDDDCFSPKPNSSDLYVNTMYCNGTHGQSMGSLGQYKGEVSNVYDVHIENVWMMNGDYSAARIKVWAGEETGTGFVNNVTFKNFWVARMDYGIFLDSCYFNISAEECNAHPSGMQITNIHFENFTGYTSGVYGNAVARLSCSAAEDAICANITVKDFNVKTPCGGDPVIICDGMHGDIGVDCVPYDSDKAKAALNAKCKTPMAAIDTDPWGSGLIEKMKGAFHPQ

SEQ ID NO: 24405 - protein, 231 aa, Fusarium oxysporum
  strain Fo5176
MRAAFILSFLLASATALPTASIEKRAVAAQDVNLLETRDLLNRNDLENGDSSNCPTAILVYARGSTEPGNLGITVGPILVEAMQLAIPDIWIQGVGGPYTADLAPNFLPEGTTDASIDEAKRLFQMAYDKCPDTPVVTAGYSQGTVVVGYALSELDGAVQNQVVGAALFGYTKNEQLGGRIPNYPTDRTKVFCLPTDLVCDGTLFILPAHFLYGADAAVPGPEFLVGQIQK

SEQ ID NO: 24406 - protein, 231 aa, Fusarium oxysporum
  strain Fo5176
MHFPSTIALLTALPSVLACKGYTGGLPKHTGTKTLSAPQYIKKGQTFDAGWVKYDRGVKCTGQDEGGEKDTVFVLEDGAKLRNVIIGANQREGVYCLGSCTLEFVWFEDVCEDAISIKGGGTANIIGGGAYKASDKIIQHNGCGHVNIINFYANDYGKVYRSCGNCKGNCRRSVHMEGTTAVNGGELMGINTNLGDKATYSNNCYPKVQCQGYNGCDKGNGACEPTKAGLC

SEQ ID NO: 24407 - protein, 382 aa, Fusarium oxysporum
  strain Fo5176
MKSLFALSLFAGLSVAQNAAWAQCGGNGWTGSKTCVSGYKCTVVNEWYSQCIPGTAEEPTTTLKTTTGGGSTPTGTPGNGKFLWVGTNEAGGEFGEGSLPGTWGKHFIFPDPAAVDTLISQGYNAFRVQLRMERTNPSSMTGPFDTAYLKNLTTIVDHITGKGANVILDPHNYGRYFDKIITSTSDFQTWWKNFATQFKSNSKVIFDTNNEYNTMDQTLVLNLNQAAINGIRAAGATQTIFVEGNQWSGAWSWPDVNDNMKALTDPLDKIVYEMHQYLDSDSSGTSPNCVSTTIGVERVKAATEWLRKNKKIGMIGELAGGPNDTCKTAVKNMLDYLKENSDVWKGVTWWAAGPWWADYMFSFEPPSGTGYQYYNSLLKTYI

SEQ ID NO: 24408 - protein, 306 aa, Fusarium oxysporum
  strain Fo5176
MKASLLLSLLPVAQAAVIDTRQSKTGDGKQGDTDATQGDLSQRPPPRFPFPITKFPVAKETVVLKNAKYIMPGEVFDGKMKRYERPEGSCNEQAEGTDADAVFNLLPGSTIRNVIIGKNQAEGIHALGDAWVENVWWEDVCEDALTSKGLNTQLRVIGGGARSATDKIFQDNSLGGKYNITGFYAEGFGTFYQSCGNCLNQAKRNATIQNVIAVDGLRMGIINPNYGDEFRLKNAQIDNVTSIVDKEIGNNVQTVPYYIGNGPDEKYALYNETRDNITKFKGKVTNAYEPEDPYEWLEEFWPEGFN

SEQ ID NO: 24409 - protein, 250 aa, Fusarium oxysporum
  strain Fo5176
MMTFGTTLVIRIIWLFASCLNSFKKAGYLFLWHHLHDPYRTTNSHLTTMKNLLFPLTALLIGSSLAADVTITAPVSIPSNEPEYKEGKSFTSAVLNSTNFYREEHNATALKWNKTLEEFATDYLDDNDDCDFEHSGGPYGENLAIGYPNVTASVEAWGDEREEYNFDKAKFSKKTGHFTQLVWKDTTTVGCGRKLCGERGWFLVCEYWPRGNVEGQFKEEVSKEEGGAFSTRPGLGLALALFIGYMLVVV

SEQ ID NO: 24410 - protein, 297 aa, Fusarium oxysporum
  strain Fo5176
MLGLPSPRKLLAQLSLGASLVAAQLQTITNFGNTYGTQLTMQVYIPGNLPASPAVMLALHACGGNGPGYFQQTKYKSLADSRGVILIFPSSQKDFNCWDVASAKTLKHDGQGDSQVLVSMVDYVIKTYKADPKKVYVTGTSSGCMMTNVLAATYPDRFAAATCYSGVAAGCMAGSPGSSPISSDRVCSDGKIIKTGQQWADQVKSMYPGYSGSYPRFKTWHGTADNLVFYRNLLEQIKEWSTIQGVSFTRNETSTPQSGYTTMIYGDGTKFVAVSAAGVGHVVPTHEDLDFKWFGLT

SEQ ID NO: 24411 - protein, 298 aa, Fusarium oxysporum
  strain Fo5176
MKIATSLAAVVALLQSTSAHYIFQQLSVGSTKYPVFQYIRQNSNYNSPVTDLDSNDLRCNVGTSGTNTQTVGVKAGDSITFTLDTAVYHQGPISVYMSKAPSSASSYDGSGGWFKIKDWGPTFSGSTSTWPMYLSYTFNLPTCITNGAYLLRIQSLGIHNPWPAGIPQFYISCAQISVSGGGSTVPSNQVKIPGAFKETDPGYTANIYSNFNSYTIPGPAVFSCNGAGGGDGGGNGPTTTLQTSTRASSTQVPPVSTQPSGQCASLWGQCGGSTWTGPKCCATGTCKALNDFYSQCTT

SEQ ID NO: 24412 - protein, 548 aa, Fusarium oxysporum
  strain Fo5176
MRLQSIAAILAAAATASAQSVSGKAYGFAAGVTGGEGEAVTPSSAEELATLLADDTPRVIYLDKEFDFTGDVKTGAGCDRKSCSASNGGQLYLGDLSCGGDDNVAVSSITYDAAGPEPLPVGSNKSIIGNGKAVLKGKGLSIKKGSKNVIVQGIEFTNINPGVVWGGDALELKGLNDGVWIDHCKFSKVGRMFIVSHYDGSRLTISNSEFDGVTDTSASCNGNHYWTMMFYGEGDQVTLDRNHFHDVAGRAPKLGEPGTNGYFHATNNYFQNMKGHAFDAYQGANAIIEGNVFDGVDTPITKEAASVNTLFVADESDASACQSALGRACVPNSATSSGDIPSLKGESGLDAVAKNKDNIITPVSASEVTALVLGSVGPANVGSGSNSGSGSDSAPSQSPESGNDATETTPATPETTPESTPETAPETTPEAVNEQEALPDYPEETEAEPVANAEVKPVASDDCEEETDATPSKTEEKPVATGDCDDEIEAAADSSSSTGSSTAQMYGQCGGKNWTGATTCPSGSSCKKMNDYYSQCIGSNSRVRRYVQ

SEQ ID NO: 24413 - protein, 371 aa, Fusarium oxysporum
  strain Fo5176
MPSLKTSSLLAFAASAARVAAHGHVDWLVTNGVAFRGYSAPEMSWNPNHPPVVGWTNGATDNGYVEPNSFADPDIICHRAARPGKGHVTVAAGDKITLQWNTWPESHKGPVIDYLARCPGDCETVDKNDLEFFKIGQEGLIDMSMHSGKWAADVLVAAGFSWTLQIPEALAPGNYVLRHEIIALHGSGQPNGAQNYPQCFNLKVTGDGDLAPDGVKGTQLYKANDPGILFNLYTTPLSYKIPGPTLVPGLPPTVSQRVVAATATSSATVPGQTQASTSSKSPSSTSKGSSTSTSTAVGDTTLKTSTTSRSSSSSTTKDTPQPTEDDDIICGPATGGLPKYSQCGGKDYTGPTVCQWGSSCKVLNPYYSQCL

SEQ ID NO: 24414 - protein, 215 aa, Fusarium oxysporum
  strain Fo5176
SSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24415 - protein, 632 aa, Fusarium oxysporum
  strain Fo5176
MRFSDSLLLIGLSSLAGAHPSRRAPNPSPLSKRGLDLEAFKLPPMAEYVPQDEVPDDVSAKVVTKRADYTETAKDLVKSTFPKATFRMVTDHYVGSNGIAHVNFKQTVNGIDIDNADFNVNIGADGEVFSYGNSFYEGKIPGPLTKRDEKDPVDALKDTVDVLSLPVEAEKAKAEKKSKNHYTFTGTKGTVSKPEAKLTYLVDENKELKLTWRVETDIVDNWLLTYVNAAKTDEVVGVVDYVNEATYKVYPWGVNDPSKGSRSTVENPWNLEASEFTWLSDGSNNYTTTRGNNGIAQVNPSGGSTYLNNYRPDSPSLKFEYDYSTSTTTPTTYRDASIAQLFYTANKYHDLLYLLGFTEQAGNFQTNNNGQGGVGNDMVILNAQDGSGTNNANFATPADGQPGRMRMYLWTYSTPQRDCSFDAGVVIHEYTHGLSNRLTGGPANSGCLPGGEPGGMGEGWGDFMATAIHIQSKDTRASNKVMGDWVYNNAAGIRAYPYSTSLTTNPYTYKSVNSLSGVHAIGTYWATVLYEVMWNLIDKHGKNDADEPKFNNGVPTDGKYLAMKLVVDGMSLQPCNPNMVQARDAIIDADTALTKGANKCEIWKGFAKRGLGTGAKYSASSRTESFALPSGC

SEQ ID NO: 24416 - protein, 230 aa, Fusarium oxysporum
  strain Fo5176
MKFSIISTLLAATASALPAGQDAAALEARQLGGSITRNDLANGNSGSCPGVIFIYARGSTESGNLGTLGPRVASKLEAKYGKNGVWIQGVGGAYRATLGDNALPRGTSSAAIREMLGHFSDANQKCPDAVLIAGGYSQGAALAAASVTDVDAGIREKIAGVVLFGYTKNLQNRGKIPSYPEDRTKVFCNTGDLVCTGSLIVAAPHLAYQSAASGAAPEFLIQKADAAGAA

SEQ ID NO: 24417 - protein, 384 aa, Fusarium oxysporum
  strain Fo5176
MRSYTLLALAGPLAVSAASGSGHSTRYWDCCKPSCSWSGKAAVNAPALTCDNKDNPISNTNAVSGCEGGGSAYACTNYSPWAVNDDLAYGFAATKISGGSESSWCCACYAMTFTSGPVKGKTMIVQSTNTGGDLGDNHFDLMMPGGGVGIFDGCTSQFGNALGGAQYGGISSRSECDSFPELLKDGCHWRFDWFKNTDNPDFTFEQVQCPKALLDISGCKRDDDSSFPAFKGDTSASKPQPSSPAKKTTSVAAAAQPQKTKDSVPAVQEPSTKDAEKPEPTKPAEKPSAIEVEKPQADKPAATKPTATKPAQPDDKPKTTQKVRGTKTRGSCPANTDTTAKASVVPVYYQCGGSKSAYPNGNLPCASGSKCVKQNEYYSQCVPN

SEQ ID NO: 24418 - protein, 381 aa, Fusarium oxysporum
  strain Fo5176
MRFSPLLFGSFIASAFAGHSHSSSKSHHPRSLPESDSSSDSHPAPGGCNFTTADTAMKHKSSCSTIVLNNVKVPAGKTLDLTKLKDGTTVIFKGVMTFGYAEWLGPLITISGNGLTIKGDAGHCINGQGRRYWDGKGSNGGKKKPKLLALHNVHDSIVQNLNIKDTPVQAVSINTVTNLLVKDVHIDSSLGDKLGGHNTDGFNVGKVDGLVIDGAVVGNQDDCVAINSGKNITFTNGHCSGGHGASIGSVGNKSSNIVENVLISKTMIENSENAIRIKTIAGATGSVTDVTYEDITLRDIDKYGMVFRQDYLNGGPTQQPTKGIPMTGIRIKNVTGTVKPAGKNIFILCANCKDWTFTNIDISGGQSKEKCVGVPAGAFCT

SEQ ID NO: 24419 - protein, 367 aa, Fusarium oxysporum
  strain Fo5176
MQYRVIMAATLAIGAYAAPAPLITGAPSLSRRQDSESGSGGSGGSSVLDAPMTIAAGESFDGGNAIFDRGVSCTGQVEGGDSDAVFILEKGATLSNVRIGPNQIEGVHCNGGCTLNNVVWDAVCEDAFSIKKQEDGETTTINGGGATGAEDKVIQHNGGGTVIIKDFEVSDFGKLYRSCGNCKEMPARHVEISGGSASNGKILVGINPNMGDTAKISGIQLTNVPKECITFEGVTDGSEPKEVGTCDSNAGSGSGSGSGDSTEAPATPTTPADGSETPAASEVADPVETSADGSQGDDQSGDDQSGDNDDGDNDESDDDKKDDDSDDENKDEQSDNENQDQESESDNQQAQPSQPNFSFGSGGFGGF

SEQ ID NO: 24420 - protein, 378 aa, Fusarium oxysporum
  strain Fo5176
MTKLGFALLAALAGSAIAVPAPAVTQAPDVHAYAKRATSCTFSGSDGASKASKSQAACATIVLNNVAVPSGETLDLSKLKDNTKVIFKGTTTWGYKEWKGPLMKISGNKITVEGSGAVLNAGGERWWDGNGGNSGKDKPKFFAAHKLTDSKINNLYVKNTPVQAVSINGVNGLTINQFTLDNKDGDTKGGHNTDAFDIGSSTGVTITGAKVYNQDDCVAVNSGKNIIFQNGYCHGGHGLSIGSVGGRDDNIVDNVQFLNSEVTNSANGIRVKTMKNTTGKVNKVTYSDITLSKITKYGILIEQNYDGGDLHGEPTSGLPITGLTLKNIKGKNGVSSSGKNAAIVCGSSGCKDWTWQNVQVTGGRKYDSCENVPSVASC

SEQ ID NO: 24421 - protein, 484 aa, Fusarium oxysporum
  strain Fo5176
MFKIFLKTVAAANLIGLAAADPIPIVPDRVRLGPRASACTPQAGRSSSVDDVPAIQAAIKACPSGTIVIPSDQTYHINSQLSFAGCSGCTFELNGELLASTDFGYWNGRGEIIYLQNIRGATITGSGTINGNGQASWDYIITNTSYKRPYLIRVDGSTNIKMSEITIKNAPSFHVVTSGNSKDVVYSGLTLYSVSSSSNIAHNTDGFDIGPASYVTVENTKITNDDDCVVLKPGASYVTTTGVTCVGSHGLSIGSLSGGAGSNDIVTNSIFKDCTMIGSTKAAGIKYYPGGSTHGTGSISNVTWQDITCDTCDYAIQISTCYMSTPAACSANPSTGKISGVVFSGFSGTTSGHYKDVVANMDCSVGGTCGIKIEDFTVTAPSGESEVLCAHTPNNLGVFPNSTRPSPVMSRNPEQKTRPVANVVSLMISMIIVGDDLMVVSDPASEAVEKRLAVGSGEQAHISPGMTSVGNRRSIMGSWTGPPI

SEQ ID NO: 24422 - protein, 457 aa, Fusarium oxysporum
  strain Fo5176
MIQSAIFGAVAGLACIANVVAHKWLPVPRPEIKSWPYSPGGAFPVSPHRVKSCYVKASNNGGDDAGSILHAFHTCNNGGTVVLAANYTIASPLDLTFLKHVDVAITGTINFAPDLSYWTEHSFKYAYQDATAFWRFGGEDVNIFGLGVGLINGNGQPWYDAAATNTSLLRPVLFLVDGLQGGSVTGLRMINPPSWFNLIANSTDIIVDDLNLQAVSKNSNLAKNTDGWDIYRSDSVVLQNSIINNGDDCVSLKPNSTNIVVQGLHCNGSHGISVGSLGQYAEEFDIVENVYIYNISMSNASDGARIKVWPGQYTTFQDNLNGGGGSGYVKNVTYDGLFNTNNDWAIELTQCYGQNNLTLCNEFPSNMVISDIVFKNMWGTTSKRYDPKVGTLVCSDASKCSNIQAQNISVSPPSGKIATWFAVLSNSLSFDDLRCWLHRWKDRPLYSADTTPDSRLV

SEQ ID NO: 24423 - protein, 404 aa, Fusarium oxysporum f. cubense
MVRNIAIAALLPAAFASTLPRDPCSVTDYSGLATAVSSCTNIVLNGFQVPTGKALDLSKLKDGATVTFKGKTTFATTADNDFDPIVISGNGITITGASGHVIDGNGPAYWDGEGSNNKKNPKPDHFIVVKKTTGNSKITNLNIQNWPVHCFDITGSSQLTISGLILDNRLGDKPNAKSGSLPAAHNSDGFDIPSSDHVTLDNIHVYNQDDCVAVTSGTNIIVSNMYCSGGHGLSIGSVGGKSNNVVNGVQFLDSQIVNSENGCRIKSNSGTTGTIENATYQNIALTNISKYGVDVQQDYLNGGPTGKPTNGVKISGIKFIKVTGTVASSAQDWYILCGDGSCSGFTFSGNAITGGGKTSSCNYPTNTCPSKVKAGRSPLHVHKARTQSKSGLTVVAWNCCGGQL

SEQ ID NO: 24424 - protein, 240 aa, Fusarium oxysporum f. cubense
MKYTAILALAGVSSAAVTKTLPKSAGATSFPTAVPVKGSYDGGMKRFERSPSVCQGQTETGEKDAMFILENGATLSNVIIGASQAEGVHCKGTCTLNNVWWADVCEDAITLKQTSGTSYINGGGAFHASDKIVQFNGRGTVQIKDFYAEDYGKLVRSCGNCKDNGGPRNVVISGSVAVDGGVLCGINTNYGDACKITSSCQDKGKYCDRYEGNSSGAEPSKIGSGPDGKYCTTSGVTTSC

SEQ ID NO: 24425 - protein, 240 aa, Fusarium oxysporum f. cubense
MKYTAILALAGVSSAAVTKTLPKSAGATSFPTAVPVKGSYDGGMKRFERSPSVCQGQTETGEKDAMFILENGATLSNVIIGASQAEGVHCKGTCTLNNVWWADVCEDAVTLKQTSGTSYINGGGAFHASDKIVQFNGRGTVQIKDFYAEDYGKLVRSCGNCKDNGGPRNVVISGSVAVDGGVLCGINTNYGDACKITSSCQNKGKYCDRYEGNSSGAEPSKIGSGPDGKYCTTSGVTTSC

SEQ ID NO: 24426 - protein, 455 aa, Fusarium oxysporum f. sp. colocasiae
MLFNNVLSAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLDLEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTSARDTTNG

SEQ ID NO: 24427 - protein, 360 aa, Fusarium oxysporum f. sp. colocasiae
MFSSTVLLSGLVASVLAAPALEPRAGSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSTGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 24428 - protein, 370 aa, Fusarium oxysporum f. sp. colocasiae
MVRNIAIAALLPAAFASTLPRDPCSVTDYSGLATAVSSCTNIVLNGFQVPTGKALDLSKLKDGATVTFKGKTTFATTADNDFDPIVISGNGITITGATGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLNIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24429 - protein, 371 aa, Fusarium oxysporum f. sp. colocasiae
MVRNIAIAALLPAAFASTLPKRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24430 - protein, 455 aa, Fusarium oxysporum f. sp. conglutinans
MLFNNVISAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLDLEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTNARDTTNG

SEQ ID NO: 24431 - protein, 455 aa, Fusarium oxysporum f. sp. conglutinans
MLFNNVISAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLDLEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTSARDTTNG

SEQ ID NO: 24432 - protein, 370 aa, Fusarium oxysporum f. sp. conglutinans
MVRNIAIAALLPAAFASTLPRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24433 - protein, 371 aa, Fusarium oxysporum f. sp. conglutinans; identical to SEQ ID NO: 24429

SEQ ID NO: 24434 - protein, 455 aa, Fusarium oxysporum f. sp. cucumerinum
MLFNNVLSAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLDLEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTNARDTTNG

SEQ ID NO: 24435 - protein, 360 aa, Fusarium oxysporum f. sp. cucumerinum
MFSSTVLLSGLVASVLAAPALEPRAGSCIFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSTGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 24436 - protein, 360 aa, Fusarium oxysporum f. sp. cucumerinum
MFSSTVLLSGLVASVLAAPALEPRAGSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVFNTPVQAFSINSVTNLGVYGVHMDNSLGDSLGGHNTDAFDVGSSTGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 24437 - protein, 371 aa, Fusarium oxysporum f. sp. cucumerinum; identical to SEQ ID NO: 24429

SEQ ID NO: 24438 - protein, 370 aa, Fusarium oxysporum f. sp. cucumerinum
MVRNIAIAALLPAAFASTLPRDPCSVTDYSGLATAVSSCTNIVLNGFQVPTGKALDLSKLKDGATVTFKGKTTFATTADNDFDPIVISGNGITITGATGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24439 - protein, 455 aa, Fusarium oxysporum f. sp. dianthi; identical to SEQ ID NO: 24426

SEQ ID NO: 24440 - protein, 360 aa, Fusarium oxysporum f. sp. dianthi
MFSSTVLLSGLVASVLAAPALEPRASSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSTGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 24441 - protein, 370 aa, Fusarium oxysporum f. sp. dianthi
MVRNIAIAALLPAAFASTLPRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNNHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24442 - protein, 371 aa, Fusarium oxysporum f. sp. dianthi
MVRNIAIAALLPAAFASTLPKRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNNHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24443 - protein, 455 aa, Fusarium oxysporum f. sp. fragariae; identical to SEQ ID NO: 24426

SEQ ID NO: 24444 - protein, 455 aa, Fusarium oxysporum f. sp. fragariae; identical to SEQ ID NO: 24434

SEQ ID NO: 24445 - protein, 455 aa, Fusarium oxysporum f. sp. fragariae
MLFNNVISAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLDLEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTIARDTTNG

SEQ ID NO: 24446 - protein, 360 aa, Fusarium oxysporum f. sp. fragariae; identical to SEQ ID NO: 24427

SEQ ID NO: 24447 - protein, 360 aa, Fusarium oxysporum f. sp. fragariae; identical to SEQ ID NO: 24435

SEQ ID NO: 24448 - protein, 371 aa, Fusarium oxysporum f. sp. fragariae; identical to SEQ ID NO: 24429

SEQ ID NO: 24449 - protein, 371 aa, Fusarium oxysporum f. sp. fragariae
MVRNIAIAALLPAAFASTLPKRDPCSVTDYSGLATAVSSCTNIVLNGFQVPTGKALDLSKLKDGATVTFKGKTTFATTADNDFDPIVISGNGITITGASGHVIDGNGPAYWDGEGTNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24450 - protein, 85 aa, Fusarium oxysporum f. sp. lactucae
PTAVPVKGSYDGGMKRFERSPSVCQGQSETGEKDAMFILENGATLSNVIIGASQAEGVHCKGTCTLNNVWWADVCEDAVTLKQTS

SEQ ID NO: 24451 - protein, 455 aa, Fusarium oxysporum f. sp. lactucae; identical to SEQ ID NO: 24434

SEQ ID NO: 24452 - protein, 360 aa, Fusarium oxysporum f. sp. lactucae; identical to SEQ ID NO: 24427

SEQ ID NO: 24453 - protein, 370 aa, Fusarium oxysporum f. sp. lactucae
MVRNIAIAALLPAAFASTLPRDPCSVTDYSGLATAVSSCTNIVLNGFQVPTGKALDLSKLKDGATVTFKGKTTFATTADNDFDPIVISGNGITITGATGHVIDGNGPAYWDGEGSNNKDNPKPDHFIVVKKTTGNSKITNLNIQNWAVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24454 - protein, 371 aa, Fusarium oxysporum f. sp. lactucae; identical to SEQ ID NO: 24429

SEQ ID NO: 24455 - protein, 455 aa, Fusarium oxysporum f. sp. lagenariae; identical to SEQ ID NO: 24434

SEQ ID NO: 24456 - protein, 455 aa, Fusarium oxysporum f. sp. lagenariae; identical to SEQ ID NO: 24426

SEQ ID NO: 24457 - protein, 360 aa, Fusarium oxysporum f. sp. lagenariae; identical to SEQ ID NO: 24427

SEQ ID NO: 24458 - protein, 370 aa, Fusarium oxysporum f. sp. lagenariae; identical to SEQ ID NO: 24438

SEQ ID NO: 24459 - protein, 371 aa, Fusarium oxysporum f. sp. lagenariae; identical to SEQ ID NO: 24449

SEQ ID NO: 24460 - protein, 370 aa, Fusarium oxysporum f. sp. lycopersici; identical to SEQ ID NO: 24432

SEQ ID NO: 24461 - protein, 384 aa, Fusarium oxysporum f. sp. lycopersici
MHTFSVLLALAPVSALAQAPIWGQCGGNGWTGATTCASGLKCEKINDWYYQCVPGSGGSEPQPSSTQGGGTPQPTGGNSGGTGLDAKFKAKGKQYFGTEIDHYHLNNNPLINIVKAQFGQVTCENSMKWDAIEPSRNSFTFSNADKVVDFATQNGKLIRGHTLLWHSQLPQWVQNINDRSTLTAVIENHVKTMVTRYKGKILQWDVVNEIFAEDGNLRDSVFSRVLGEDFVGIAFRAARAADPAAKLYINDYNLDKSDYAKLTRGMVAHVNKWIAAGIPIDGIGSQGHLAAPSGWNPASGVPAALRALAASDAKEIAITELDISGASANDYLTVMNACLAVPKCVGITVWGVSDKDSWRPGENPLLYDSNYQPKAAFNALVNAL

SEQ ID NO: 24462 - protein, 361 aa, Fusarium oxysporum f. sp. lycopersici
MFSSTVLLSGLVASVLAAPALEPRAGSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSTGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPMTDVTINKVTGTVSSPAGTEVYILCANCKNWTWNNNKVTGGKTSTKCKGIPSGASC

SEQ ID NO: 24463 - protein, 454 aa, Fusarium oxysporum f. sp. lycopersici
MLFNNVLSAVAVSVLVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNRPIGSTLSSTARTCLISDLELEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGTLSASTRRCSTSWLRILKSRFQGKKPPVYDCQNIDTSTLDITCRDPTNARDTTNG

SEQ ID NO: 24464 - protein, 240 aa, Fusarium oxysporum f. sp. lycopersici
MKYTAILALAGVSSAAVTKTLPKSAGATSFPTAVPVKGSYDGGMKRFERSPSVCQGQSETGEKDAMFILENGATLSNVIIGASQAEGVHCKGTCTLNNVWWADVCEDAVTLKQTSGTSYINGGGAFHASDKIVQFNGRGTVQIKDFYAEDYGKLVRSCGNCKDNGGPRNVVISGSVAVDGGVLCGINTNYGDTCKITSSCQNKGKYCDRYEGNSSGAEPSKIGSGPDGKYCTTSGVTTSC

SEQ ID NO: 24465 - protein, 455 aa, Fusarium oxysporum f. sp. lycopersici; identical to SEQ ID NO: 24431

SEQ ID NO: 24466 - protein, 455 aa, Fusarium oxysporum f. sp. lycopersici
MLFNNVLSAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLNLQAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTNARDTTNG

SEQ ID NO: 24467 - protein, 455 aa, Fusarium oxysporum f. sp. lycopersici
MLFNNVLSAVAVSVLVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLELEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTNARDTTNG

SEQ ID NO: 24468 - protein, 360 aa, Fusarium oxysporum f. sp. lycopersici
MFSSTVLLSGLVASVLAAPALEPRAGSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 24469 - protein, 360 aa, Fusarium oxysporum f. sp. lycopersici; identical to SEQ ID NO: 24427

SEQ ID NO: 24470 - protein, 371 aa, Fusarium oxysporum f. sp. lycopersici; identical to SEQ ID NO: 24429

SEQ ID NO: 24471 - protein, 274 aa, Fusarium oxysporum f. sp. lycopersici
ISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVTSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSS

SEQ ID NO: 24472 - protein, 274 aa, Fusarium oxysporum f. sp. lycopersici
ISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSS

SEQ ID NO: 24473 - protein, 274 aa, Fusarium oxysporum f. sp. lycopersici
ISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTSSGNAITGGGKTSQ

SEQ ID NO: 24474 - protein, 327 aa, Fusarium oxysporum f. sp. lycopersici
  strain 4287 / CBS 123668 / FGSC 9935 / NRRL 34936
AASGLEAAMKAAGKQYFGTALTVRNDQGEIDIINNKNEIGSITPENAMKWEAIQPNRGQFNWGPADQHAAAATSRGYELRCHTLVWHSQLPSWVANGNWNNQTLQAVMRDHINAVMGRYRGKCTHWDVVNEALNEDGTYRDSVFLRVIGEAYIPIAFRMALAADPTTKLYYNDYNLEYGNAKTEGAKRIARLVKSYGLRIDGIGLQAHMTSESTPTQNTPTPSRAKLASVLQGLADLGVDVAYTELDIRMNTPATQQKLQTNADAYARIVGSCMDVKRCVGITVWGISDKYSWVPGTFPGEGSALLWNDNFQKKPSYTSTLNTINRR

SEQ ID NO: 24475 - protein, 455 aa, Fusarium oxysporum f. sp. melongenae; identical to SEQ ID NO: 24434

SEQ ID NO: 24476 - protein, 360 aa, Fusarium oxysporum f. sp. melongenae; identical to SEQ ID NO: 24427

SEQ ID NO: 24477 - protein, 370 aa, Fusarium oxysporum f. sp. melongenae; identical to SEQ ID NO: 24438

SEQ ID NO: 24478 - protein, 455 aa, Fusarium oxysporum f. sp. melonis
MLFNNVLSAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVVITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLNLQAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTNARDTTNG

SEQ ID NO: 24479 - protein, 455 aa, Fusarium oxysporum f. sp. melonis; identical to SEQ ID NO: 24434

SEQ ID NO: 24480 - protein, 360 aa, Fusarium oxysporum f. sp. melonis
MFSSTVLLSGLVASVLAAPALEPRAGSCTFTDAATAIKNKAGCSTITLNNIVVPAKTTLDLTKLNDGTHVIFQGKTTFDYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 24481 - protein, 360 aa, Fusarium oxysporum f. sp. melonis; identical to SEQ ID NO: 24427

SEQ ID NO: 24482 - protein, 370 aa, Fusarium oxysporum f. sp. melonis; identical to SEQ ID NO: 24432

SEQ ID NO: 24483 - protein, 371 aa, Fusarium oxysporum f. sp. melonis; identical to SEQ ID NO: 24429

SEQ ID NO: 24484 - protein, 455 aa, Fusarium oxysporum f. sp. niveum; identical to SEQ ID NO: 24434

SEQ ID NO: 24485 - protein, 360 aa, Fusarium oxysporum f. sp. niveum; identical to SEQ ID NO: 24427

SEQ ID NO: 24486 - protein, 371 aa, Fusarium oxysporum f. sp. niveum; identical to SEQ ID NO: 24429

SEQ ID NO: 24487 - protein, 371 aa, Fusarium oxysporum f. sp. niveum; identical to SEQ ID NO: 24449

SEQ ID NO: 24488 - protein, 455 aa, Fusarium oxysporum f. sp. phaseoli; identical to SEQ ID NO: 24430

SEQ ID NO: 24489 - protein, 455 aa, Fusarium oxysporum f. sp. phaseoli; identical to SEQ ID NO: 24426

SEQ ID NO: 24490 - protein, 360 aa, Fusarium oxysporum f. sp. phaseoli; identical to SEQ ID NO: 24427

SEQ ID NO: 24491 - protein, 370 aa, Fusarium oxysporum f. sp. phaseoli; identical to SEQ ID NO: 24438

SEQ ID NO: 24492 - protein, 371 aa, Fusarium oxysporum f. sp. phaseoli; identical to SEQ ID NO: 24429

SEQ ID NO: 24493 - protein, 370 aa, Fusarium oxysporum f. sp. radicis-lycopersici; identical to SEQ ID NO: 24432

SEQ ID NO: 24494 - protein, 455 aa, Fusarium oxysporum f. sp. radicis-lycopersici
MLFNNVISAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGRDIHIYGDLTKGESLLDGHGQAYWEEMAVNKTLLRPILLTIEDAHGLTMSNLRMRNPPNWFNIIINSTDVLISDLDLEAKSLNGVKIANSDGWDTYRSDRIVIQNSVIDNTDDCVSFKPNSTIVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTSARDTTNG

SEQ ID NO: 24495 - protein, 360 aa, Fusarium oxysporum f. sp. radicis-lycopersici
MFSSTVLLSGLVASVLAAPALEPRAGSCTFTDAATAIKNKAGCSTITLNNIVVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 24496 - protein, 455 aa, Fusarium oxysporum f. sp. radicis-lycopersici
MLFNNVLSAVAVSVLVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLELEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQILLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTNARDTTNG

SEQ ID NO: 24497 - protein, 455 aa, Fusarium oxysporum f. sp. radicis-lycopersici
MLFNNVLSAVAVSVLVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLELEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGFLVCSAPDRCSNIVAEDIKVQVPSKKPPVYDCQNIDTSTLDITCRDPTNARDTTNG

SEQ ID NO: 24498 - protein, 455 aa, Fusarium oxysporum f. sp. radicis-lycopersici
MLFNNVISAVAVSALVSSVVGTSSRNSALPTRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLDLEAKSLNGVKIPNSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTSARDATNG

SEQ ID NO: 24499 - protein, 360 aa, Fusarium oxysporum f. sp. radicis-lycopersici
MFSSTVLLSGLVASVLAAPALEPRAGSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSDGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 24500 - protein, 360 aa, Fusarium oxysporum f. sp. radicis-lycopersici
MFSSTVLLSGLVASVLAAPALEPRAGSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKATGTVKSSGTDVYILCAHCKNWTWTNNKVTGGKTSTKCKGIPSGASC

SEQ ID NO: 24501 - protein, 360 aa, Fusarium oxysporum f. sp. radicis-lycopersici
MFSSTVLLSGLVASVLAAPALEPRAGSWTFTDAATAIKKKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 24502 - protein, 371 aa, Fusarium oxysporum f. sp. radicis-lycopersici
MVRNIAIAALLPAAFASTLPKRDPCSVTDYSGLATAVSSCTNIVLNGFQVPTGKALDLSKLKDGATVTFKGKTTFPTTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24503 - protein, 371 aa, Fusarium oxysporum f. sp. radicis-lycopersici
MVRNIAIAALLPAAFASTLPKRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPANTCPS

SEQ ID NO: 24504 - protein, 371 aa, Fusarium oxysporum f. sp. radicis-lycopersici; identical to SEQ ID NO: 24429

SEQ ID NO: 24505 - protein, 371 aa, Fusarium oxysporum f. sp. radicis-lycopersici
MVRNIAIAALLPAAFASTLPKRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWAVHWFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNIPLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24506 - protein, 371 aa, Fusarium oxysporum f. sp. radicis-lycopersici
MVRNIAIAALLPAAFASTLPKRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLSDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNICKYGVDVQQDYLNGGPTGKPTNGVKISGIKFIKVTGTVASSAQDWYILCGDGSCSGFTFSGNAITGGGKTSSCNYPTNTCPS

SEQ ID NO: 24507 - protein, 360 aa, Fusarium oxysporum f. sp. radicis-lycopersici; identical to SEQ ID NO: 24468

SEQ ID NO: 24508 - protein, 455 aa, Fusarium oxysporum f. sp. radicis-lycopersici; identical to SEQ ID NO: 24467

SEQ ID NO: 24509 - protein, 455 aa, Fusarium oxysporum f. sp. raphani; identical to SEQ ID NO: 24434

SEQ ID NO: 24510 - protein, 455 aa, Fusarium oxysporum f. sp. raphani; identical to SEQ ID NO: 24426

SEQ ID NO: 24511 - protein, 360 aa, Fusarium oxysporum f. sp. raphani; identical to SEQ ID NO: 24427

SEQ ID NO: 24512 - protein, 371 aa, Fusarium oxysporum f. sp. raphani; identical to SEQ ID NO: 24429

SEQ ID NO: 24513 - protein, 449 aa, Fusarium oxysporum f. sp. spinaciae
MLFNNVLSAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLDLEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTNG

SEQ ID NO: 24514 - protein, 360 aa, Fusarium oxysporum f. sp. spinaciae; identical to SEQ ID NO: 24435

SEQ ID NO: 24515 - protein, 370 aa, Fusarium oxysporum f. sp. spinaciae; identical to SEQ ID NO: 24428

SEQ ID NO: 24516 - protein, 371 aa, Fusarium oxysporum f. sp. spinaciae; identical to SEQ ID NO: 24429

SEQ ID NO: 24517 - protein, 455 aa, Fusarium oxysporum f. sp. tracheiphilum; identical to SEQ ID NO: 24431

SEQ ID NO: 24518 - protein, 455 aa, Fusarium oxysporum f. sp. tracheiphilum; identical to SEQ ID NO: 24426

SEQ ID NO: 24519 - protein, 360 aa, Fusarium oxysporum f. sp. tracheiphilum; identical to SEQ ID NO: 24427

SEQ ID NO: 24520 - protein, 370 aa, Fusarium oxysporum f. sp. tracheiphilum; identical to SEQ ID NO: 24432

SEQ ID NO: 24521 - protein, 371 aa, Fusarium oxysporum f. sp. tracheiphilum; identical to SEQ ID NO: 24429

SEQ ID NO: 24522 - protein, 455 aa, Fusarium oxysporum f. sp. tulipae; identical to SEQ ID NO: 24478

SEQ ID NO: 24523 - protein, 360 aa, Fusarium oxysporum f. sp. tulipae; identical to SEQ ID NO: 24480

SEQ ID NO: 24524 - protein, 370 aa, Fusarium oxysporum f. sp. tulipae
MVRNIAIAALLPAAFASTLPRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLNIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 24525 - protein, 371 aa, Fusarium oxysporum f. sp. tulipae; identical to SEQ ID NO: 24429

SEQ ID NO: 24526 - protein, 98 aa, Fusarium poae
MKFSLAAVTLLGAVVSALPANEKRQAYVPCTGLYGSSQCCATDVLGVANLDCGTPPSVPANATDFSAVCAEIGQRARCCVLPILDQGILCNTPTGVQD

SEQ ID NO: 24527 - protein, 511 aa, Fusarium poae
MYRAIATASALIAAVRAQQVCSLTTETKPALTWSKCTSSGCSNVQGSVTIDANWRWTHQVSGSTNCHTGNKWDTSVCTSGKVCAEKCCVDGADYASTYGITSSGNQLSLSFVTKGSYGTNIGSRTYLMEDENTYQMFQLLGNEFTFDVDVSNIGCGLNGALYFVSMDADGGKAKYPGNKAGAKYGTGYCDAQCPRDVKFINGQANSDGWEPSKSDVNGGIGNLGTCCPEMDIWEANSISTAYTPHPCTKLTQHACTGDSCGGTYSNDRYGGTCDADGCDFNAYRQGNKTFYGPGSGFNVDTTKKVTVVTQFHKGSNGRLSEITRLYVQNGKVIANSESKIAGNPGSSLTSDFCTTQKKVFGDIDDFAKKGAWNGMSDALEAPMVLVMSLWHDHHSNMLWLDSTYPTDSTALGSQRGSCSTSSGVPADLEKNVPNSKVAFSNIKFGPIGSTYNKEGTQPQPTNPTNPNPTNPTNPGTVDQWGQCGGTNYSGPTACKSPFTCKKINDFYSQCQ

SEQ ID NO: 24528 - protein, 374 aa, Fusarium sacchari
MVRNIAIAALLPAAWALPSTQLKERDACTVTDYSGLATAVSSCTNIVLAGFQVPTGKQLDLSKLKAGTTVTFKGKTTFATTADNDFDPIVISGSGITITGASGHVIDGNGQAYWDGQGSNNQDNPKPDHFIVVKKTTGNSKITNLNIQNWPVHCFDITGSSDLTISGLILDNRAGDKPNSKSGGLPAAHNSDGFDISSSDHVTLDNNHVYNQDDCVAVTSGTNIVVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTCPS

SEQ ID NO: 24529 - protein, 374 aa, Fusarium sacchari
MVRNIALAALLPAAWALPSTQLKERDACTVTDYSGLATAVSSCTNIVLAGFQVPTGKQLDLSKLKAGTTVTFKGKTTFATTADNDFDPIVISGSGITITGASGHVIDGNGQAYWDGQGSNNQDNPKPDHFIVVKKTTGNSKITNLNIQNWPVHCFDITGSSDLTISGLILDNRAGDKPNSKSGGLPAAHNSDGFDISSSDHVTLDNNHVYNQDDCVAVTSGTNIVVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTCPS

SEQ ID NO: 24530 - protein, 230 aa, Fusarium solani
  subsp. cucurbitae
MKFFALTTFLAATASALPTSNPAQELEARQLGRTTRDDLINGNSASCADVIFIYARGSTETGNLGTLGPSIASNLESAFGTDGVWIQGVGGAYRATLGDNALPRGTSSAAIREMLGLFQQANTKCPDATLIAGGYSQGAALAAASIEDLDSAIRDKIAGTVLFGYTKNLQNRGRIPNYPADRTKVFCNVGDLVCTGSLIVAAPHLAYGPDARGPAPEFLIEKVRAVRGSA

SEQ ID NO: 24531 - protein, 230 aa, Fusarium solani
  subsp. pisi
MKFFALTTLLAATASALPTSNPAQELEARQLGRTTRDDLINGNSASCRDVIFIYARGSTETGNLGTLGPSIASNLESAFGKDGVWIQGVGGAYRATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSA

SEQ ID NO: 24532 - protein, 242 aa, Fusarium solani
  subsp. pisi
MKFTAAFVAALVGTSSAAVTKTLPKSAGATSFPTAVPVKGSYDGGMKRFEREPKVCKGQDETGEKDAMFILENGATLSNVIIGASQAEGVHCKGTCTLNNVWWADVCEDAVTLKQTSGTSYINGGGAFHASDKIIQFNGRGTVHVKDFYAEDYGKLSRSCGNCKDNGGPRNVIVENSVAVDGGVLCGINTNYGDTCKVINSCQDKGKYCDRYEGNSSGKEPTKIGSGPDGKYCTVTGSTTSC

SEQ ID NO: 24533 - protein, 508 aa, Fusarium solani
  subsp. pisi
MYRAIATASALLATARAQQVCTLNTENKPALTWAKCTSSGCSNVRGSVVVDANWRWAHSTSSSTNCYTGNTWDKTLCPDGKTCADKCCLDGADYSGTYGVTSSGNQLNLKFVTVGPYSTNVGSRLYLMEDENNYQMFDLLGNEFTFDVDVNNIGCGLNGALYFVSMDKDGGKSRFSTNKAGAKYGTGYCDAQCPRDVKFINGVANSDEWKPSDSDKNAGVGKYGTCCPEMDIWEANKISTAYTPHPCKSLTQQSCEGDACGGTYSATRYAGTCDPDGCDFNPYRQGNKTFYGPGSGFNVDTTKKVTVVTQFIKGSDGKLSEIKRLYVQNGKVIGNPQSEIANNPGSSVTDSFCKAQKVAFNDPDDFNKKGGWSGMSDALAKPMVLVMSLWHDHYANMLWLDSTYPKGSKTPGSARGSCPEDSGDPDTLEKEVPNSGVSFSNIKFGPIGSTYTGTGGSNPDPEEPEEPEEPVGTVPQYGQCGGINYSGPTACVSPYKCNKINDFYSQCQ

SEQ ID NO: 24534 - protein, 231 aa, Fusarium solani
  subsp. pisi
MKFFALTTLLAATDSALPTSHPVQELEARQLGGGTTRNDLTNGNSASCADVIFIYARGSTETGNLGTLGPSIASKLESAFGRDGVWIQGVGGAYRATLGDNSLPRGTSSAAIREMLGLFQQPNTKCPDATLIAGGYSQGAALAAASVEDLDSAIRDKIAGTVLFGYTKNLQNHGRIPNFPADRTKVFCNTGDLVCTGSLIIAAPHLTYGPDARGPAPEFLIEKVRAVRGSA

SEQ ID NO: 24535 - protein, 231 aa, Fusarium solani
  subsp. pisi
MKFFALTTLLAATASALPTSHPVQELEARQLGGGTTRNDLTNGNSASCADVIFIYARGSTETGNLGTLGPSIASKLESAFGRDGVWIQGVGGAYRATLGDNSLPRGTSSAAIREMLGLFQQANTKCPDATLIAGGYSQGAALGAASVEDLDSAIRDKIAGTVLFGYTKNLQNHGRIPNFPADRTKVFCNTGDLVCTGSLIIAAPHLTYGPDARGPAPEFLIEKVRAVRGSA

SEQ ID NO: 24536 - protein, 374 aa, Fusarium subglutinans
MVRNIAIAALLPAAWALPSSSLQERDACTVTDYSGLATAVSSCTNIVLNGFQVPTGKQLDLSKLKAGSTVTFKGETTFATTADNDFDPIVISGSGITITGASGHVIDGNGQAYWDGQGSNNADNPKPDHFIVVKKVTGTSKITNLNIQNWPVHCFDINGSSDLTISGLILDNRAGDKPNSKSGGLPAAHNSDGFDISSCDHVTLDNNHVYNQDDCVAVTSGTNIVVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGVGSCSGFTFSGNAITGGGKTSSCNYPTNTCPS

SEQ ID NO: 24537 - protein, 374 aa, Fusarium subglutinans
MVRNIALAALLPAAWALPSSSLQERDACTVTDYSGLATAVSSCTNIVLNGFQVPTGKQLDLSKLKAGSTVTFKGKTTFATTADNDFDPIVISGSGITITGASGHVIDGNGQAYWDGQGSNNADNPKPDHFIVVKKVTGTSKITNLNIQNWPVHCFDITGSSDLTISGLILDNRAGDKPNSKSGGLPAAHNSDGFDISSCDHVTLDNNHVYNQDDCVAVTSGTNIIVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGVGSCSGFTFSGNAITGGGKTSSCNYPTNTCPS

SEQ ID NO: 24538 - protein, 374 aa, Fusarium subglutinans
MVRNIALAALLPAAWALPSSSLQERDACTVTDYSGLATAVSSCTNIVLNGFQVPTGKQLDLSKLKAGSTVTFKGKTTFATTADNDFDPIVISGSGITITGASGHVIDGNGQAYWDGQGSNNADNPKPDHFIIVKKVTGTSKITNLNIQNWPVHCFDITGSSDLTISGLILDNRAGDKPNSKSGGLPAAHNSDGFDISSCDHVTLDNNHVYNQDDCVAVTSGTNIVVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGVGSCSGFTFSGNAITGGGKTSSCNYPTNTCPS

SEQ ID NO: 24539 - protein, 507 aa, Fusarium venenatum
MYRAIATASALIAAVRAQQVCSLTPETKPALSWSKCTSSGCSNVQGSVTIDANWRWTHQLSGSTNCYTGNKWDTSICTSGKVCAEKCCIDGAEYASTYGITSSGNQLSLSFVTKGTYGTNIGSRTYLMEDENTYQMFQLLGNEFTFDVDVSNIGCGLNGALYFVSMDADGGKAKYPGNKAGAKYGTGYCDAQCPRDVKFINGQANSDGWQPSKSDVNGGIGNLGTCCPEMDIWEANSISTAHTPHPCTKLTQHSCTGDSCGGTYSEDRYGGTCDADGCDFNAYRQGNKTFYGPGSGFNVDTTKKVTVVTQFHKGSNGRLSEITRLYVQNGKVIANSESKIAGVPGSSLTPEFCTAQKKVFGDIDDFEKKGAWGGMSDALEAPMVLVMSLWHDHHSNMLWLDSTYPTDSTKLGAQRGSCSTSSGVPADLEKNVPNSKVAFSNIKFGPIGSTYKEGQPEPTNPTNPNPTTPGGTVDQWGQCGGTNYSGPTACKSPFTCKKINDFYSQCQ

SEQ ID NO: 24540 - protein, 374 aa, Gibberella circinata
MVRNIALAALLPAAWALPSSSLQERDACTVTDYSGLATAVSSCTNIVLNGFQVPTGKQLDLSKLKAGTTVTFKGTTTFATTADNDFDPIVISGSGITITGASGHVIDGNGQAYWDGQGSNNADNPKPDHFIVVKKVTGTSKITNLNIQNWPVHCFDITGSSDLTISGLILDNRAGDKPNSKSGGLPAAHNSDGFDISSCDHVTLDNNHVYNQDDCVAVTSGTNIVVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTCPS

SEQ ID NO: 24541 - protein, 374 aa, Gibberella circinata
MVRNIALAALLPAAWALPSSSLQERDACTVTDYSGLATAVSSCTNIVLKGFQVPTGKQLDLFKLKAGTTVTFKGTTTFATTADNDFNPIVISGSGITITGASGHVIDGNGQAYWDGQGSNNADNPKPDHFIVVKKVTGTSKITNLNIQNWPVHCFDITGSSDLTISGLILDNRAGDKPNSKSGGLPAAHNSDGFDISSCDHVTLDNNHVYNQDDCVAVTSGTNIVVSNMYCSGGHGLSIGSVGGKSTNVVNGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTCPS

SEQ ID NO: 24542 - protein, 374 aa, Gibberella fujikuroi
MVRNIALAALLPAAWALPSSSLQERDACTVTDYSGLATAVSSCTNIVLAGFQVPTGKQLDLSKLKAGTTVTFKGKTTFATTADNDFDPIVISGSGITITGASGHVIDGNGQAYWDGQGSNNQDNPKPDHFIVVKKTTGNSKITNLNIQNWPVHCFDITGSSDLTISGLILDNRAGDKPNAKSGGLPAAHNSDGFDISSSDHVTLDNNYVYNQDDCVAVTSGTNIIVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTCPS

SEQ ID NO: 24543 - protein, 374 aa, Gibberella fujikuroi
MVRNIAIAALLPAAWALPSSSLQERDACTVTDYSGLATAVSSCTNIVLAGFQVPTGKQLDLSKLKAGTTVTFKGKTTFATTADNDFDPIVISGSGITITGASGHVIDGNGQAYWDGQGSNNQDNPKPDHFIVVKKTTGNSKITNLNIQNWPVHCFDITGSSDLTISGLILDNRAGDKPNAKSGGLPAAHNSDGFDISSSDHVTLDNNYVYNQDDCVAVTSGTNIIVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTCPS

SEQ ID NO: 24544 - protein, 373 aa, Gibberella fujikuroi
MVRNIVSRLCSQLFALPSSSLQERDPCSVTEYSGLATAVSSCKNIVLNGFQVPTGKQLDLSSLQNDSTVTFKGTTTFATTADNDFNPIVISGSNITITGASGHVIDGNGQAYWDGKGSNSNSNQKPDHFIVVQKTTGNSKITNLNIQNWPVHCFDITGSSQLTISGLILDNRAGDKPNAKSGSLPAAHNTDGFDISSSDHVTLDNNHVYNQDDCVAVTSGTNIVVSNMYCSGGHGLSIGSVGGKSDNVVDGVQFLSSQVVNSQNGCRIKSNSGATGTINNVTYQNIALTNISTYGVDVQQDYLNGGPTGKPTNGVKISNIKFIKVTGTVASSAQDWFILCGDGSCSGFTFSGNAITGGGKTSSCNYPTNTCPS

SEQ ID NO: 24545 - protein, 374 aa, Gibberella fujikuroi
MVRNIAIAALLPAAWALPSSSLQERDACTVTDYSGLATAVSSCTNIVLAGFQVPAGKQLDLSKLKAGTTVTFKGKTTFATTADNDFDPIVISGSGITITGASGHVIDGNGQAYWDGEGSNNKDNPKPDHFIVVKKTTGNSKITNLNIQNWPVHCFDITGSSQLTISGLILDNRAGDKPNAKSGSLPAAHNSDGFDISSSDHVTLDNNHVYNQDDCVAVTSGTNIVVSNMYCSGGHGLSIGSVGGKSDNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPSNTCPS

SEQ ID NO: 24546 - protein, 349 aa, Gibberella fujikuroi
DPCSVTEYSGLATAVSSCTNIVLAGFQVPTGKQLDLSKLKAGTTVTFKGTTTFATTADNDFNPIVISGSGITITGASGHVIDGNGQAYWDGKGSNSNSNQKPDHFIVVQKTTGNSKITNLNIQNWPVHCFDITGSSQLTISGLILDNRAGDKPNAKSGSLPAAHNTDGFDISSSDHVTLDNNHVYNQDDCVAVTSGTNIVVSNMYCSGGHGLSIGSVGGKSDNVVDGVQFLSSQIVNSENGCRIKSNSGATGTINNVTYQNIALTNISTYGVDVQQDYLNGGPTGKPTNGVKISNIKFIKVTGTVASSAQDWFILCGDGSCSGFTFSGNAITGGGKTSSCNYPTNTCPS

SEQ ID NO: 24547 - protein, 374 aa, Gibberella intermedia
MVRNIAIAALLPAAWALPSSSLQERDACTVTDYSGLATAVSSCTNIVLAGFQVPTGKQLDLSKLKAGTTVTFKGKTTFATTADNDFDPIVISGSGVTITGASGHVIDGNGQAYWDGQGSNNQDNPKPDHFIVVKKTTGNSKITNLNIQNWPVHCFDITGSSDLTISGLILDNRAGDKPNAKSGGLPAAHNSDGFDISSSDHVTLDNNHVYNQDDCVAVTSGTNIIVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTCPS

SEQ ID NO: 24548 - protein, 374 aa, Gibberella intermedia
MVRNIAIAALLPAAWALPSSSLQERDACIVTDYSGLATAVSSCTNIVLAGFQVPTGKQLDLSKLKAGTTVTFKGKTTFATTADNDFDPIVISGSGVTITGASGHVIDGNGQAYWDGQGSNNQDNPKPDHLIVVKKTTGNSKITNLNIQNWPVHCFDITGSSDLTISGLILDNRAGDKPNAKSGGLPAAHNSDGFDISSSDHVTLDNNHVYNQDDCVAVTSGTNIIVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTYPS

SEQ ID NO: 24549 - protein, 374 aa, Gibberella intermedia
MVRNIAIAALLPAAWALPSSSLQERDACTVTDYSGLATAVSSCTNIVLAGFQVPTGKQLDLSKLKAGTTVTFKGKTTFATTADNDFDPIVISGSGVTITGASGHVIDGNGQAYWDGEGSNNKDNPKPDHFIVVKKTTGNSKITNLNIQNWPVHCFDITGSSDLTISGLILDNRAGDKPNAKSGGLPAAHNSDGFDISSSDHVTLDNNHVYNQDDCVAVTSGTNIIVSNMYCSGGHGLSIGSVGGKSNNVVDGVQFLNSQIVNSENGCRIKSNSGTTGTINNVTYQNIALTNISKYGVDVQQDYLNGGSTGKPTNGVKISNIKFTKVTGTVASSAQNWYILCGDGSCSGFTFSGNAITGGGKTSSCNYPTNTCPS

SEQ ID NO: 24550 - protein, 374 aa, Gibberella moniliformis
MVRNIAIAALLPAAWALPSSSLQERDACTVTDYSGLATAVSSCTNIVLAGFQVPTGKQLDLSKLKAGTTVTFKGKTTFATTADNDFDPIVISGSGITITGASGHVIDGNGQAYWDGEGSNNKDNPKPDHFIVVKKTTGNSKITNLNIQNWPVHCFDITGSSQLTISGLILDNRAGDKPNAKSGSLPAAHNSDGFDISSSDHVTLDNNHVYNQDDCVAVTSGTNIVVSNMYCSGGHGLSIGSVGGKSDNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPSNTCPS

SEQ ID NO: 24551 - protein, 374 aa, Gibberella moniliformis
MVRNIAIAALLPAAWALPSSSLQERDACTVTDYSGLATAVSSCTNIVLAGFQVPTGKQLDLSKLKAGTTVTFKGKTTFATTADNDFDPIVISGSGITITGASGHVIDGNGQSYWDGEGSNNKDNPKPDHFIVVKKTTGNSKITNLNIQNWPVHCFDITGSSQLTISGLILDNRAGDKPNAKSGSLPAAHNSDGFDISSSDHVTLDNNHVYNQDDCVAVTSGTNIVVSNMYCSGGHGLSIGSVGGKSDNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPSNTCPS

SEQ ID NO: 24552 - protein, 374 aa, Gibberella moniliformis
MVRNIAIAALLPAAWALPSSSLQERDACTVTDYSGLATAVSSCTNIVLAGFQVPTGKQLDLSKLKAGTTVTFKGKTTFATTADNDFDPIVISGSGITITGASGHVIDGNGQAYWDGEGSNNKDNPKPDHFIVVKKTTGNSKITNLNIQNWPVHCFDINGSSQLTISGLILDNRAGDKPNAKSGSLPAAHNSDGFDISSSDHVTLDNNHVYNQDDCVAVTSGTNIVVSNMYCSGGHGLSIGSVGGKSDNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPSNTCPS

SEQ ID NO: 24553 - protein, 98 aa, Gibberella moniliformis
MQFSLALVTLLATAVSALPTEEKRQAYIPCSGLYGTSQCCATDVLGVADLDCGNPPSTPANATDFSAVCSAIGQRARCCVLPILDQGILCNTPTGVQD

SEQ ID NO: 24554 - protein, 100 aa, Gibberella moniliformis
MQFYAIASLFLAGTAFAAPATSPNGYDACPDGGLIGTPQCCSLDLVGVLSGECSSPSKTPNSAKEFQEICAASGQKARCCFLSEVFTLGAFCQKPVGVTA

SEQ ID NO: 24555 - protein, 374 aa, Gibberella nygamai
MVRNIAIAALLPAAWALPSSSLQERDACTVTDYSGLATAVSSCTNIVLTGFQVPTGKQLDLSKLKAGTTVTFKGKTTFATTADNDFDPIVISGSGITITGASGHVIDGNGQAYWDSKGSNNKNNPKPDHFIVVKKTTGNSKITNLNIQNWPVHCFDITGSSQLTISGLILDNRAGDKPNAKSGNLPAAHNSDGFDISSSDHVTLDNNHVYNQDDCVAVTSGTNIVVSNMYCSGGHGLSIGSVGGKSNNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTCPS

SEQ ID NO: 24556 - protein, 374 aa, Gibberella thapsina
MVRNIAIAALLPAAWALPSNSLQERDACTVTDYSGLATAVSSCTNIVLAGFQVPTGKQLDLSKLKAGTTVTFKGKTTFATTADNDFDPIVISGSGITITGASGHVIDGNGQAYWDGEGSNNKDNPKPDHFIVVKKTIGNSKITNLNIQNWPVHCFDITGSSQLTISGLILDNRAGDKPNAKSGSLPAAHNSDGFDISSSDHVTLDNNHVYNQDDCVAVTSGTNIVVSNMYCSGGHGLSIGSVGGKSNNVVDGVQFLDSQIVNSENGCRIKSNSGTTGTINNVTYKNIALTNISKYGVDVQQDYLNGGPTGKPTNGVKISNINFTKVTGTVASSAQNWYILCGDGSCSGFTFAGNAIAGGGKTSSCNYPTNTCPS

SEQ ID NO: 24557 - protein, 374 aa, Gibberella thapsina
MVRNIALAALLPAAWALPSNSLQERDACTVTDYSGLATAVSSCTNIVLAGFQVPTGKQLDLSKLKAGTTVTFKGKTTFATTADNDFDPIVISGSGITITGASGHVIDGNGQAYWDGEGSNNKDNPKPDHFIVVKKTTGNSKITNLNIQNWPVHCFDITGSSQLTISGLILDNRAGDKPNAKSGSLPAAHNSDGFDISSSDHVTLDNNHVYNQDDCVAVTSGTNIVVSNMYCSGGHGLSIGSVGGKSNNVVDGVQFLDSQIVNSENGCRIKSNSGTTGTINNVTYKNIALTNISKYGVDVQQDYLNGGPTGKPTNGVKISNINFTKVTGTVASSAQNWYILCGDGSCSGFTFSGNAITGGGKTSSCNYPTNTCPS

SEQ ID NO: 24558 - protein, 381 aa, Gibberella zeae
MHFLGLVVAFAPAALAQSAIWGQCGGTGWSGSTTCQSGLKCEKINDFYYQCIPGSDNGGGTTPDPGTPSPGNGNADATGLDAKIRAKGKIYFGTEIDHYHLSNNPLINIVKKDFGQVTNENSMKWDAIEPSRGQFTFSNADKVVDFAQANGKKIRGHTLLWYSQLPQWVKNIRDRATMTSVIENHVKTVVTRYKGKILHWDVVNEIFAEDGNMRNSEFYQVLGEDFVGIAFRAARAADPAAKLYINDYNLDIANYAKVTRGMVDHVNKWVSQGIPIDGIGSQAHLAKPGGWNPASGFPAALKVLAGANVKEVAITELDIDGAAANDYVTVVNSCLTTPKCVGITVWGVSDKDSWRSESNPLLFDRNYQPKAAYTAVSNALN

SEQ ID NO: 24559 - protein, 98 aa, Gibberella zeae; identical to SEQ ID NO: 24365

SEQ ID NO: 24560 - protein, 680 aa, Gibberella zeae
MKHLLTLALCFSSINAVAVTVPHKAVGTGIPEGSLQFLSLRASAPIGSAISRNNWAVTCDSAQSGNECNKAIDGNKDTFWHTFYGANGDPKPPHTYTIDMKTTQNVNGLSMLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFGGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSWSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLYFARTFHTSVVLPDGSTFITGGQRRGIPFEDSTPVFTPEIYVPEQDTFYKQNPNSIVRVYHSISLLLPDGRVFNGGGGLCGDCTTNHFDAQIFTPNYLYNSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQ

SEQ ID NO: 24561 - protein, 375 aa, Gibberella zeae
MRTSTLLTIANSGTAFAAVQMYNQCGGSAYSGDKECPSGSTCVEVSKWYSQCIPDSSSKKAASVEKTDFDFRAFGFPGFPAPPQAPPAEEDNSQGNDNTPAPFLSTIPTPEGPTNTPEQPVDDPVDTIIANPTTAPTSEPIETGSGSGSVAITRTIPASSGATAVATAIPVSGELDGGMAYYDRSPSVCKEQEETGEADAMFILGDGATLRNVIIGPGQAEGVHCKGTCTLENVWFEDVCEDAITLKQKSGTSIIRGGGAFHAADKVVQFNGRGTVEISDFYVEDYGKLVRSCGNCKDNGGPRNVVIENVAAVNGGVLCGINTNYGDTCTISNACQDKGKNCDLFEGNSDGSEPTKLSSGPDGTSCKVDSFAETC

SEQ ID NO: 24562 - protein, 355 aa, Gibberella zeae
MRSFALLALFGPLAVSAASGSGHSTRYWDCCKPSCSWSGKAKVSAPALTCDKKDNPITNLNAVNGCESGGSAFACTNYSPWAVNDDLAYGFTATKLAGGTEASWCCACYALTFTTGPVKGKKMIVQSTNTGGDLGDNHFDLMMPGGGVGIFDGCTSEFGKPLGGAQYGGISSRSQCDSFPELLKDGCHWRFDWFKNADNPDFTFEQVQCPKELLAISGCKRDDDSSFPAFKGNTTPSNAKPSGEKSAAAAQPQKPSTKAATEPIATKPATVKPAPVKPTKVVNKPKTASKVGGTKTRGKCPATKPTKPAAPQKSAVAIYHQCGGSKSAYPDGSLSCASGSKCVKMNDYYSQCVPN

SEQ ID NO: 24563 - protein, 512 aa, Gibberella zeae
MYRAIATASALIAAVRAQQVCSLTQESKPSLNWSKCTSSGCSNVKGSVTIDANWRWTHQVSGSTNCYTGNKWDTSVCTSGKVCAERCCLDGADYASTYGITSSGDQLSLSFVTKGPYSTNIGSRTYLMEDENTYQMFQLLGNEFTFDVDVSNIGCGLNGALYFVSMDADGGKAKYPGNKAGAKYGTGYCDAQCPRDVKFINGQANSDGWQPSDSDVNGGIGNLGTCCPEMDIWEANSISTAYTPHPCTKLTQHSCTGDSCGGTYSNDRYGGTCDADGCDFNSYRQGNKTFYGPGSGFNVDTTKKVTVVTQFHKGSNGRLSEITRLYVQNGKVIANSESKIAGVPGNSLTADFCTKQKKVFNDPDDFTKKGAWSGMSDALEAPMVLVMSLWHDHHSNMLWLDSTYPTDSTKLGSQRGSCSTSSGVPADLEKNVPNSKVAFSNIKFGPIGSTYKSDGTTPTNPTNPSEPSNTANPNPGTVDQWGQCGGSNYSGPTACKSGFTCKKINDFYSQCQ

SEQ ID NO: 24564 - protein, 457 aa, Gibberella zeae
MTAYKLFLAAAFAATALAAPVEERQSCSNGVWSQCGGQNWSGTPCCTSGNKCVKVNDFYSQCQPGSADPSPTSTIVSATTTKATTTGSGGSVTSPPPVATNNPFSGVDLWANNYYRSEVSTLAIPKLSGAMATAAAKVADVPSFQWMDTYDHISFMEDSLADIRKANKAGGNYAGQFVVYDLPDRDCAAAASNGEYSLDKDGKNKYKAYIADQGILQDYSDTRIILVIEPDSLANMVTNMNVPKCANAASAYKELTIHALKELNLPNVSMYIDAGHGGWLGWPANLPPAAQLYGQLYKDAGKPSRLRGLVTNVSNYNAWKLSSKPDYTESNPNYDEQKYIHALSPLLEQEGWPGAKFIVDQGRSGKQPTGQKAWGDWCNAPGTGFGLRPSANTGDALVDAFVWVKPGGESDGTSDTSAARYDYHCGIDGAVKPAPEAGTWFQAYFEQLLKNANPSFL

SEQ ID NO: 24565 - protein, 512 aa, Gibberella zeae
MYRAIATASALIAAVRAQQVCSLTQESKPSLNWSKCTSSGCSNVKGSVTIDANWRWTHQVSGSTNCYTGNKWDTSVCTSGKVCAEKCCLDGADYASTYGITSSGDQLSLSFVTKGPYSTNIGSRTYLMEDENTYQMFQLLGNEFTFDVDVSNIGCGLNGALYFVSMDADGGKAKYPGNKAGAKYGTGYCDAQCPRDVKFINGQANSDGWQPSDSDVNGGIGNLGTCCPEMDIWEANSISTAYTPHPCTKLTQHSCTGDSCGGTYSNDRYGGTCDADGCDFNSYRQGNKTFYGPGSGFNVDTTKKVTVVTQFHKGSNGRLSEITRLYVQNGKVIANSESKIAGVPGNSLTADFCTKQKKVFNDPDDFTKKGAWSGMSDALEAPMVLVMSLWHDHHSNMLWLDSTYPTDSTKLGSQRGSCSTSSGVPADLEKNVPNSKVAFSNIKFGPIGSTYKSDGTTPTNPTNPSEPSNTANPNPGTVDQWGQCGGSNYSGPTACKSGFTCKKINDFYSQCQ

SEQ ID NO: 24566 - protein, 627 aa, Gibberella zeae
  strain PH-1 / ATCC MYA-4620 / FGSC 9075 / NRRL 31084
MATVRICVCGDESTGKSSLIASLVKDQFVNNKIQPVLPQITIPPSIGTPENVSTTIVDTSARPQDRTTLRKEIRKCNVILLVYADHYSYERVALFWMPYFRSLGVNVPVVLCANKSDLVGQGTTPQVVEEELLPVMAEFREVDSCIRTSARDHRNVNEVFFLCQKAVTHPIAPLFDYKEGHLKPLCINALKRIFYLCDKDQDGYLNEQEMRDFQARCFDKPLTTDDLDNIKLSIAKSLPASDLEKGIDLPGFLQLNKLYAEKGRHETIWIILRKFHYTDSLSLEDKFIRPKFEVPEYSSAELSPAGYRFFVDLFLIFDKDNDGGLNDEELEALFAPAPGLPSSWTDSSFPSSTVRNEAGHVTLQGWLAQWSMTTFIEPKTTIEYLAYLGFEPSNPKDSITAALKITKPRKRRSRLGRVERNVVLCYVLGASGAGKSALLDSFLNRPFYGLYHPTIKPRRAVNSVELPGGKQVYLILEELGELEPAILENRAKLDACDLICYAYDSSDPDSFSHIVDLRKKYPHLDELPSIYTALKADKDKTNQRCELQPDQYTSSLSMSLPLHVSVTWGSISELFVAYADAATTPSTAFPRSNEEGPDRTSLYIALGATACAGVAALTIWRRATNAL

SEQ ID NO: 24567 - protein, 93 aa, Gibberella zeae
  strain PH-1 / ATCC MYA-4620 / FGSC 9075 / NRRL 31084
MSSSTPKDTVDTAETPKVKDPESQAWSDDKRRKFETKSKSEFYDPCQEAAQASYRCLFRNGGDKNMCGEYFQAYRDCKQEWTEKRRREGRGWF

SEQ ID NO: 24568 - protein, 153 aa, Gibberella zeae
  strain PH-1 / ATCC MYA-4620 / FGSC 9075 / NRRL 31084
MVTELPYALDAETPLNPSELNVLKAQYDREGEMVGVQTKFNYAWGLVKSNQRNDQQLGVRLLSDIFRVSPERRRECLYYLALGNYKLGNYGEARRYNDLLLDKEPANLQASNLRSLIDDKVAREGLMGVAILSGVGVAAGVVGAFLLRNARKR

SEQ ID NO: 24569 - protein, 130 aa, Gibberella zeae
  strain PH-1 / ATCC MYA-4620 / FGSC 9075 / NRRL 31084
MRPSLLRLASATSTQRGLKPNPMALLPPIPLYRRLLRAHRKHLPPDMRILGDEYIKAEFRAHRKVDNPAHLIGFLTEWQMYAQKIEGDQWVGDKLDEQKLSKMSDEQIQQLYELMQAIQNRGKEGGEQES

SEQ ID NO: 24570 - protein, 100 aa, Hypocrea atroviridis
MQFTTFVALFASLAVAAPASEVVERDGINGPCSAGVTNNIPQCCGAGVLDLLYLDCETPRTVSSALNPLRNICATVGLQAKCCTLGIAGLGVLCQDALPL

SEQ ID NO: 24571 - protein, 89 aa, Hypocrea atroviridis
MKLFIAAALFTLGLAAPVTETKSHNIVARSTYSCPSGLTNSSPMCCSVNVLGLLALDCANVGEDGCHGAAKLNCCTLGLAGQGVICNEQ

SEQ ID NO: 24572 - protein, 89 aa, Hypocrea atroviridis
MQFSIVALFATGALASVSVCPNGLYSNPQCCGANVLGVAALDCHTPRVDVLTGPIFQAVCAAEGGKQPLCCVVPVAGQDLLCEEAQGTF

SEQ ID NO: 24573 - protein, 98 aa, Hypocrea atroviridis
MKFFVATALFATAAIAGPVEVRTGTAPLCPNGLYSNPQCCDTLVLGIVGLGCEVPTQTPRDGVDFKNICAKTGDQAVCCVVPVAGQDLLCQTAVGIQG

SEQ ID NO: 24574 - protein, 106 aa, Hypocrea atroviridis
MQFFAVATLFLATAFAAPSVDSNGNGVAHRQPAPFCPPGLLYTNPQCCDVDVLGVADLNCVVPPRGPSNCKTFSGICASIGKEPKCCAVPILGQALLCTDPVGSRN

SEQ ID NO: 24575 - protein, 182 aa, Hypocrea atroviridis
MKVLAIATILIAAVSAAPTKELCPSPIPPIPSYGLPSPPLNGEIPPLNGGNPPLNGVIPPVDSVIPPVNVANPPVDDVIPPVNVANPPVDDVIPPVNVATPVSGSNVFGQFECPAGLLYSNPQCCSVDVLGIADLDCSSPSKTPKDASDFQDICDTAGKKAQCCAVPIAGQAVLCQDVIGAY

SEQ ID NO: 24576 - protein, 86 aa, Hypocrea atroviridis
MQFSIVALFATGALAAVCPTGIYSNPLCCVTDVFGVIGQNCEAPKSAIFDGLSFQNACAAVGLDPLCCVAPVADQGILCQIPVGTQ

SEQ ID NO: 24577 - protein, 86 aa, Hypocrea atroviridis
MQFSIVAIFATGAFAAICPTGLYSNPLCCGSGILGVVFLDCEAPKAQVSDSMSFQNACAAVGLQPLCCAAPTADQGIICQMPAGTI

SEQ ID NO: 24578 - protein, 85 aa, Hypocrea atroviridis
MQFFAVATLFVVGVLAAPSPSGLNSRDTLCAAGLYSTPQCCAVDVLGVADLNCAGPNCAAIGQEARCCVLPVLGQDVLCQTPPGL

SEQ ID NO: 24579 - protein, 217 aa, Hypocrea atroviridis
MKHLLVTALLAAGALAMPAGSSCASPSTDYPPPSTDYPPPSTDYPPPSTDYTPPSYPTPTPTPTYTPPPPKNGGGKYPPPPPPPSSPPYSTAPHNGGGGGNGGNGGNGGNGGNNGGGNSGNGGGNNGNGGNNGGGNNGGGNNGQYECSGGGGLYSNLQCCSVDVLGIADLDCKPPSKTPVSGSDFKSICQASGAKPKCCVLPILGQGLLCEDAIGTA

SEQ ID NO: 24580 - protein, 409 aa, Hypocrea atroviridis
MTSIRRLALYLGALLPAVLAAPAALHKKPEAVPNKFIVTLKEGASIDTDSHLAWVTDIHTRSLTKRSTAGVEKTYNIHTWNAYAGEFDEETIEQIKSNPDVASVEPDYIMHLSDIVEDKRALTTQSGAPWGLGTVSHRTSGSTSYIYDSSAGAGTFAYVVDSGINTSHQQFGGRASLGYNAAGGQHVDTLGHGTHVSGTIGGSTYGVAKQASLISVKVFAGESASTSVILDGYNWAVNDIVSKSRASKSAINMSLGGPASSTWTTAINAAFNQGVLTIVAAGNGDSLGNPQPVSGTSPANVPNAITVAALDINWRTASFTNYGAGVDVFAPGVNILSSWIGSNTATNTISGTSMATPHVVGLALYLQSLEGLTSPTAVTNRIKALATSGRVTGSLNGSPNVIIFNGNSS

SEQ ID NO: 24581 - protein, 408 aa, Hypocrea atroviridis
  strain ATCC 20476 / IMI 206040
MLFQKTLAGLGLLASLASAAPSLRRRQDPAGLNVVYWGQNGGGTIENNDLSAYCTATSDIDVLVLSSLWQWSNGATAMGGSFGQSCGVTSSGQPQNCDALVAAITKCKNAGVKIILSIGGAAAYSSFASADEASAAGQYVWNAYGGGSGVTRPFGNNIVDGFDLDLELATGNEYFIPFLNTLRSNFASDPSHTYVITGAPQCPIPEPNMGIIIQGVQFDYLWIQFYNNNNYTVPCSLGINGGAPFNYNNWTSFVETTPSKNAKLFVGVPASPLGANGSPTGSVYYATPQQLAQIVAEVKGNSNFGGIMMWSAGFSDSNVNNGCNYAQEAKNILLTGSPCASGPVTASLPPVPTSTSASSPPGSSSTPPSGSGSVPQWGQCGGDGYTGPTQCVSPYKCVATSEWWSQCE

SEQ ID NO: 24582 - protein, 420 aa, Hypocrea atroviridis
  strain ATCC 20476 / IMI 206040
MKFLRHVLQLLPASLVFAAYTPSSPEHTCVIPALNDGRDDAPAIREAFDKCGKNGKVIFQKDTTYSIQTVLQLHDLKNVQVDMLGTLEYSTDVRYWILHGSYYYFQNISIAMEFSGEDITIDGHGSGTIDGQGQVWYDLALGVGGLYGRPIPFCLRNVKNAVARNFKILQSGKWNFVMLESQNILVDNIYLSSTSDDDQANPGNLGNTDGFDTINSDNITIQNSWANVGDDCVSFKPGSTNMHVKNLTCYNSAGIAIGSLGQYEGVRDVVENITAEDVTLIGSRNGAYIKTYVGKRTYWPPQGGGGGNGYVRNVVFKNFHIENITSSPVLIQQCTHWGGYNVPACADTPATGYFSNISWSNFTGYLNEKVGTKSISWACSPLAQCEGFSFKDINVKSVDGADGTYSCSNVDGYDATCQKV

SEQ ID NO: 24583 - protein, 424 aa, Hypocrea atroviridis
  strain ATCC 20476 / IMI 206040
MVMAIKSYVLAALSAASTLAAVVQPAPRASSFVTISGSHFDIDGEVGYFAGTNCYWCPFTYNTAEVDTTLSDIASSGLKVVRVLGFSDWNTLPPTGEIWFQLLNATGSIINTGADGLQNLDYVVASAEQHGLKLIIPLVNNWDDFGGINAYVNAFGGNATSWFTNAAAQSQYRTYIHAVVSRYINSTAIFAWELANEPRCAGCDTGVIAEWATGVSQYIKSLDPNHLVTLGDEGLGLSTGDGSYPYSYASGTDFAANIQIESLDFGTFHLYPDGWGETYPWGSSWVQTHAQACVEAGKICIMEEYGAVTDRCTNMVPWQNASMASLGMGGDLFWQWGETFVSGYGDSYSINYGSSDWHCVVQDHVAAISGKSPPPSTTTLTGPTASGSCSILWGQCGGNGYLGATCCAQGTCTYLNDWYSQCQP

SEQ ID NO: 24584 - protein, 380 aa, Hypocrea atroviridis
  strain ATCC 20476 / IMI 206040
MTKASLLIGAFAASACVQAFVVPSAPEVTQGPKLEDRATTCTFSGSNGASSASKSQKSCATIVLSNVAVPSGVTLDLSDLNDGTTVIFQGTTTWGYKEWSGPLLQIEGNDITIQGASGAVLNPDGARWWDGQGSNGGKTKPKFFAAHDLTSSTITNLYIENTPVQAVSVNGVNGLNINGMTIDNSAGDSGGGHNTDGFDIGSSSNVVISGAKVYNQDDCVAVNSGTNITFTGGLCSGGHGLSIGSVGGRDDNTVQTVTFSNSQVTKSANGIRIKASAGDTGTIKGVTYSGITLSSITGYGILIEQNYDGGDLHGSPTSGIPITNLVLQNISGSGGVQSSATNVAIVCGSGACSSWTWSNVVVTGGKKYSSCQNVPSPASC

SEQ ID NO: 24585 - protein, 394 aa, Hypocrea atroviridis
  strain ATCC 20476 / IMI 206040
MVQSLVYLGALLAALPSARAGFNASSTQNVAVYWGQNSANQETSQQRLSTYCANAEIDIIPIGFMNGISPVITNFANAGNNCTAFADNKNALNCPQIEQDIITCQQTYGKTILISLGGGSYTQGGFSSTDVATSAAQTVWNMFGPVNSNSNVDRPFGSAVVDGVDFDFESGVNNLETFAAELRSLMDASASSANRKFYLSAAPQCVYPDYADNPALNGSVFFDFIMIQYYNNGCGVSSYVPGASTQWNYNFDVWDNWAHTVSKNPNVRILLGIAANTGAASGYVSGTQLSAVISFTKQYSSFAGIMMWDMSQLYLNSGFLDQVVSDLAASGSTPPPTSSTGGSKPTSTSGSTSPTGGGSVPQWGQCGGQGYTGPTQCQSPYTCVATSTWWASCQ

SEQ ID NO: 24586 - protein, 846 aa, Hypocrea atroviridis
  strain ATCC 20476 / IMI 206040
MILQSLVLLLLTAIAPVFAETGIDAWLRYAPLSSSVTRGHLNSFPNHIVALNATKDGPLSSAASELQKGIKGILGLNLGVSSSQKSCSAQKTIVVSTLDSYKSACGKLPPKLDLIQDGYWLSTKGESVQIIGQNERGALYGAFQYLSLLGQGNFSQVAFASNPSAPIRWSNQWDNLNAGTAAHGSIERGYGGVSIFFENGYVKKDLSRVPLYGRLLASVGLNGIVINNVNADATLLNETNLEGVKRIADLFRPWGVQVGISLNFASPQVLGELDTFDPLDETVIKWWTDKSNRIYELVPDFAGYLVKANSEGQPGPLTYNRTLSQGANLFAKAIEPHGGIVVFRAFVYDQLNETDWKADRANAAVEFFKDLDGQFDSNVLVQIKFGPIDFQVREPPSPLFVNIPKTPVSIELEVTQEYLGQQCHLVYLPPLWQTILGFDMRANGRQSYIRDIVTGKTFNHKLSGYAGVINIGMNDTWIGSHLAMSNMFAFGRLAWNPQADSQDIVEEWTRLTFGLNRDVVSAIVSMSMKSWPAYEDYSGNLGIQTLTDILYTHYGANPASQDNNGWGQWTRADSKTIGMDRTVSNGTGNAGQYAKDVAHMFEYTQTTPDDLMLWFHHVPYTFKLHSGKTVIQHFYDAHYAGSATAQTFPTTWKSLEGQIDAERYKEVLYRLTYQAGHSLVWRDAISEFYRNLSSIPDQLNRVRNHPHRIEAEAMDLSDFTIVDVDPTECASKYKAIATNGTGTATTKLNVPSGKYNVAVNYYDVMGGIANYEVLLNGKSVGTWKGDSENYLGHDYSSFLDCHSAIRITFEGVKIKKGDTLTIKGTGNALEQAAIDYVSILPQGVVD

SEQ ID NO: 24587 - protein, 247 aa, Hypocrea atroviridis
  strain ATCC 20476 / IMI 206040
MKASLFVGSLIASSAAAYKATTTRYYDGQEGACGCGGANGGAAFSWQLGISSGVYTAAGSQALYDTAGASWCGAGCGKCYNLTSTGEPPCTSCGTGGVAGQSIIVMVTNLCPNNGNAQWCPTVGGTNQYGYSYHFDIMAQNEIFGDNVVVDFEPVACPGQATSDWQQCLCVGMQETDTTPVLGGGSSPPPGSSSSRPPASATSSAPTGSGTQSLYGQCGGTGWAGPTACAPPATCKVLNQYYSQCLD

SEQ ID NO: 24588 - protein, 120 aa, Hypocrea atroviridis
  strain ATCC 20476 / IMI 206040
MQFLAVLPLLYTAAAALGINCRGNANCVGTPECRLSDLILQVSQQDPSTSYSPGQHIACCGIPGGNICAFTQGISNSITAGEALGMLQGLSSHGCGQCGSIPFKDNNVAEGQLTVNWTDH

SEQ ID NO: 24589 - protein, 470 aa, Hypocrea atroviridis
  strain ATCC 20476 / IMI 206040
MAGRVFATLATLAALAASAPVVEERQACASVWGQCGGQGWSGATCCASGSSCVVSNPYYSQCLPGSGGGSSSSTLASSTRASSTTVRSSSTTPPPSSSTPPPPVGSGTATYQGNPFSGINPWANSFYAQEVSSSAIPSLSGAMATAAAAAAKVPSFMWLDTLSKTSLLSSTLSDIRAANKAGGNYAGQFVVYDLPDRDCAAAASNGEYSIADNGVANYKNYIDTIVGILKTYSDIRTILVIEPDSLANLVTNLSVAKCSNAQAAYLECINYAITQLNLPNVAMYLDAGHAGWLGWPANQQPAAQLFASVYKNASSPRAVRGLATNVANYNGWNITSAPSYTQGNSVYNEQLYIHAISPLLTQQGWSNTYFITDQGRSGKQPTGQQAWGDWCNVIGTGFGIRPSANTGDSLLDAFTWIKPGGECDGTSNTSATRYDYHCGLSDALQPAPEAGSWFQAYFVQLLTNANPSFL

SEQ ID NO: 24590 - protein, 418 aa, Hypocrea atroviridis
  strain ATCC 20476 / IMI 206040
MNKPMGPLLLAATLMASGAIAQTQTVWGQCGGQGYSGPTNCASGSACSTLNPYYAQCIPGATSFTTSTTSTKSPGSGSSTTSSASQPTGSGQTRFAGINIAGFDFGCTTDGTCVTSQIYPPLKNFGGTNNHPDGVGQMQHFVNDDKLNIFRLPVGWQYLVNNNLGGTLDSTAISNYDQLVQGCLATGAYCIVDIHNYARWNGAIIGQGGPTNAQFVSLWTQLATKYASQSKIWFGIMNEPHDVDINTWGTTVQAVVTAIRNAGATTQFISLPGTDYQSAGNFLTDGSSTALSQVKNPDGSTTNLIFDLHKYLDSDNSGTHTECVTNNIATAFQPVATWLRQNKRQGILTETGGGNTQSCIQDVCQQNQFLNQNSDVFLGYVGWGAGSFDSTYQLTLTPTQNGNTWTDTALAAACFSRA

SEQ ID NO: 24591 - protein, 97 aa, Hypocrea atroviridis
  strain ATCC 20476 / IMI 206040
MQFFAVATLFVVGVLAAPSPSGLNSRDTLCAAGLYSTPQCCAVDVLGVADLNCAGLVGTVTTAAEFKANCAAIGQEARCCVLPVLGQDVLCQTPPGL

SEQ ID NO: 24592 - protein, 416 aa, Hypocrea atroviridis
  strain ATCC 20476 / IMI 206040
MRSAAFLASLGLAGLVVGAPPAPHSVRARQASGAQNVVYWGGTNNESDDLSTYCAPNAGIDILVLSFLDIYGSTGSIPAGNIGNTCYVGTNGAPQLCDGLAASIASCQAAGIKIILSLGGAAGSYSLQSQSQAVSIGQYLWEAYGNSGSTSVQRPFGNVFVNGFDFDLELNLGNQYYQYLISTLRSNFASDPSHTYYITGAPQCPLPEPNMGEVISNSQFDYLWIQFYNNNGYGPDPCSLGLPGDAPFNYNNWTSFIATTPSKNAKLFVGVPANTLAANGNSGGAVYYASPSQLASIIADVKSSPDFGGIMMWDAGYSDANVNNGCNYAQEAKNILLTGAPCGGSSPPASSSAPTSTAKTTKPASSSTSSASGTGPTGSGTVPQWGQCGGEGYTGPTQCVSPYKCVVSSEWWSSCQ

SEQ ID NO: 24593 - protein, 139 aa, Hypocrea atroviridis
  strain ATCC 20476 / IMI 206040
MLFKLAITIIASTAGVSALGINCEGSAYCSGVLGNPGANDEPLPDMVDIIDYGIDDNRWYAAGEHIACDQPSGVCAFVQKTSGAMGTDIARVVRDLANHGCTVCGSVPLGFPGTNDVNNGEVTFNFVGLDDMGSCSGLC

SEQ ID NO: 24594 - protein, 392 aa, Hypocrea atroviridis
  strain ATCC 20476 / IMI 206040
MPSLYLTSALGLLSLLPAAQAGWNPNSKDNVVVYWGQNSGSIGQNRLSYYCENAPDIDVINLSFLVGITDLNLNFANVGNNCTSFAQDPNLLDCPQVAADIVECQQTYGKTIMMSLFGSTYTESGFSSSSAAVSAAQEIWAMFGPVQSGNSTPRPFGNAVVDGFDFDLEDPIENNMEPFAAELRTLTTAATSKTFYMSAAPQCVYPDASDESFLQGEVAFDWMNIQFYNNGCGVSGYPSQFNYATWDNWAKTVSANKNVKLLVGTPASVHAVNFAQYFPTNDQLAGAISTSKAYDTFAGVMLWDMAQLFGNPGYLDLIVADLGGASTPPPASTTLATVTRSSTASSGATPPPSGGGSVPQWGQCGGEGYTGPTQCQSPYTCVVSSQWWASCQ

SEQ ID NO: 24595 - protein, 797 aa, Hypocrea atroviridis
  strain ATCC 20476 / IMI 206040
MLVNETGLDGWLRYAALPDEFASLRPQYSAIISLTDSQSSPIFTAARELQLGLSKILSQNISLETKDGYCLVCKNGRAAEIIGQNDRGALYGAFEFLRLLSQNQPLPEMRISNPSAPIRWVNQWDNLDGTIERGYAGPSIFFADGHVLDDLTRVQQYARLLASVGLNGLIVNNVNSNYNLLNPFNMQGLARIADIMRPWGVRIGISLYFDTPKELGGLQTSDPLDRNVIAWWEDITSELYRHVPDMLGYLIKANSEGQPGPLTYGRTLADGANMFARALQPHGDGVVMYRAFVYNHHLDESNWKNDRANAAVEYFDGLDTQFEDNVIIQIKYGPIDFQIREPPSPLLAHLRKTPIILELQVTQEYLGQQDHIVYLPPLWKTIFDFDLHVDGQKSLVRDVVSGQRFNWSRSGYAAVVNVGNDPTWLGSHLAMANLYAYGLCAWDPQQSEVDIIQGWAQLTFGLNKAVVDTITNISMASWPTYENYSGNLGIQTLCDIVTHCHYGPSPAAQDGNGWGQWTRADARSIGMDRTVATGTGNSGQYPQKVADRFECIDTTPDELLLWFHHVPYTHRLKSGKTVIQHFYDAHYAGALVAQTFAQQWEILRGLIDDNRFDHMAFRLQYQAGHALVWRDSVNNFYYAKCGIRDELNRVGNHAWRIEAEEMTLEGYKVVPVTPFEAASGGKAIATIPGADVGTATCTVAFPSGTYNIAINYYDHLGGRSQYEVFVNERLIGAWAGDLQDKLSHDFSDRIDGHSATRITFDSVEVKKGDSLKIVGRPDGNELAPIDYVSLLPQGVVD

SEQ ID NO: 24596 - protein, 457 aa, Hypocrea atroviridis
  strain ATCC 20476 / IMI 206040
MVHISNFLLAALPAVFALPSASQHDLEGRSANVAQTEAHWANQASAQGRHFCYIKPDANGGDDAPAIMDALNNKCNSKALVIFPGPVYNIQTNMTTLDLQDVVIYQFGRMLWSTDIDYWLSVSMPVGFQNQSTVWYFGGHNVVWDGWGVGTLDGNGQVWYDWAKSQGNLARRPMNINFRTLTNSVIKRLRFVQSQMWTMAITYSQYVDLDDIYVNSTSTSQWSTLNTDGCDTIYSDSITFRRWTISNGDDAIALKMNSSNIAVYDSYFENGQGIAIGSMGQYNGKYEHLENFYARNITLKNTAHVSYLKTWAGISRGYPPNGGGGGLGVARNITIEDVTLIGGRQQPLFAWQCENYSGFSGQDCDSSLFKMEDITWKNIKGTVGPGVTEAVYLQCSSAAGGCDNVEVENFDVVVASTGKPLVVWDCFNVNAPIGFTCTESVTPKLSPAVTGGHGPDN

SEQ ID NO: 24597 - protein, 219 aa, Hypocrea atroviridis
  strain ATCC 20476 / IMI 206040
MRLLFLLHTLILFARPSSSTAIVTVTAAPAIPSNEPSYSIASSFTSAILNSTNTYRRQYNASSLSWNTTLEKFATSYLQSDTTCRFAHSGGPYGENLAIGYPNATASVEAWGNEEAKYNFNDPGFSEETGHFTQLVWKTTTTVGCGRRLCGTKGWFVVCEYWPRGNVGGEYAKEVDRNIDGGGGTRLSSPIVAAIAVVVSLVQCCVIIVVVWWFGTAKL

SEQ ID NO: 24598 - protein, 284 aa, Hypocrea atroviridis
  strain ATCC 20476 / IMI 206040
MVAFSRLVAGLSAVTASLAAPAEVVEKSVEERGPHNFFLGPDHPLARRTAINYNQDYTTGGTVNFSPSKTGFNLNWNTQQDFVVGVGWQPGTNLPINYSGTFNVSSGLGSLSVYGWTTNPLVEYYVMETNIGISTGGSQKGTLTSDGGTYAIWENQRVNEPSIIGTATFNQYISIRQSARSSGTVTIQNHFDAWAKAGLNLGTMNFQVIAVESWSGSGSASQQVSNGGTGTGTPTSSSGSTGPTGPSGSCSALYGQCGGIGWNGPTCCSSGSCKVSNSYYSQCL

SEQ ID NO: 24599 - protein, 349 aa, Hypocrea atroviridis
  strain ATCC 20476 / IMI 206040
MAQKLSNLFAIALTVATGVVGHGHVNNIVVNGVYYQGYDPTSFPYMPDPPIVVGWTAADTDNGFVSPDAYQTPDIVCHKNGTNAKGHASVKAGDSVLFQWVPVPWPHKSTVVDYLANCNGPCETVDKTTLEFFKIDGIGLLSGGNPGTWGSDVLIGNNNTWVIQIPEDLQTGNYVLRHELIALHSAEQADGAQNYPQCFNLAVTGTGSLQPSGVLATDLYHETDPGILFNIYTSPLTYIIPGPTVVSGLPSSVAQASSAATATSSATVSGGGGGSSTGGSTSKTTTVVRSTTSVTSKASSSTAVTTPPPAGGTQTLYGQCGGSGYSGPTKCASPAVCTTLNPYYAQCLN

SEQ ID NO: 24600 - protein, 319 aa, Hypocrea atroviridis
  strain ATCC 20476 / IMI 206040
MARQAALLALATFSSLSIAQISDGFEDGWNQSTWPTYAPDCNQGGTVSLDTTVAHSGSNSMKVVGGANGYCGHIFFGTTQVPTGDVYVRAWVQLETALNSDHVTFIVMPDTAQSGKHLRIGGQSEILDYNRESDDATLPDLSPQGIASSVDLPTGSFQCFEYYLGTDGTIQTWLNSNLITGMTAGPSANNSNDAGWTRETYVPDITGVYFGWEAYSGDINTVWFDDVAIATSRVGCGGPASSGTTSVRPTSTAHSTTSNPGTTTKPSTTIPPTTSKTTSSAGATQTKYGQCGGQGWSGPTVCASGSTCTYSNPYYSQCL

SEQ ID NO: 24601 - protein, 437 aa, Hypocrea atroviridis
  strain ATCC 20476 / IMI 206040
MMLYHALLAGLGLAGLAAAAPAKTKADDQTSGAQNVVYWGGSEGMTPLSEYCKPKTGIDILVLSFLNSWGVSGDIPSGRFGNIGCSIDQNGIPTAECSNLASQIKGCQSAGKKIIVSLGGAGGSYTLTSQSQAEKIGQYLWDAYGKGGNPAVKRPFGDAVVDGWDFDLEHSSDTDPAGRQWYPDLVNQLRTNSDKDKSRKYYITAAPQCVSPDASLDDAIQNSVFDYLFVQFYNNPKQCSLNIPGNASINWDTWNQRTSSSKSNNAKIFVGAPASDRAAPSGGYVGPSHLATLIKSLKSEPYFGGVMLWDAHWSDLNIIADCTYAQQVKSILTTGKTCPNTPDVPDSVAFPNAPTFSAPASPSFPPATSSAVYPPPASTSPASILPDNSSSHVSSSSGTGGGVAQWGQCGGEGYTGSTQCQSPFKCVYGGQYWSSCQ

SEQ ID NO: 24602 - protein, 135 aa, Hypocrea atroviridis
  strain ATCC 20476 / IMI 206040
MHFINILLSLASAASAASAAPVASASGSNCRDSGVCAGINANLSSVIAQLKGMDQHQRFSDGEHITCVDANSEGGSSLCLSYQGTGRSWTVFQTAWFAQSLIEKGCQACGSLSLGSDRKHGELTSSVITTPAGGL

SEQ ID NO: 24603 - protein, 348 aa, Hypocrea atroviridis
  strain ATCC 20476 / IMI 206040
MAMLGMPSMVFAASLTQVSNWGNPVNGVSMYIYVPDRVATKPPVIVAIHPCGGSAQEYFSLTRLPSYADSFGFILIYPQTTKDQNCWDCYSSASNTHNGGSDSKAIAAMVSYTLGKYNGDASKVFSVGSSSGAMMTPILMAAYPDVFAGGAGFSGVPAGCFENATSSTPSTPDQSCPHAQKGFTAQQWGDIARAEYPGYTGQYPKMQVWEGTADTLVTIGNLQAQLDQWSNVMGLSFSHNETNTPQSGYTKIVYGDGTRLVGYSAAGVGHFVPFHETDVLDFFDLLGGTSTSSSTQPSGPTSTTGGGGGPSCTAAHWAQCGGMGYSGCTVCASPYSCQVSNAYYSQCL

SEQ ID NO: 24604 - protein, 1322 aa, Hypocrea atroviridis
  strain ATCC 20476 / IMI 206040
MVMRVRSLSQRMPSWTKSAKRLSRTNTTFSTTSTERMDSSMDFTETPEDEKSFQLVAGGTSDQLRWLEIDNGPKKPEDAASELAPSEDPSSEEAQSEGVSHEAADEAVAGENAASDNATSVNAPSVKEAASVKAVSTKAVSTKAPSTKAASQKLTLDDATDVDSDEPESYVLQCHDDVNNHLRQINEALSLISIMGPTRSGKSTLLNLLAGCTTEPLFSTSPGAESWTRGTNLGNKIMGVKEFSRLDDGVELPLVGSQRVAFLDTEGHGDQGDLYDIILFTPALLCSRVIVFNTTDVAKDTILTSLAMMTLAAEKLHFGGDKKTSGPKFGQLVIIINKYDLGGSVDDVRKNILRKEIGRTEAIKRRNKIREKLSAEFEDVTVHLLRGNSLKDGVQAKINDKSKEFLVLDDFNDNYVKDFKNLRASLSQMLRVPRLVAGAPLTGASTADFVSSIVKSINRLEQNGQLHVPDIWRAAENEAVNRSHIKFHHDYREACNKLSQDTRLLSTKDCNKKLDRAMQKCLNSVRDSLRYLSQQTIKDTCESLAKESEGQRNEVLAANLQKIEAFAEQELTELISSIQDSLNEAASDFKSFSLNLAEKLLDQYHGDLLEAYKKKISSYDEQALSRNYSVTYDRAFFTAAATVKQNLSVAWASWVVELDTARSEAITAALEQQYRESLIGDESIWETTAEEEQSSHLEQYYNTIDTEYLWENASAIKENYTEKVNKTKDLIKSKVTVREQQMEKSIAQELDKRLNAYQRQLDDSLLPKEDVGDFKSITDTTDSREALIAFLKEQPISGRLYDHHLNEFDNQLSTKKSTYGDRYTSVLKDFLAYLEEELDRVVKTQLEDFKNQSDTLAITRTVSKDRITTHLATCETAAKAAFEASVVNFSVTHEDSKTRVVEARNKLASGISDYHIAKLLLLDALVNKWNRQALNRAINEVMAGVVDFTLDTPEKLEEGIRKAKMAYFGEACGELTKQAETWETFEQRSDTLYENVKRAQAVFKTKGISYESTTSELESKVIHGISRPFADLANLLGMSWISSGSEFQHELHPEGSGRSYLLKNLSKPKGFGNKQCTSLRFDNWRAEFSDFVFDEPIIQELSPFTVKTITVPAQDENTQVNISIKETKTETIVHSNHAMFNAQNEYASTTGTEDAIASTIKSAFNGSDAFTDGKRNEITLDIDYNCPVICPAKRATTVTCSGYTQLKSITYTAKMKLVPEVTFTGGFTRWGGKNNENPNFLRGESRKRVYKDINNGPADQLKDKAAQNADPWDWTEAIEQNPQIQTLVDRISDPQCFEMYVRGKWEGISGWKFVIQTDIKTT

SEQ ID NO: 24605 - protein, 106 aa, Hypocrea atroviridis; identical to SEQ ID NO: 24574
  strain ATCC 20476 / IMI 206040

SEQ ID NO: 24606 - protein, 472 aa, Hypocrea atroviridis
  strain ATCC 20476 / IMI 206040
MAPSGTLPLAAAILALAGIVTAQQPGTSTPEVHPKLTTYQCTTSGGCVAQDTSVVLDWNYRWMHDANYNSCTVNGGVNTTICPDEATCGTNCFIEGVNYTASGVTTSGSSLTMNQYMPATTGGYSSVSPRLYLLGADGNYVLLQLNGKELSFDVDLSALPCGENGSLYLSQMADNGGANQYNTAGANYGSGYCDAQCPVQTWKNGTLNTNHSGYCCNEMDILEGNSEANALTPHSCTATACDSSGCGLNPYASGFHSYYGPGLTVDTSKPFTITTQFNTDNGSPSGNLVSITRKYIQNGVSIPSAQSGGDIISSCPSASAYGGLTTMGKALTSGMVLIFSIWNDSGGYMNWLDSGSSGPCSSTEGNPSTILANNPGTHVTFSNIKWGDIGSTTSGGSSPPPPPASSTTLRTSTTTSKTSTAPPSCTQTHWGQCGGNGYTGCKTCASGTTCQYSNDCEYSMNISKRRFRILIM

SEQ ID NO: 24607 - protein, 507 aa, Hypocrea atroviridis
  strain ATCC 20476 / IMI 206040
MYQKLAAISALLAAARAQQVCTTQAETHPALSWSKCTSGGSCTTQAGKVVLDANWRWTHAYPSGNNCYNGNTWDATLCPDDATCAKNCCLEGADYSGTYGVTTSGNQLTIDFVTQSANKNVGARLYLMASDTAYEEFTLLNNEFSFDVDVSALPCGLNGALYFVSMDADGGASKYPTNLAGAKYGTGYCDSQCPRDLKFISGQANVEGWQPSSNNANTGIGGHGSCCSEMDIWEANSISQALTPHPCETVGQVTCSGDDCGGTYSNNRYGGTCDPDGCDWNPYRLGNHTFYGPGSGFTVDTTKKITVVTQFSSTGINRYYVQNGVKFVQPNASGLSGYTGNTINSAYCSAEQTAFGGTSFTDKGGLTQMNKALSGGMVLVLSLWDDYAANMLWLDSTYPTNDTASTPGAARGTCSTSSGVPATVEQQSPNSKVVFSNIKFGPIGSTGSNSTTGTPTGGGGGPTSTGSSTGATQTHYGQCGGTGYSGPTQCASGTTCQVLNQYYSQCL

SEQ ID NO: 24608 - protein, 493 aa, Hypocrea atroviridis
  strain ATCC 20476 / IMI 206040
MLRKLSLLALAGLVSHSVQQSCAALYGQCGGSGWSGATCCVSGAQCSALNQYYSQCVPSTGSSGPTGSSSSTTSIPHSQSSSASHSSGGQSSVGQSTGVSTYTTTDTSTVALHSQSPYPSIAASSCGAWTLVDNVCCPSYCATDDTSESCTCSDCTTPPSADCKSGTMYPEVHTVSTNETWHYSRSTHFGLTSGGACGFGLYGLCTKGSVTASWTDPMLGTTCDAFCTAYPLLCKDPAGTTLRGNFAAPNGDYYTQFWPSLPGDLDNYLSCGECIELIQTKPDGTDYAVGEAGYTDPITLEIVDSCPCSANSKWCCGPGADHCGEIDFKYGCPLPADSMHLDLSDIAMGRLQGNGSLTNGVIPTRYRRVQCPKLGNVYIWLRNGGGPYYFALTAVNANGPGSVTKIEVRGAGSSTWIPLVHDPNYTSSRPQERYGSWVIPQGSGPFNLPVAVRLTSPTGEQIVNEQAIKTFTPPSTADPNFYYIDIGVQFSKN

SEQ ID NO: 24609 - protein, 382 aa, Hypocrea atroviridis
  strain ATCC 20476 / IMI 206040
MNKCGRKLWAGLALLALPAIASASCALPSTYKWTSTGPLANPKSGWVSLKDFSQVPYNGQHLVYSSTVNAAGSYGSMNFGLVSNWTSLSTASQNTMNLGTVAPTLFYFSPKKIWVLAYEWAATPFAYVTSSDPTNANGWSSSQPLFSGSISPSSPIDPALISDGTNMYLFFAGDNGSIYRSSMPIDQFPSSFGTSYTTVMSAATNDLFEAIQVYTVSGQNQYLMIVECIGSVGRYFRSFTATSLSGTWTPQAATESNPFAGHANSGTTWTNDISSGDLIRSTNDETMTIDPCNLQLLYQGMAVGSSGDYNSLPWRPAVLTLANPGSSTGNGTGSGGSGGSGSGEASQYAQCGGLGYAGPTVCQARQSPYKCTYVNEYYSQCI

SEQ ID NO: 24610 - protein, 344 aa, Hypocrea atroviridis
  strain ATCC 20476 / IMI 206040
MKSAFLLATGAILAAAMPLDKRALETQWVTDIVTVTVTVDPSAPSSAGGVFIQAVSSQPAATPSPQVQAPAPKPVYAAPPPAVSSPKPAPPPPPPSPAPAAPQISTVIVVETPKSSPAPAPSPEVAVKSSPKPSPKPSPSPVAAAPKPAASSPAASSSSSSSSSSSSSSSGSNDYQSAMLNEHNIHRANHSAPALEWDDQLAGFAQITASGCVFAHDMTEGGGSVSYGQNLASFGSSGDISGDQILSGRRGVTDQWYNDEMENWTFYGQSNPPSGLDLDAFGHFTQVVWKGSTKVGCATVQCPSGSVLSLPSWYTVCNYGPPGNFGGEYGDNVLEPLGQAPVTV

SEQ ID NO: 24611 - protein, 783 aa, Hypocrea atroviridis
  strain ATCC 20476 / IMI 206040
MKLNSVAGLVAATAGVVQATASSDDSLAIFAKRRTADLAQFPDPTWFSKIDSWLSSQKADGTWSDVNYLSGCPAQRANWPIQEHWNRLITLGAAWSGTNPAVSSSQAKDPKLLAAVQKGLNYLFSNDYTSADCMGDGGDATKGCPCGTPGLWNTNWYDQAILIPQLCSTACLLVKDANLTETQRAGCERIPNRAYALRDGTYGTGGKMTGANVVLIMQNSVTLALFTDNSTILADSMTRAMAEMTFTDTPGADGIHRDGTFLQHDGVLYNGNYGKDLLNAFIQLESEAIGTSFAADNDTRAAMSTYVKGDEWLIYTDSQTKTEHWDFNAIGRFVSFPTVDLQASADINFNVSKLAAATADFQGQYAVNDTIRRLLSNGTQKLTGNRGFWASDYMVHRRSNFMLTNKMISTRSANSESVNGANPYAYHMGHGTLYSYVKGNEYKDIMGAWDWNLVPGTTTLLNQPKLQASQVKYYGLKDFVGVVSDGAFGAAVEDYVDPLTQNLSYRKSWFYVDEGVIVITTDIKKNATAGNTPVVTVLDNRAADSTRALVKSGFVGQQGEQHLTTDTLYYANNGYLAYDTPFQLTLSQGKRSGNWSEISTSTQGVETVDIFSAYTTIKGNSFTYGFFPSISSVKLLKELVDPTWIPITKNGISGIYGKGRASLAFWPGGAKSVKLDLRELGWSSKAETLTFTSDQPALYLLSAQKKDKKGLHLTVTLADPTQKLAAASYSIKLSGQRYKVREVDGRSEGLEKRGDGSIGFGVKLPAGGLAGSSISSEVVLELN

SEQ ID NO: 24612 - protein, 438 aa, Hypocrea atroviridis
  strain ATCC 20476 / IMI 206040
MKFLKSQALALLAATSVLATPLQSVSPRASSYVTVSGLQFNIDGKTGYFAGTNCYWCSFLTNHADIDTTFGHMASSGLKIVRIWGFNDVNQQPGTGNIWFQLLSASGSTINTGSTGLGNLDYVVQSAETNGLKLIINFVNNWNDYGGINAYVNAFGGNATSWYTNTAAQAQYRKYIQAVVSRYTNSTAIFAWELANEPRCNGCATSVVWNWASSVSQYIKSLDSNHLVTLGDEGLGLATGSDGSYPYTYGEGTDFASYMNITTLDFSTLHLYPNSWGEAYDWGSSWIETHAQACVASGKPCMLEEYGATTNHCAIESPWQQTALASKGMAADLLWQWGDTLSNGQSSDDGNTVYYGTSDFTCLVTDHVAAINGGTPPPPASSTTTSKATSTSKPPSGPTGSCSPLYGQCGGTGWSGATCCSSGTCKYSNPYYSQCLSS

SEQ ID NO: 24613 - protein, 422 aa, Hypocrea atroviridis
  strain ATCC 20476 / IMI 206040
MINNKAALLFAAYAGVSGVAAQQQTTWGQCGGQGYSGPTSCVSGAACSTINPYYAQCIPATGIITSTTTRATSATSTLKSTTASASSTPPPSNGSGTQFAGINIAGFDFSCSTDGTCNVSGAYPPLKNYDGANNYPDGVGQMQHFVKDDGFNIFRLPVGWQYLVNATLGATLNPTNLGYYDQLVQGCLDTGAYCIIDIHNYARWNTGIIGQGGPTNAQFVNLWTQIATKYASEPKIWFGVMNEPHDVNITTWAATVQLVVTAIRNAGATSQYISLPGTDWQSAGSIITDGGVAALGAITNPDGSKTNLIFDVHKYLDSDNSGTNSVCVTDNIDSAFAPLATWLRSNNRKAILTETGGGNTPSCEQYLCQQIQYLNQNADVYMGYVGWAAGSFDPGYPLAETPVQNADGSWTDQPLVSLCLAR

SEQ ID NO: 24614 - protein, 638 aa, Hypocrea atroviridis
  strain ATCC 20476 / IMI 206040
MKSAILLGLTGLAAHVNAHPTKQPENGNSLAKRGVDISKYHLPSLSQYTPSPNIEEEASLQALAYKRNYVDTATRAVKKVAPKAEFRVVDDHYIDVDGIGHVHFKQTVHGIDIDNADFKVNIGKDGRVFSHGNSFFSGKLPQESPLGKRDFSDPTNALKGAIDILGLPVQADGATAQAEEGTEKYTLKGTSGAVSDPKAHLVYLVKGDGTLALTWRVETDIMDNWLLTYVDATTNEEIHGVVDYVSDFATFQVYPWGLNDPTEGDRKVLTDPWRTDASPFTWVGDGTTNYTVTRGNNAIAQDNPSGGDSYLNNHRPSSSTRDFQYPFTLTQTNPTDYRDAAITQLFYTVNKYHDLLYVLGFNEVAGNFQTNNNGKGGKGNDLVIVNAQDGSGTNNANFATPVDGSSGRMRMYIWTTANPKRDGDLEAGIVIHEYTHGLSTRLTGGPANSGCLNGVEAGGMGEGWGDFYATAIRLKAGDTRNTDYPMGVWADNNVKGIRQYPYSTSLTTNPLTYKSVNAQNEVHAAGTTWATILYEVLWNLIDKYGKNDADFPTFDSQGVPTDGKYLALKLVLNGLALQPCTPTFVSARDAILDADRALTGGENLCELWTGFAKRGLGSGAKYASTSRTESYTIPSGVC

SEQ ID NO: 24615 - protein, 628 aa, Hypocrea atroviridis
  strain ATCC 20476 / IMI 206040
MPTAVRICVCGDESTGKSSLIASLVKDQFMTNKIQPVLPQISIPPSIGTPENVTTTIVDTSARPQDRTTLRKEIRKCNVILLVYADHYSYERVALFWMPYFRSLGVNVPVVLCANKSDLVGQSSTSQVVEEEMLPVMAEFREIDSCIRTSAREHRNVNEVFFLCQKAVTHPIAPLFDYKEGHLKPACVDALKRIFYLCDKNQDGYLDNQEMRDFQSRCFDKPLTDDELENIKLSLSKALRGADLSKGIDLRSFLQLNKMYAEKGRHETIWIILRKYHHTDSLSLEENFLHPKFEVPEFCSAELSPAGYRFFVDLFLLFDKDNDGGLNDEELEALFAPTPGLPPSWSDSAFPSSTVRNEGGYITLQGWLAQWSMTTFLEPKTTLEYLAYLGFEPPNPKDPITSALKVTKPRKRRRRPGRVERNVFHCYILGASGAGKSSLLDAFLNRTFDGLYHPTIKPRRAVNSVELPGGKQVYLIFEELGELEPAILENQAKLDACDLLCYAYDSSDPDSFSHIVDIRKKHPQLDELPSVYTALKADRDKTMQRSELQPDQYTSSLNMSSPLHVSVTWNSISELFVALAEAAANPSIAFPKSDDDMIDRTSLYLTLGATACAAIAAVMIWRRSTNAL

SEQ ID NO: 24616 - protein, 152 aa, Hypocrea atroviridis
  strain ATCC 20476 / IMI 206040
MRFNSFIALAAATAQSAAGLGINCEGDSLCGISYLAGGRLTQFQSIFDNIFEKRIWDNGDDIGCVEMTHLNFQGSFKGVYCAYIQNLDGSVDGATLKSLYTELIEYGCGICGSIPIHYAKGDNDVNHGELSFNMVDSLPENCELNQPCKIPN

SEQ ID NO: 24617 - protein, 444 aa, Hypocrea atroviridis
  strain ATCC 20476 / IMI 206040
MAIFRKLVLWGALLLSVYPIDAHKTILERPKLQWGPKTPGRPFPHSPHRHKTCHVPSSSHSNNHKDIDSAPEIFKAFKQCNRGGRVVLDGTYTIASPLDLTFLEAVDVVLTGTIKFSDNIDYWVQNSFKYAFQNSSAFWRFGGKDVNIYGGGHGLLDGNGQAWYDAFATNPTLLRPILFVLDGLNAGSVTGLKMRNSPDWFNLVANSTDILVSDIDIAVRSESSNPAKNGDGWDTFRSNRVVIQNSHVNNSDDCVSFKPNSTNIIVQGLQCNGSHGISVGSLGQYPAEYDIVENVYVYNISMSNASDGARIKVWPGTDTPFQPGLSGGGGAGYVKNITYDTFYNDNNDWAIEINQCYGQSNQTICDKYPSNVTISDVLFKNMWGTTSSKYDPDVGTLTCSSPEKCVNIAAQNISVANPSGNTPQWICTNMDDGLLDINCVSASS

SEQ ID NO: 24618 - protein, 839 aa, Hypocrea atroviridis
  strain ATCC 20476 / IMI 206040
MKYASALALLLGAAIPVQAAFTWKNVKFGGGGGFIPGIIFHPKTKGVAYARADIGGLYRLNSDDSWTAITDGIATDAGWHNWGIDAVALDPQNDEKIYAAVGMYTNSWDPNNGAIIRSSDRGATWTFSNLTFKVGGNMPGRGNGERLAVDPANSNIIYFGARSGNGLWKSTDGGVTFSKVASFTDTGPFVPDPSDTTGYNSDKQGLLWVTFDSTSGTTGGATSRIFVGTADNITASVYVSTNAGSTWSAVPGQPGRYFPHKAKLQPAEKALYLTYSDGTGPYDGTSGSVWRYDITAGTWKDITPVSGSDLYFGFGGLGLDLQKPGTLVVASLNSWWPDAQLFRSTDSGTTWSPLWAWASYPDMTYYYSISTPLAPWIKNDFIDVTSETPPGSLIKRLGWMIESLEIDPLDSNHWLYGTGMTIFGGHDLTKWDTIHNVTIQSLADGIEETSVQGLASAPGGSELLAAVGDDNGYTFTSANSLGTSPQNVWSTPTWATSSSVDFAGNSVKNVVRVGNTAGTQQVAISSDGGVTWNIDYGADTNMNGGTVAYSANADTILWSTGSTGVQRSQYQGSFTSVSSLPATAVIAADKKTNSLFYAGYASTFYVSNNTGSSFTAGPKLGSTTSVRDIIAHPTTAGTLYVSTDAGIFRSTDSGTTFTQVSTALTNTYQIALGLGSGSNWNLYAFGTGSAGNRLYASADNGATWTDIQGSAQGFGAIDGAKLAGSGSVAGQVYVGTNGRGVFYAQGTVSGGTGGSSSSSTKASSTTIARSSTTLTSSNVSTTRTSTVTSSTRTTSSSSPTGSGLAQHYAQCGGVGWTGPTQCVSPYTCQAQNDYYSQCV

SEQ ID NO: 24619 - protein, 405 aa, Hypocrea atroviridis
  strain ATCC 20476 / IMI 206040
MDKCRALIFAIVAVNGATVTISQPPTQVVKRGSSCTPVAGHSSSIDDAPAIQSAIASCPSGTIVIPKSTTYYINTAFSFVGCSGCTLQIEGTLQATSNTTYWGGRRAIFLMDGINGATVYSATGTGIVDGNGQAAWDLFAANSSYQRPTLFYINNSKNVKLSNLYFKSAPNVFHSVTGGSSNVSYSNISLYAVSSSANVAHNTDGWDIGQSTYVTIDGATVTNDDDCVALKPGCSFATVTNISCTGSHGISVGSLGSGVNSKDTVQNCLISGATMINSAKAAGLKLYPGPPDHGTAVVSNVTFENFILQNTDYAFQVQSCYGEDSSYCETNPSTAQIAGVVVRNFSGTTSTHYSPNIANIDCPAAGTCGLTLSNITVTPPKGSAVIQCANTPSNLGVPCASGASG

SEQ ID NO: 24620 - protein, 217 aa, Hypocrea atroviridis; identical to SEQ ID NO: 24579
  strain ATCC 20476 / IMI 206040

SEQ ID NO: 24621 - protein, 98 aa, Hypocrea atroviridis; identical to SEQ ID NO: 24573
  strain ATCC 20476 / IMI 206040

SEQ ID NO: 24622 - protein, 89 aa, Hypocrea atroviridis; identical to SEQ ID NO: 24572
  strain ATCC 20476 / IMI 206040

SEQ ID NO: 24623 - protein, 247 aa, Hypocrea atroviridis
  strain ATCC 20476 / IMI 206040
MRSAAIFTALLAGQAFAYPKPVIQSTSKRDWPSINAFLTEIAKIMPIGDTVTAACDLIGDGEDIAADLFGISETENEACGDVTVLFARGTCDPGNVGVLVGPFFFESLQNALGSTSLGVQGFNYPASVQGFLSGAVQPGIDLATQITSVTQSCPNTKLVVGGYSQGSLVVHNAVGHLDAATASKISAVVLFGDPRDGQALPNIAASKVLTVCHDGDNICAGGDIILLPHLTYAEDADTAAAFVASLV

SEQ ID NO: 24624 - protein, 100 aa, Hypocrea atroviridis; identical to SEQ ID NO: 24570
  strain ATCC 20476 / IMI 206040

SEQ ID NO: 24625 - protein, 360 aa, Hypocrea atroviridis
  strain ATCC 20476 / IMI 206040
MPSFGFFLAMLVATAAAKPVSIDPRASCTFTDAATAIKQKTSCSTITLNGVAVPAGQTLDLTGLKDNTNVIFAGKTTFGYKEWDGPLISISGKGIQVQGASGHTIDCAGQRWWDGKGSNGGKTKPKFFSAHKLTNSNIKSLNVLNTPVQAFSINSVTDLGLYNINMDNSLGDTEGGHNTDAFDVGSSTGVYISGAIVKNQDDCLAINSGTNITFTGGNCSGGHGLSIGSVGGRSDNTVKTVRILDSKISNSQNGVRIKTVSGATGSVSDIVYDNISLSNIGSYGIVIEQDYKNGGPTGTPTAGVPITGLTVNKVVGTVQKSGINAYILCAACSNWTWTNNAVTGGTKTKTNKGIPKGVSI

SEQ ID NO: 24626 - protein, 296 aa, Hypocrea atroviridis
  strain ATCC 20476 / IMI 206040
MPSMKSSLALLLAQALLATNQANGAIVKRQCPGIHVFGARETTVSAGYGSSATVVNLIIAAHPGTTSEALNYPACGGQASCGGVQYNASVVAGINAAVTAIDNFHTSCPDTQLVLVGYSQGGQVYDDVVCGGGDPGEGYSNTAVPISASAAAAIKAVILMGDPRNIAGLPYNVGTCKAGGFDAHNAGFQCAAASKVQSYCDAADPYCCNGNDPNTHQGYGTEYGSQALAFVNSKLSGGGGSGPTSTPPSGPTSTGSSPTATQTHYGQCGGIGYSGPTQCGGGYTCQVLNSYYSQCL

SEQ ID NO: 24627 - protein, 182 aa, Hypocrea atroviridis; identical to SEQ ID NO: 24575
  strain ATCC 20476 / IMI 206040

SEQ ID NO: 24628 - protein, 86 aa, Hypocrea atroviridis; identical to SEQ ID NO: 24576
  strain ATCC 20476 / IMI 206040

SEQ ID NO: 24629 - protein, 88 aa, Hypocrea atroviridis
  strain ATCC 20476 / IMI 206040
MQFSIVAIFATGAFAAICPTGLYSNPLCCGSGILGVVFLDCEAPKAQVSDSMSFQNACAAVGLQPLCCAAPTVSIPKSISDISLGGLC

SEQ ID NO: 24630 - protein, 457 aa, Hypocrea atroviridis
  strain ATCC 20476 / IMI 206040
MTMQVLKILVLAVPILAQSQVWGQCGGIGWTGPTTCVAGATCVVNNPYYSQCIPNGQASSATTAATTTTFATSTTKTSTPVSGSQTSTSAATCSALPASISLKSNSKLNDLFTLFNGDKVTTKAQFACRQAEISQLVQRYELGTLPGRPATLTASFSGNTLTINCGDSGKSMSFSVTITYPSSGSAPYPAIIAYGGGSLPAPAGVAMINFNNDDMAAQVNTGSRGQGKFYTLYGSGHSAGAMTAWAWGVSRVIDALEQVTAARIDTTRIGVTGCSRNGKGALLAGAFDSRIALTLPQESGAGGSACWRISDYLKSQGANIQTASEIIGEDPWFSTSFNSYVNQVPVLPFDHHSLAALIAPRGLFVIDNNIDWLGPQSCFGCMTAAHTAWQALGASDHMGYSQIGAHAHCAFPSNQQSQLTAFVQKFLLGQSTNTAIFQSDFTFSQSQWIDWTVPTLT

SEQ ID NO: 24631 - protein, 411 aa, Hypocrea jecorina
MFFTKAVGGLGLLASLASSAPNPIARRQAPGAQNVVYWGQNGGGTVENNDLSAYCTPTSGIDIIVLSFLYQWGQGSSALGGTIGQSCGITTSGEPQNCDALTAAITKCKTAGVKIILSLGGASAFSSFQTADQAAQAGQYLWNAYGGGSGVTRPLGNNVMDGFDLDIESNPGTNENYAALVSALRSNFASDPSRQYVISGAPQCPLPEPNMGVIIQNAQFDYLWVQFYNNNEYPGDPCSLGLPGDAPFNFNNWTTFIQSTPSKDAKVFVGVPAAPLAANGAPSGEVYYATPSQLADIVNDVKSNPAFGGIMMWSAGFSDTNVNDGCNYAQEAKNILLTGSPCSSGPVSVSRPPVSSPTITSSPPGTSPAPPSQTGSVPQWGQCGGNGYTGPTQCVAPFKCVATSEWWSQCE

SEQ ID NO: 24632 - protein, 401 aa, Hypocrea jecorina
MLSRTLLTALGLTTIAAAAPSQTVKTRQAPGGQNAVYWGATNNENDNLSTYCTASSGIDIVILSFLDIYGATGNFPSGNMGNSCYVGTNGVPQLCDDLASSIATCQAAGIKVIISLGGAASSYSLQSQSQAVAIGQYLWNAYGNSGNTTVQRPFGNVFVNGFDFDIELNAGSQYYQYLISTLRSNFANDPKNTYYITGAPQCPIPEPNMGEIISTSQFDYLWVQFYNNNPVCSLGLPGDAPFNFNDWVSFISTTPSKNAKLFVGAPASTLGANGNAGGAKYYATPEQLAGIVNSVKSSPFFGGIMLWDAGYSDSNVNNGCNYAQEAKNILLTGTACGGESSPPPSTTTTAVPPPASSTPSNPSGGSVPQWGQCGGDGYTGPTQCVAPYKCVATSEWWSSCQ

SEQ ID NO: 24633 - protein, 392 aa, Hypocrea jecorina
MPSISSFTSALGLLSLLPAARAGWNQNSNDNIVVYWGQNSGSVGQNRLSYYCQNAPDVDVINISFMVGITNLNLNLANVGNNCTAFPQAPNLLNCPQVAADIIECQQTYGKTIMMSLFGSTYSESGFSSSSAAVAAAQEIWAMYGPVQSGNSTPRPFGDAVVDGFDFDLEDPIENNMEPFAAELRSLIDASTSKKFYLSAAPQCPYPDVSDESFLDGQVPFDWVNVQFYNNGCGVSHYPADFNWATWDNWAKTVSANKNAKVLIGTPANVGGANAGSFPTDSQLSGAISLAKGSSSFGGVMLWDMAQLFTNQGYLAKIVADLGSASSPPPPASTTLQTITRSSTASTGPTNPPSGGSVPQWGQCGGNGYTGPTQCQAPYKCVATSEWWSSCQ

SEQ ID NO: 24634 - protein, 471 aa, Hypocrea jecorina
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVTGTGFGIRPSANTGDSLLDSFVWVKPGGECDGTSDSSAPRFDSHCALPDALQPAPQAGAWFQAYFVQLLTNANPSFL

SEQ ID NO: 24635 - protein, 459 aa, Hypocrea jecorina
MAPSVTLPLTTAILAIARLVAAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFSPYGSGYKSYYGPGDTVDTSKTFTIITQFNTDNGSPSGNLVSITRKYQQNGVDVPSAQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQCL

SEQ ID NO: 24636 - protein, 344 aa, Hypocrea jecorina
MIQKLSNLLVTALAVATGVVGHGHINDIVINGVWYQAYDPTTFPYESNPPIVVGWTAADLDNGFVSPDAYQNPDIICHKNATNAKGHASVKAGDTILFQWVPVPWPHPGPIVDYLANCNGDCETVDKTTLEFFKIDGVGLLSGGDPGTWASDVLISNNNTWVVKIPDNLAPGNYVLRHEIIALHSAGQANGAQNYPQCFNIAVSGSGSLQPSGVLGTDLYHATDPGVLINIYTSPLNYIIPGPTVVSGLPTSVAQGSSAATATASATVPGGGSGPTSRTTTTARTTQASSRPSSTPPATTSAPAGGPTQTLYGQCGGSGYSGPTRCAPPATCSTLNPYYAQCLN

SEQ ID NO: 24637 - protein, 459 aa, Hypocrea jecorina
MAPSVTLPLTTAILAIARLVAAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFNPYGSGYKSYYGPGDTVDTSKTFTIITQFNTDNGSPSGNLVSITRKYQQNGVDIPSAQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQCL

SEQ ID NO: 24638 - protein, 418 aa, Hypocrea jecorina
MNKSVAPLLLAASILYGGAVAQQTVWGQCGGIGWSGPTNCAPGSACSTLNPYYAQCIPGATTITTSTRPPSGPTTTTRATSTSSSTPPTSSGVRFAGVNIAGFDFGCTTDGTCVTSKVYPPLKNFTGSNNYPDGIGQMQHFVNEDGMTIFRLPVGWQYLVNNNLGGNLDSTSISKYDQLVQGCLSLGAYCIVDIHNYARWNGGIIGQGGPTNAQFTSLWSQLASKYASQSRVWFGIMNEPHDVNINTWAATVQEVVTAIRNAGATSQFISLPGNDWQSAGAFISDGSAAALSQVTNPDGSTTNLIFDVHKYLDSDNSGTHAECTTNNIDGAFSPLATWLRQNNRQAILTETGGGNVQSCIQDMCQQIQYLNQNSDVYLGYVGWGAGSFDSTYVLTETPTSSGNSWTDTSLVSSCLARK

SEQ ID NO: 24639 - protein, 471 aa, Hypocrea jecorina
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 24640 - protein, 242 aa, Hypocrea jecorina
MKATLVLGSLIVGAVSAYKATTTRYYDGQEGACGCGSSSGAFPWQLGIGNGVYTAAGSQALFDTAGASWCGAGCGKCYQLTSTGQAPCSSCGTGGAAGQSIIVMVTNLCPNNGNAQWCPVVGGTNQYGYSYHFDIMAQNEIFGDNVVVDFEPIACPGQAASDWGTCLCVGQQETDPTPVLGNDTGSTPPGSSPPATSSSPPSGGGQQTLYGQCGGAGWTGPTTCQAPGTCKVQNQWYSQCLP

SEQ ID NO: 24641 - protein, 97 aa, Hypocrea jecorina
MKFFAIAALFAAAAVAQPLEDRSNGNGNVCPPGLFSNPQCCATQVLGLIGLDCKVPSQNVYDGTDFRNVCAKTGAQPLCCVAPVAGQALLCQTAVGA

SEQ ID NO: 24642 - protein, 513 aa, Hypocrea jecorina
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNRGTTTTRRPATTTGSSPGPTQSHYGQCGGIGYSGPTVCASGTTCQVLNPYYSQCL

SEQ ID NO: 24643 - protein, 86 aa, Hypocrea jecorina
MQFFAVALFATSALAAVCPTGLFSNPLCCATNVLDLIGVDCKTPTIAVDTGAIFQAHCASKGSKPLCCVAPVADQALLCQKAIGTF

SEQ ID NO: 24644 - protein, 418 aa, Hypocrea jecorina
MNKSVAPLLLAASILYGGAVAQQTVWGQCGGIGWSGPTNCAPGSACSTLNPYYAQCIPGATTITTSTRPPSGPTTTTRATSTSSSTPPTSSGVRFAGVNIAGFDFGCTTDGTCVTSKVYPPLKNFTGSNNYPDGIGQMQHFVNEDGMTIFRLPVGWQYLVNNNLGGNLDSTSISKYDQLVQGCLSLGAYCIVDIHNYARWNGGIIGQGGPTNAQFTSLWSQLASKYASQSRVWFGIMNEPHDVNINTWAATVQEVVTAIRNAGATSQFISLPGNDWQSAGAFISDGSAAALSQVTNPDGSTTNLIFDVHKYLDSDNSGTHAECTTNNIDGAFSPLATWLRQNNRQAILTETGGGNVQSCIQDMCQQIQYLNQNSDVYLGYVGWGAGSFDSTYVLTETPTGSGNSWTDTSLVSSCLARK

SEQ ID NO: 24645 - protein, 892 aa, Hypocrea jecorina
MLANAIAALLLGSGIASAAGHGSPLTSKAGHRAVIPDWDLKSSSDVSKDLGGLSKPGVDTSSWYHAGTSRCTIMGCLINAGVYNDEELWYSDNLNHVNWGQFSVPWVYRHEFALSPAKGKHFLLQTNGITSKADLFFNGKQIADKEYQSGAYAGRTYDITNLAAKKNALLVQVYPTDYLYDFALGYVDWNPYPSDNGSGIWRDITIKETGSVSMGPVSVLVDIDVPVEKNPARVTVRAEAQNLESHAVEFNAAAVISGNSCSGEALKQTIKLAPGEKKLVQFTQTIKTPSIWWPKQWGDQPLYTAEVTFSVKGAVSDTAQTKFGVRKVTSFVNQFNDTQYSVNGHPFQVIGGGYGADMFLRWDSERFTRIVEYMLDMHQNTIRLEGKMEHPELYEICDEYGLMVMPGWECCDKWEAWAYNDELAIFPPPVWDANDYETANYSMIHEAAMMQPHPSVLTFLVGSDFWPNDEAVVLYANALKNAGWQTPIIASASKRGFPALLGPGGMKMDGPYDWVPPNYWYDVEPSEDRLGAAFGFGSELGAGVGTPELSSLRRFLNQSDLDDLWKNPNKNLFHMSTNASSFYNRKIYNQGLWKRYGAPTSLDDYLLKAQMMDYEATRAQYEGFGALWTASRPATGVIYWMLNNAWPSLHWNQFDYYLHPAGSYFGTKVGSRIEHVAYNYQKKEIWVINHSLYQTGSRNIKVELIDMNGKQIAKKLVQVRTKANSGFKAMDISSDINKLSSVAFLRLVLSDEKGSVLSRNVYWVTKTIDELNWDESTWYYTPVSKFVDYTPLNTLATAQVSVTTSGGKHLPGIPGSQTRTVTLENKSSVPAVFIRLTLVDSKGNDVNPVSWSDNYVTLWPHEKLQLEVGGWDGSGDKIQISGKNIKATTVKL

SEQ ID NO: 24646 - protein, 459 aa, Hypocrea jecorina
MAPSVTLPLTTAILAIARLVAAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGGGYCDAQCPVQTWRNGTLNTSHQGFCCNEMDILEGNSRANALTPHSCTATACDSAGCGFNPYGSGYKSYYGPGDTVDTSKTFTIITQFNTDNGSPSGNLVSITRKYQQNGVDIPSTQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQCL

SEQ ID NO: 24647 - protein, 316 aa, Hypocrea jecorina
MVRRTALLALGALSTLSMAQISDDFESGWDQTKWPISAPDCNQGGTVSLDTTVAHSGSNSMKVVGGPNGYCGHIFFGTTQVPTGDVYVRAWIRLQTALGSNHVTFIIMPDTAQGGKHLRIGGQSQVLDYNRESDDATLPDLSPNGIASTVTLPTGAFQCFEYHLGTDGTIETWLNGSLIPGMTVGPGVDNPNDAGWTRASYIPEITGVNFGWEAYSGDVNTVWFDDISIASTRVGCGPGSPGGPGSSTTGRSSTSGPTSTSRPSTTIPPPTSRTTTATGPTQTHYGQCGGIGYSGPTVCASGTTCQVLNPYYSQCL

SEQ ID NO: 24648 - protein, 624 aa, Hypocrea jecorina
MSPSAAVLIPLAAAVLLRPVVGQTQCGGNLYTPGTLNFTLECYNAFQDCVAQFEANASQVDCNDGKGNLFMQQQANLGASPGSQNNDAIIAFQDIRDLCLLSGSTTATWGYSDNQWYWAAAEDACYTNDPTRTDVVKTHPAPFCIQNRDSSLPECYPQPDATPPGGPLKVIKTAKTRNGFKSSARGWNTYGVQALVNGSQVVPSFAGQSGLFYTQKFVETQCGVLARPEFKKAGYDLCSLDSGWQATTAVDQHGRIIYNTTRFNLPELASWLHKRDLKLGVYITPGVPCLAHNQTILGTNIKIKDVLNGNNDQINCDFDFRKDGVQQWHDSVVAQWASWGVDMLKLDFLTPGSPSNGANLACDSSDAVRAYQKAIKKSGRKIRLDISWKLCRNETWLPIWSDLAESMRTDQDLDNYGTNTLMAWQVGQRAIENYRQYIGLQAQRNVPLTIYPDMDALFTVNPEHLAGVNDTIRYTVQNHWLGAGANLIIGGDMEQVDALGLKLTTSKQSIDAADFFAKYPMQPRNPGTGSNAAKQLQAWIGGPSDDHEAYVLIVNYGPDLGNGGFSTKLYGKQKVTVSLKDLGISGSAWTFTDIWSGKSSRVTGSYSAWLTEGESQLLRLKRTH

SEQ ID NO: 24649 - protein, 746 aa, Hypocrea jecorina
MLGAPSPRRLADVLAVTAGLVASVRAASPISVSGKSFALNGDNVSYRFHVDDDSKDLIGDHFGGPATEDGVFPPIIGPIQGWVDLIGRQRREFPDLGRGDFRTPAVHIRQAAGYTVSDFQYKSHRVVEGKPALRGLPSTFGDAGDVSTLVVHMYDNYSSVAADLTYSIFPKYDAIVRSVNITNMGKGNITIEKLASLSVDLPYEDFDMLELKGDWAREGKRLRRKVDYGSQGFGSTTGYSSHLHNPFFSLITPTTTESQGEAWGFSLVYTGSFSVEVEKGSQGLTRAAIGVNPYQLSWPLGPGETFSSPEAVAVFSTTGVGGMSRKFHNLYRKHLIKSKFATQMHPVLLNSWEGLGFDYNDTTILHLAQESADLGIKLFVLDDGWFGVKHPRVSDNAGLGDWEANPKRFPQGLPDFISDVTKLKVANSSDHLQFGLWFEPEMVNPNSTLYMEHPDWAIHAGSYPRTLTRNQLVLNVALPEVQDFIIESLSNILSNASISYVKWDNNRGIHEAPYPGLDYAYMLGLYRVFDTLSSKFPNVRWEGCASGGGRFDPGVLQYFPHIWTSDDTDAVERIAIQFGTSLVYPPSAMGAHVSAVPNGQTQRTTSIAFRAHVAMMGGSFGFELTPAEMPEDDKAQIPGIIALAEKVNPIVVKGDMWRLSLPEESNWPAALFISQDGSQAVLFYFQIRANINNAWPVLRLQGLDASAKYKIDGNQTFSGATLMNIGLQYQFNGDYDSKVVFLEKQT

SEQ ID NO: 24650 - protein, 847 aa, Hypocrea jecorina
MVIRSLLLLLLAAIVPVFAESGIDAWLRYARLPSSATRGHLTSFPDRIVVLNASKNGPLASASSELHKGIKGILGLDLDVSSRGGKHCSTQKSIVISTLDTYQSACGKLSPKLNLKEDGYWLSTKGGSVQIIGQNERGALYGAFQYLSYLGQGDFSGKAFASNPSAPVRWSNQWDNLNAATAAHGSIERGYGGPSIFFENGLIKEDLSRVPLYGRLLASVGLNGIVINNVNADANLLNETNLQGLKRIADLFRPWGVNVGISLNFASPQVLGDLSTFDPLDDSVIKWWTDKTDRIYQLVPDLAGYLVKANSEGQPGPLTYNRTLAEGANLFAKAVQPHGGIVVFRAFVYDQLNETDWKADRANAAVDFFKSLDGQFDDNVLVQIKYGPIDFQVREPASPLFANLPKTAVSIELEVTQEYLGQQSHLVYLPPLWQTVLGFDMRYNNRQSYVRDIISGEVFGHKLGGYAGVINVGMDDTWLGSHLAMSNMFAYGRLAWNPRADSRDIVEEWTRLTFGLDRDVVSTIADMSLKSWPAYEGYSGNLGIQTLTDILYTHYGANPASQDNNGWGQWTRADSKTIGMDRTVSNGTGNAGQYPKEVAARFEHTQTTPDDLMLWFHHVPYTFRLHSGKSVIQHFYDAHYTGAATVQRFPAAWKSLKSKIDTERYNAVLYKLQYQTGHSLVWRDAITEFYRNLSSIPDQLNRVRNHPHRIEAEDMDLSGFTVVNVSPTECASKYKAIATNGTGTATTRLNVPSGKYTVAVNYYDVINGTASYDVLLNGKSLGKWKGDSETHLGHDFSTFLDCHSAIRITFEGVRISRGDKLTIRGTGNAQEQAAIDYVSILPQGVVD

SEQ ID NO: 24651 - protein, 302 aa, Hypocrea jecorina
MPSVKETLTLLLSQAFLATGSPVDGETVVKRQCPAIHVFGARETTVSQGYGSSATVVNLVIQAHPGTTSEAIVYPACGGQASCGGISYANSVVNGTNAAAAAINNFHNSCPDTQLVLVGYSQGAQIFDNALCGGGDPGEGITNTAVPLTAGAVSAVKAAIFMGDPRNIHGLPYNVGTCTTQGFDARPAGFVCPSASKIKSYCDAADPYCCTGNDPNVHQGYGQEYGQQALAFINSQLSSGGSQPPGGGPTSTSRPTSTRTGSSPGPTQTHWGQCGGQGWTGPTQCESGTTCQVISQWYSQCL

SEQ ID NO: 24652 - protein, 437 aa, Hypocrea jecorina
MMMLSKSLLSAATAASALAAVLQPVPRASSFVTISGTQFNIDGKVGYFAGTNCYWCSFLTNHADVDSTFSHISSSGLKVVRVWGFNDVNTQPSPGQIWFQKLSATGSTINTGADGLQTLDYVVQSAEQHNLKLIIPFVNNWSDYGGINAYVNAFGGNATTWYTNTAAQTQYRKYVQAVVSRYANSTAIFAWELGNEPRCNGCSTDVIVQWATSVSQYVKSLDSNHLVTLGDEGLGLSTGDGAYPYTYGEGTDFAKNVQIKSLDFGTFHLYPDSWGTNYTWGNGWIQTHAAACLAAGKPCVFEEYGAQQNPCTNEAPWQTTSLTTRGMGGDMFWQWGDTFANGAQSNSDPYTVWYNSSNWQCLVKNHVDAINGGTTTPPPVSSTTTTSSRTSSTPPPPGGSCSPLYGQCGGSGYTGPTCCAQGTCIYSNYWYSQCLNT

SEQ ID NO: 24653 - protein, 471 aa, Hypocrea jecorina
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGRLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 24654 - protein, 493 aa, Hypocrea jecorina
MAGKLILVALASLVSLSIQQNCAALFGQCGGIGWSGTTCCVAGAQCSFVNDWYSQCLASTGGNPPNGTTSSSLVSRTSSASSSVGSSSPGGNSPTGSASTYTTTDTATVAPHSQSPYPSIAASSCGSWTLVDNVCCPSYCANDDTSESCSGCGTCTTPPSADCKSGTMYPEVHHVSSNESWHYSRSTHFGLTSGGACGFGLYGLCTKGSVTASWTDPMLGATCDAFCTAYPLLCKDPTGTTLRGNFAAPNGDYYTQFWSSLPGALDNYLSCGECIELIQTKPDGTDYAVGEAGYTDPITLEIVDSCPCSANSKWCCGPGADHCGEIDFKYGCPLPADSIHLDLSDIAMGRLQGNGSLTNGVIPTRYRRVQCPKVGNAYIWLRNGGGPYYFALTAVNTNGPGSVTKIEIKGADTDNWVALVHDPNYTSSRPQERYGSWVIPQGSGPFNLPVGIRLTSPTGEQIVNEQAIKTFTPPATGDPNFYYIDIGVQFSQN

SEQ ID NO: 24655 - protein, 302 aa, Hypocrea jecorina; identical to SEQ ID NO: 24651
  strain QM6a

SEQ ID NO: 24656 - protein, 316 aa, Hypocrea jecorina; identical to SEQ ID NO: 24647
  strain QM6a

SEQ ID NO: 24657 - protein, 344 aa, Hypocrea jecorina; identical to SEQ ID NO: 24636
  strain QM6a

SEQ ID NO: 24658 - protein, 379 aa, Hypocrea jecorina
  strain QM6a
MLKLSLFLGAVTASLCVQAHAVPPPTVTQAPKLEDRATTCTFSGSNGASSASKSQKSCATIVLSNVAVPSGVTLDLSDLNDGTTVIFEGTTTWGYKEWSGPLLQIEGNDITIQGASGAVLNPDGARWWDGQGGNGGKTKPKFFAAHDLTSSSITNLYIKNTPVQAVSVNGVNGLTITGMTIDNSAGDSGGGHNTDGFDIGSSSNVVISGAKVYNQDDCVAVNSGTNITFTGGLCSGGHGLSIGSVGGRDDNTVQTVTFSNSQVTKSANGIRIKATAGKTGTIKGVTYTGITLSSITGYGILIEQNYDGGDLHGSPTSGIPITNLVLQNISGSNGVVSSGNNIAIVCGSGACSNWTWSNVVVTGGKKYGSCQNVPSPATC

SEQ ID NO: 24659 - protein, 86 aa, Hypocrea jecorina; identical to SEQ ID NO: 24643
  strain QM6a

SEQ ID NO: 24660 - protein, 471 aa, Hypocrea jecorina; identical to SEQ ID NO: 24639
  strain QM6a

SEQ ID NO: 24661 - protein, 418 aa, Hypocrea jecorina
  strain QM6a
MNKSVAPLLLAASILYGGAAAQQTVWGQCGGIGWSGPTNCAPGSACSTLNPYYAQCIPGATTITTSTRPPSGPTTTTRATSTSSSTPPTSSGVRFAGVNIAGFDFGCTTDGTCVTSKVYPPLKNFTGSNNYPDGIGQMQHFVNDDGMTIFRLPVGWQYLVNNNLGGNLDSTSISKYDQLVQGCLSLGAYCIVDIHNYARWNGGIIGQGGPTNAQFTSLWSQLASKYASQSRVWFGIMNEPHDVNINTWAATVQEVVTAIRNAGATSQFISLPGNDWQSAGAFISDGSAAALSQVTNPDGSTTNLIFDVHKYLDSDNSGTHAECTTNNIDGAFSPLATWLRQNNRQAILTETGGGNVQSCIQDMCQQIQYLNQNSDVYLGYVGWGAGSFDSTYVLTETPTGSGNSWTDTSLVSSCLARK

SEQ ID NO: 24662 - protein, 96 aa, Hypocrea jecorina
  strain QM6a
MKSFATVALFIAGILAAPQPNMKLPRSPVCSGLTSTPQCCATDVLGVADLDCQTPSSPVPDAQTFEAVCAAGGQRARCCAIPVAGQDLLCQTPAGI

SEQ ID NO: 24663 - protein, 160 aa, Hypocrea jecorina
  strain QM6a
TVTAAPAIPSNEPSYANPSSFTSAVLNSTNTYRRQYNASSVHWNTTLEKFASAYLANDTTCKFAHSGGPFGENIAIGYPNATAAVEAWGNEDKEYNFAKPGFTEETGHFSQLVWKDTRAVGCGRKLCGERGWFVVCEYWPRGNVGGEYKDEVGRRVDGVE

SEQ ID NO: 24664 - protein, 264 aa, Hypocrea jecorina
  strain QM6a
MFFGKALFAAASVASVVNALGINCQGSGLCTGNKGALGNLLGQVKALDQSKTFSDGEQIACVESSVSIGNPSLCLFYQKTGRTFTVAQTVWYVQALIDHGCQACGSIPVDDGNNVDNGELTANMVAKFRRRDTGMVKVVRKAEGQTENVSKLSKRLGINCRGSSTCGVGGVANLPAGHIDDLKDVIAGQGDGVWGNGQQIGCVAHVTGRLCAFYQNVGDRTFTTQQTLMYLDWLTDHGCTVCGSVPTDDGNNVDNGELTVNYVA

SEQ ID NO: 24665 - protein, 260 aa, Hypocrea jecorina
  strain QM6a
MKLLAVTALLVAGSLAVPAGSYPPPPPTYGDDPSGEVGHPPEYPPDYSSQYPEYPPGHGGKDDGDEDSYTPPSTTLSPSYPTSVGGDKSSYPPPSSTPYPPPEADGDGGNNNSGNNSGDNNGDDNDDNNGDDDDDNNGDDDDDDNDNGDDDDDNVPGAPEQPPTDGDSDSPDNGTGGDGTVGGGDDGDGEDNASDLCPGILYASPQCCDTSVLGLLDLSCEPPRSAPADVEAFNDICQEVGAKAQCCVLPVALLCEDVPN

SEQ ID NO: 24666 - protein, 97 aa, Hypocrea jecorina; identical to SEQ ID NO: 24641
  strain QM6a

SEQ ID NO: 24667 - protein, 204 aa, Hypocrea jecorina
  strain QM6a
MPIGDTITAACDLISDGEDAAASLFGISETENDPCGDVTVLFARGTCDPGNVGVLVGPWFFDSLQTALGSRTLGVKGVPYPASVQDFLSGSVQNGINMANQIKSVLQSCPNTKLVLGGYSQGSMVVHNAASNLDAATMSKISAVVLFGDPYYGKPVANFDAAKTLVVCHDGDNICQGGDIILLPHLTYAEDADTAAAFVVPLVS

SEQ ID NO: 24668 - protein, 101 aa, Hypocrea jecorina
  strain QM6a
MQYSAIVALFATLAVAAPAQEAAADIAILDGPCTAGVTNNIPMCCGSGILDLLYLDCETPTQATSVLNPLSAVCGRVGLQAKCCTLGIADLGVLCQDALPE

SEQ ID NO: 24669 - protein, 459 aa, Hypocrea jecorina; identical to SEQ ID NO: 24637
  strain QM6a

SEQ ID NO: 24670 - protein, 150 aa, Hypocrea jecorina
  strain QM6a
MRLASFVAVAIAAAQSAVGLGINCHGDTRCGIAYLSGGRLSHLGTVIKKIDDTRKYENGEDIACIEIDSLNFKGPFKSTLCAWIENYDDTVSGAAIKAAFQELLDHGCGICGAVPLLYAKGVDDVNKGELNVDLVDSLPDGCKANEPCSA

SEQ ID NO: 24671 - protein, 629 aa, Hypocrea jecorina
  strain QM6a
MPTAVRICVCGDESTGKSSLIAALVKDQFMTTKIQPVLPQISIPPSIGTPENVTTTIVDTSARPQDRETLRKEIRKCNVILLVYADHYSYERVALFWMPYFRSLGVNVPVVLCANKSDLVGQGSTSQVVEEEMMPVMAEFREIDSCIRTSAREHRNVNEVFFLCQKAVTHPIAPLFDYKEGRLKPSCVDALKRIFYLCDKNQDGYLDNQEMRDFQSRCFDKPLTDDDLDNIKLSISKSLRGAVDLSKGIDLKGFVQLNKMYAEKGRHETIWIILRKFHHTDSLSLEENFLHPKFEVPEFCSAELSPAGYRFFVDLFLLFDKDNDGGLNDQELEALFAPTPGLPPSWADSAFPSSTVRNEGGYITLQGWLAQWSMTTFLEPKTTLEYLAYLGFEPPNPKDPITSALKITKPRKRRRRPGRVERNVFHCYILGAAGAGKSSLLDAFLNRPFDELYHPTIKPRRAVNSVELPGGKQVYLIFEELGELEPAILENQAKLDACDLVCYAYDSSDPDSFSHIVDIRKKYPQLDQLPSVYTALKADKDKTMQRSELQPDQYTASLNMSSPLHVSVTWNSISELFVALAEAAANPSTAFPKSDDDTPDRTSLYLTLGATACAAIAAVMIWRRSTNTM

SEQ ID NO: 24672 - protein, 242 aa, Hypocrea jecorina; identical to SEQ ID NO: 24640
  strain QM6a

SEQ ID NO: 24673 - protein, 392 aa, Hypocrea jecorina; identical to SEQ ID NO: 24633
  strain QM6a

SEQ ID NO: 24674 - protein, 278 aa, Hypocrea jecorina
  strain QM6a
MKSAVLLAAGALLVSAVPLEKRVMETDWVTDIVTVTVTVDPNASPSATPTAGGPSPPPAPASSSKPAPSLQPVVAKPSPAPSSKPAPSPKPAPSSAAPAPAPAPSSGGSDYGSIMVDQHNVHRANHSSPALEWDDTLAGYAQITAQGCVFAHDMSEGGGGYGQNLASWGSTGDIDDKQLEAARRGVTDQWYNDEMENWTFYGLANPPSGTNLDSWGHYTQLIWKSSTKVGCYTAKCPAGTVLSMQSWYTVCNYSPPGNFGGRYAENVLKPLGQPTVRI

SEQ ID NO: 24675 - protein, 401 aa, Hypocrea jecorina; identical to SEQ ID NO: 24632
  strain QM6a

SEQ ID NO: 24676 - protein, 1361 aa, Hypocrea jecorina
  strain QM6a
MVMRMRSLSQRMPSWSKSTKQKNRLSKSDGRFSTSTDRMNSLELNDPSNLQEEESFQLVAGGTSDQLRWLEIDNGVKKEDDDTPSELTPSEDVSNAEPAGEDAEADDEAATNGVNGDSEIVNGETPNGETPNGVTPNGETANGETVNGETAGETPASEAAPSLRSRTTSFKAVSVKTASERVNLDDATDVDPDEVTNYVLQCHDDVNDHLRQINDALNLISIMGPTRSGKSTLMNLLAGCTDEPLFSTSPGAESWTRGTNLGNKIMGVKEFSRLDDGVEVPMNTNQKVAFLDTEGHGDQGDLYDIMLFTPAVLCSRVIVFNTTDVAKDTILTSLAMMTLAADKLNFGGDKKTTGPKFGQLVIIINKYDLGGSVDDVRKNILRKEIGRTEAIKRRNKIREKLAAEFEDVTTPQVHVLRGNSLKEGVQAKINDKTKEFLVLDDFNDSYVKDFKNLRAQLSQMLRTPRLVAGAPLTGASTADFVSSIVKSINRLEQNGQLHVPDIWRAAENEAINRSHIKFHHDFREACNRLAQDTSLISTKECNKKLDRITQKCMTDVRGSLRYLTQQTIRDTCASLTKESEGQRNEVLAANLQKIEAFAEKELTELVGSIQDTLTDAVSNFKTISVDTADKLLDQLHGDLLEKYKKKIASYDEQALVRNYSVTYDRAFFTAAAMARQNLNIAWASWLVELDTTSAEQIAAALEKLYQESLVGDESIWETRADEELSSHLSNYYNTIDTEYLWDNAAAIKANYTEKANNAKNLVAAKVAVREQEMAKLVEQELEKYLAAYQRQLDESLLPKEDVGDFKAITDTTACRSELIAFLKEQPMSTRLYDHYLNQFDNQLSAKKSAFGDKYTAVLKEFLSYIEEELDRIVKAQIEDFKNQSDTLPITRFLSKDKITSHLAACESAARAAFERSVSHFSLTTDEARLRVTEARNRLAAGIADYHIAKLLLLDSLVNKWNRQALNRCVNEVLSGVVDFTLDTPEKLEEAVRKAKMAYFGEACGETTKQAETWETFERKADTLYDNIRRAQAVFKLKGISYESTTSELESKVIHGISRPFADLANLLGMSWISSGSEFQHELRPEGKSRSYLLKNLSKPKGYGNKHCTSLRFDNWRAEFSDFVFDEPIVQELSPFTVKTITVPAQDENTQVNIAIKETKTETITHSNAVMFTAQNEYAATKGIEEVIGAKIKEAFHASDAFADVKRNEVTLDIDFNHPVICPANRATTVTCSGYTQLTSITYTAKMKLVPEVTFTGGYTRAITKKNDTGNFLKGDKRKKRSYADIPNGPADEIKDKAASNADPWDWPQAIEKYPHIQTLVDRISEPQCYEMYVRGKWEGISGWNFVIQTDIKTATPPGTPI

SEQ ID NO: 24677 - protein, 782 aa, Hypocrea jecorina
  strain QM6a
MKVNSLVSLAAAAAGVARAASSSDDDLALFAKRRTADLAQFPDPTWFAKIDTWLSSQKDDGTWSDVNYLSGCPAQRANWPIQEHWNRLITFGAAWSGVNPVVSSSWAKDPKLLAAVQKGLDYWFSNDYTPADCMGDGGDASKGCPCGTPGLWNTNWYDQAILIPQLCSTACLLVKDANLTETQRAGCERIPYRAYALRDGTYGTGGRMTGANMVLVMQNSVTLALFTDNSTILADSMTRAMSVMTFEDTAGADGIHRDGTFLQHDGLLYNGNYGKDLLNAFIQLEGEAIGTSFAADDDTREAMSTYIKGDEWMIYTDSETKTEHWDFNAIGRFVSFPTVDLQASADINFNVSKLAAAVADFTGSYAVNDTIRRLLSNGTEKLTGNKGFWASDYMVHRRPNFVLTNKMLSTRSANSESVNGANPYAYHMGQGTLYSYVTGTEYKDIMGAWDWNLVPGTTTLLDQPKLQASQVKYDGLKDFVGVVSDGKFGAAVEDYVDPLTQNLAYRKSWFFVDEGVIVITTDIKKNATAGNAPVITVLDNRAAESSKTKAFVKNGPLAKSGAVQHVATDTLYYANNGYLAYDTPFELTLSVGKRSGNWSEISTSTQGVETVDIFSAYTTIKGDKFTYGFFPSISSQKLNKELLEPTWTPITKKGISGIYGKDRASLAFWPGGAKSVELDLKDLGWASAGTLTFTSDQPAVYLLSAKCKDKGSLRLSVTLADPTQKLGAASYSIKISGQKHKVREMGKLSEGIERRGDGAIGFGVRLPTGGLAGSSRAEYSGT

SEQ ID NO: 24678 - protein, 847 aa, Hypocrea jecorina; identical to SEQ ID NO: 24650
  strain QM6a

SEQ ID NO: 24679 - protein, 460 aa, Hypocrea jecorina
  strain QM6a
MASRFFALLLLAIPIQAQSPVWGQCGGIGWSGPTTCVGGATCVSYNPYYSQCIPSTQASSSIASTTLVTSFTTTTATRTSASTPPASSTGAGGATCSALPGSITLRSNAKLNDLFTMFNGDKVTTKDKFSCRQAEMSELIQRYELGTLPGRPSTLTASFSGNTLTINCGEAGKSISFTVTITYPSSGTAPYPAIIGYGGGSLPAPAGVAMINFNNDNIAAQVNTGSRGQGKFYDLYGSSHSAGAMTAWAWGVSRVIDALELVPGARIDTTKIGVTGCSRNGKGAMVAGAFEKRIVLTLPQESGAGGSACWRISDYLKSQGANIQTASEIIGEDPWFSTTFNSYVNQVPVLPFDHHSLAALIAPRGLFVIDNNIDWLGPQSCFGCMTAAHMAWQALGVSDHMGYSQIGAHAHCAFPSNQQSQLTAFVQKFLLGQSTNTAIFQSDFSANQSQWIDWTTPTLS

SEQ ID NO: 24680 - protein, 102 aa, Hypocrea jecorina
  strain QM6a
MQFLAVAALLFTTALAAPSSDVNGIIRRANAFCPEGLLYTNPLCCDLDVLGVADVDCVVPPAKPSSCKSFGSVCASIGRKPRCCAVPVAGVALLCTDPIPAI

SEQ ID NO: 24681 - protein, 514 aa, Hypocrea jecorina
  strain QM6a
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 24682 - protein, 493 aa, Hypocrea jecorina; identical to SEQ ID NO: 24654
  strain QM6a

SEQ ID NO: 24683 - protein, 411 aa, Hypocrea jecorina; identical to SEQ ID NO: 24631
  strain QM6a

SEQ ID NO: 24684 - protein, 401 aa, Hypocrea jecorina
  strain QM6a
MTILSRLAVGVALLAFPELIDAHRVPVKRPNLQWGPKSPGHAFPHSPKRHKTCYVPSCGSNDAPEILKAFKRCNRGGTVVLNEEYVIASPLDLTFLESVDVAITGTIKFTNDIDFWVVNSFKYDFQNSSAFWRFGGKDVNIYGGGHGLIDGNGQAWIEDAKFARCRYLFAYSSGIVANVVQWFNLIANSSDILVSDIDIAVKSESKNPAKNGDGWDTFRSDSVVIQDSYVNNSDDCVSFKPNSTNIIVQGMQCNGSHGISVGSLGQYPAEYDIVEHVYVYNISMSNASDGARIKVWPGTDTPFEPGLSGGGGAGYVKNVTYDTFHNNNNDWAIEINQCYGQSNQTICDKYPSNMTISDVVFKNMWGTTSKKYDPKVGTLTCSSTESSLEKREYRGEEHLGG

SEQ ID NO: 24685 - protein, 405 aa, Hypocrea jecorina
  strain QM6a
MLLGGCLVLVAVVANVAAVNLLQPPTKVIKRASTCTPVAGRSSATDDTLAIQSAIASCSSGTIVIPASTTYHINTALSFKGCSGCTLQIEGTLQAISDTNYWEGLRAIFLMDGINGANIYSNTGKGVIDGNGQAAWDVFAANSSYRRPTLFYINNSKNVNVRNLYFKSAPNVFHSVTGGSSNVTYTDITLYAVSNSSNVAHNTDGWDIGQSTYVSINHATVTNDDDCVAFKPGSSFATVTNITCTGSHGISVGSLGSGAGNTDTVQNCFVSGATMIDSTKAAGLKLYPGPPKHGTAIVTNVTFENFVLKNTDYAFQVQSCYGEDASYCSSSPSTAQVKGVVVRNFSGTTSSHYSPNVANLNCPAAGSCGLTLSNITVKPPSGSAVFQCANTPSSIGVPCSAGASG

SEQ ID NO: 24686 - protein, 640 aa, Hypocrea jecorina
  strain QM6a
MKSAILLGLTGLAANVHAHPTKQHDSGSNLVRRGIDISKYHLPSLSDYTPSTHVDVEDEASLQSVDLKRDYVATATRAVKRLAPHAKFRVVDDHYVDVDGIGHVHFKQTVHGIDIDNADFKVNVGRNGRVFSHGNSFFTGKLPTENPLTKRAFSEPTEALKGAVDILGLPVKADGATAEPTEGTEKYVLKGTSGAVSDPEARLVYLVKADGTLSLTWRVETDVVDNWLLTYVDAATNQEVHGVVDYVADFATYEVYPFGVNDPSEGDRKTFTDPWRIDASPFTWLGDGTTNYTTTRGNNAIAQVNPTGGNDYLNNYRPSSPSRTFEYPFSLTQTNPVDYRDFSVTQLFYTANKYHDLLYLLGFTEAAGNFQVNNNGKGGKGNDFVILNAQDGSGTNNANFATPADGSSGRMRMYIWTVSTPRRDGSLEEGIVIHEFTHGLSNRLTGGPANSGCLSGLEAGGMGEGWGDFYATAIRLKPSDTHSTNYPMGAWADNNPAGIRQYPYSTSLTTNPLTYKSVNSQSEVHSAGTTWASILYEVLWALIDKHGKNDAEFPTFDSQGVPTDGKFLALKLVLNGLALQPCTPTFVSARDAIIDADRALTGGDNVCELWTAFAKRGLGSGAKYSSSSRTESFTVPSGVC

SEQ ID NO: 24687 - protein, 249 aa, Hypocrea jecorina
  strain QM6a
MKSCAILAALGCLAGSVLGHGQVQNFTINGQYNQGFILDYYYQKQNTGHFPNVAGWYAEDLDLGFISPDQYTTPDIVCHKNAAPGAISATAAAGSNIVFQWGPGVWPHPYGPIVTYVVECSGSCTTVNKNNLRWVKIQEAGINYNTQVWAQQDLINQGNKWTVKIPSSLRPGNYVFRHELLAAHGASSANGMQNYPQCVNIAVTGSGTKALPAGTPATQLYKPTDPGILFNPYTTITSYTIPGPALWQG

SEQ ID NO: 24688 - protein, 838 aa, Hypocrea jecorina
  strain QM6a
MKVSRVLALVLGAVIPAHAAFSWKNVKLGGGGGFVPGIIFHPKTKGVAYARTDIGGLYRLNADDSWTAVTDGIADNAGWHNWGIDAVALDPQDDQKVYAAVGMYTNSWDPSNGAIIRSSDRGATWSFTNLPFKVGGNMPGRGAGERLAVDPANSNIIYFGARSGNGLWKSTDGGVTFSKVSSFTATGTYIPDPSDSNGYNSDKQGLMWVTFDSTSSTTGGATSRIFVGTADNITASVYVSTNAGSTWSAVPGQPGKYFPHKAKLQPAEKALYLTYSDGTGPYDGTLGSVWRYDIAGGTWKDITPVSGSDLYFGFGGLGLDLQKPGTLVVASLNSWWPDAQLFRSTDSGTTWSPIWAWASYPTETYYYSISTPKAPWIKNNFIDVTSESPSDGLIKRLGWMIESLEIDPTDSNHWLYGTGMTIFGGHDLTNWDTRHNVSIQSLADGIEEFSVQDLASAPGGSELLAAVGDDNGFTFASRNDLGTSPQTVWATPTWATSTSVDYAGNSVKSVVRVGNTAGTQQVAISSDGGATWSIDYAADTSMNGGTVAYSADGDTILWSTASSGVQRSQFQGSFASVSSLPAGAVIASDKKTNSVFYAGSGSTFYVSKDTGSSFTRGPKLGSAGTIRDIAAHPTTAGTLYVSTDVGIFRSTDSGTTFGQVSTALTNTYQIALGVGSGSNWNLYAFGTGPSGARLYASGDSGASWTDIQGSQGFGSIDSTKVAGSGSTAGQVYVGTNGRGVFYAQGTVGGGTGGTSSSTKQSSSSTSSASSSTTLRSSVVSTTRASTVTSSRTSSAAGPTGSGVAGHYAQCGGIGWTGPTQCVAPYVCQKQNDYYYQCV

SEQ ID NO: 24689 - protein, 94 aa, Hypocrea virens
MNFFTAAALFAAVVVAHPLEHRSSNVCPDGLFSNPLCCATAILGLVGLDCQSPPRLYDNAAEFQTSCAKLGHAPFCCVAPVANQGILCQKPVGN

SEQ ID NO: 24690 - protein, 93 aa, Hypocrea virens
MQFFAVAALFVASALAAPAGDEGCPGGILHNVPLCCATNVLGVATLDCGTPTVPVLTPAQFQSHCAGKGKQPVCCSIPAAGLGLLCEKPVGTQ

SEQ ID NO: 24691 - protein, 110 aa, Hypocrea virens
MKFFTIATLLAAVAVAHPLEDAGLELRAGGDNNNTPTDRPHLCPQGLYSNAQCCDVFLLGIIGLDCKTPSGKVYDANDFRKECAKTGDKPLCCVAPVADQAILCQPALDV

SEQ ID NO: 24692 - protein, 223 aa, Hypocrea virens
MNLSICESNSVPITPFPLPHPKSCLFCFKPILQGDCLPILTMKLLAITALFIAGTLAVPASSYPPPPPEYGDGHKGDVGYGGDHGGDHGKDHGKDHGGHYPGDPNYPPPPPPGYHNGGSDKPPTDGDGYPSDGGDDGDDSDGGGHGGDRENDPSDLCPTLLYSNPQCCSASVLNIADLDCEPPRKRPSRKHDFKQICAAQGSDAKCCVLPLLGLGILCTDAIV

SEQ ID NO: 24693 - protein, 87 aa, Hypocrea virens
MNMKLLILAGIFTTGAFASIPCSGNQNTPLCCAVDVLGVASLDCQPPPGPVNSSEDLQQQCRSVGLESKCCALSLLGQAIGCTNPGN

SEQ ID NO: 24694 - protein, 97 aa, Hypocrea virens
MKSFAAAVLFIAGILAAPSPNAKAIRSPLCPGGLESNPQCCSTDVLGIADLDCANPSSPVTDVQSFRAVCAAGGQRARCCAIPVAGQALLCESPVGI

SEQ ID NO: 24695 - protein, 102 aa, Hypocrea virens
MQFSAIIALFASLAIAAPAGETTTHELAARDGPCSSGVTNNVPKCCGTGVLDLLYLDCKTPTQATSVLNPLSAVCGRVGLQAKCCTAGIGSVGVLCQDALPE

SEQ ID NO: 24696 - protein, 158 aa, Hypocrea virens
MKFLAVTTVFFAAVLAAPGLYYPPPPPDYTLPGNGGNGNGHGNGNGNGNGNGNGNGNGNGNGNGNGNGNGNGNGDGNGNGNGNGGASALCPTGLFASPQCCATDVLGVADLDCIVPTTAPQNAASFQSTCAASGRRPRCCVLPVAGLGVLCTSPVGTQ

SEQ ID NO: 24697 - protein, 102 aa, Hypocrea virens
MQFLAVAALLFTAAFAAPSSEAHGLRRRDQAWCPDGLYASPQCCDVDVLGVAALDCRTPPVAPSKCKSFGSVCAAIGLQPKCCVLPVAGVAVLCTDPLPPAF

SEQ ID NO: 24698 - protein, 505 aa, Hypocrea virens
MYQKLAVISAFLAAARAQQVCTQQAETHPPLTWQKCSSSGCTAQSGSVVLDANWRWTHDVKSTTNCYDGNTWSKTLCPDDATCAKNCCLDGAAYSSTYGITTSSDSLTINFVTQSNVGARLYLMATDTSYQEFTLSGNEFSFDVDVSQLPCGLNGALYFVSMDADGGQSKYPTNAAGAKYGTGYCDSQCPRDLKFINGQANVDGWQPSSNNANTGIGGHGSCCSEMDIWEANSISQAVTPHPCETVGQTMCSGDGCGGTYSSDRYGGTCDPDGCDWNPYRLGNTTFYGPGSGFTLDTTKKMTVVTQFATSGAISRYYVQNGVKFQQPNAQLSGYSGNTLNSDYCAAEQAAFGGTSFTDKGGLTQFNKALSGGMVLVMSLWDDYYANMLWLDSTYPTNATASTPGAKRGSCSTSSGVPSQIESQSPNAKVVFSNIRFGPIGSTGGSTGNPPPGTSTTRLPPSSTGSSPGPTQTHYGQCGGIGYSGPTQCVSGTTCQVLNPFYSQCL

SEQ ID NO: 24699 - protein, 397 aa, Hypocrea virens
MVRSLAYVGALLAALPSARAGFNASSTQNIAVYWGQNSANQANSQQRLSTYCANADIDIIPIGFMNGISPVITNFANAGNNCTAFPDNANALDCPQIEEDIITCQKTYGKTILISLGGGSYSQGGFSSASAATSAAQTVWNMFGPVNPNSTVDRPFGSAVVDGVDFDFESGVNNLATFATELRSLMDASASSANRKFYLSAAPQCVYPDYADNPALNGVVSFDFIMIQYYNNGCGVSSYVPGATTQWNYNFDVWDNWAHTVSKNPNVKILLGIAANTGAASGYVSGTQLSAVISFTKQYSSFAGIMMWDMSQLYENSGFLDQVVSDLAAPGSSPPATTSTGGSKPTSTSGGSTGPTGGGGGTVPQWGQCGGEGYTGPTQCQSPYKCVVSSTWWASCQ

SEQ ID NO: 24700 - protein, 890 aa, Hypocrea virens
MIAKAVAALLLGSGLASAAGTPLTSKAGDKVPIPDWDLKSSSEVSKDLKGLSKPGVDTSAWYHAGTSKCTLMACLLNAGIYKDEDLWYSDNLNHFNWGQFSIPWLYRHEFALAPAKGKHFILQTNGITSKADLFFNGQQIADSEYQAGAYAGRTYDITSLAAKDNAFVVQVHPTDYLYDFALGYVDWNPYPPDNGTGIWRDITVKETGSVSMGPISVVVDIDVPVESSPAKVTIRAEAQNLENVAVVLDAEAVVSGNSCSGGPLKQTVKLAPGEKKLVEFTKTIAKPKIWWPKQWGDQPLYNAKVTFSVNKAVSDTAQTNFGVRKVTSFVNQYNDTQYSVNGHPFQVVGGGYGADMFLRWDGDRFTRIVEYMLDMHQNTIRLEGKMEHPELYEICDKYGLMVMPGWECCDKWEAWAYNDELAIFPPPVWDDNDYQTANYSMIHEASMLQPHPSVLTFLVGSDFWPNDEAVVLYVNALKNAGWQTPIIASASKRGFPALLGPGGMKMDGPYDWVPPNYWYDTEPSEDRLGAAFGFGSELGAGVGTPELGSLKRFLSQSDLNDLWKNPNKNLYHMSTNVSSFYNRKIYNQGLFKRYGAPTSLDDYLLKAQMMDYEATRAQYEGFSSLWTASRPATGNIYWMLNNAWPSLHWNQFGYYMHPAGSYFGTKVGSRIEHVAYNYQKKEVWVINHSLDQTGPRKVDIELIDTNGKQIAKQSVNINTKANSGFKAADISSQIGKLSSVAFLRLILSDSKGNVLSRNVYWVTNSIDKLDWDSSTWYYTQVTSFVDYTPLNKLSAAQISVTTGSSRRVAGVPGTQTRTVTLENKPSVPAVFIRLTLVDKSGNDVNPVSWTDNYVTLWPKEKLQLEVGGWDASGDSIQVSGRNIAATTVKL

SEQ ID NO: 24701 - protein, 45 aa, Hypocrea virens
TPPVAPSKCKSFGSVCAAIGLQPKCCVLPVAGVAVLCTDPLPPAF

SEQ ID NO: 24702 - protein, 397 aa, Hypocrea virens
MPSLSFTAALGLLSLLPAAQAGWNQNSNNNIVVYWGQNSGSVGQNRLSYYCQNAPDVDVINISFMVGITNLNLNLANVGNNCTSFPQAPNLLNCPQVAADIVECQQTYGKTIMMSLFGSTYSESGFSSSSAAVSAAQEIWAMYGPVQSGNSTPRPFGNAVVDGFDFDLEDPIENNMEPFAAELKTLMNANTSKKFYLSAAPQCPYPDVSDQSFLNGQVAFDWVNVQFYNNGCGVSHYPTDFNWATWDNWAKTVSANKNAKVLIGTPANVGGANAGSFPTDSQLSGAINLAKGSSSFGGVMLWDMAQLFSNTGYLAKIVADLGGSSSPPPPPPPSTTLATVTRTSTASTGPTSSPPSGGNGGSVPQWGQCGGNGYTGPTQCQAPFKCVVESEWWSSCQ

SEQ ID NO: 24703 - protein, 846 aa, Hypocrea virens
  strain Gv29-8 / FGSC 10586
MVIQSLLIFFLAAIAPVSAESGIDAWLRYARLPGSVTRGHLNSFPNRIVVLNASKNGPLASASSELHKGIQGILGLDLDVSSSGKSCSAQNTIVVSTLETYQSSCGKLSPKLNLKEDGYWLSAKGKSVQIIGQNERGALYGAFQYLSLLAQGDFSEVAYASNPSAPVRWANQWDNLNAATAAHGSIERGYGGASIFFNNGLIKDDLSRVPLYGRLLASVGINGIIINNVNADANLLNETNLAGVKRIADLFRPWGVKVGISLNFASPQVLGALTTFDPLDSTVIKWWTDKTNRIYQLVPDFAGYLVKANSEGQPGPLTYNRTLAEGANLFAKAIEPHGGIVVFRAFVYDQLNETNWRADRANAAVQFFKDLDGQFDSNVLVQIKFGPIDFQVREPASPLFANLPKTAVSIELQVTQEYLGQQCHLVYLPPLWQTILGFDMRYNHRQSYVRDIVSGEVFNHKLGGYAGVINVGMDDTWIGSHLAMSNMFAFGRLAWNPQADSQDIIEEWTRLTFGLSRDVISAIVDMSMKSWPAYEGYSGNLGIQTLTDILYTHYGANPASQDNNGWGQWTRADSKTIGMDRTVSNGTGNAGQYPKDVADKFEHTQTTPDDLMLWFHHVPYTFKLHSGKTVIQHFYDAHYSGAATVQKFPATWKSLKGQVDAERYVDVLYRLQYQAGHSLVWRDGISEFYRNLSSIPDKLNRVRNHPHRIEAEEMELSGFTTVNVSPTECASKYKAIATNGTGTATTKLNVPSGKYTVAINYYDVMGGSASYDVLLNGKSIGTWKGDSENYLGHDFSTFLDCHSAIRITFEDVKISRGDKLTIKGTGDAQEQAAIDYVAVLPQGVVD

SEQ ID NO: 24704 - protein, 638 aa, Hypocrea virens
  strain Gv29-8 / FGSC 10586
MKSAILLGLTGLAANVHAHPAKQHETGSTLTKRGIDISKYSLPSLSDYTPSTHVEEEVSIQAEGFKRDYVATATRAVKRAAPHAEFRVVNDHYIDVDGIGHVHFKQTVHGIDIDNADFKVNIGRNGRVFSHGNSFFSGKLPTESPLKKRAFSDPTDALKGAVDILGLPVQADGATAEAKEGTEKYTLKGTSGAVSDPEARLVYLVKDDGTLSLTWRVETDVVDNWLLTYIDATTNKEVHGVVDYVSDFATFEVFPWGLNDPTEGDRKTLTDPWSIAASPFTWLGDGTTNYTTTRGNNAIAQVNPTGGNDYLNNYRPTSATRAFEYPFSLTQTNPTDYRDASIAQLFYTANKYHDLLYALGFTEAAGNFQANNNGKGGLGNDFVILNAQDGSGTNNANFATPADGSNGRMRMYIWTVSTPRRDGSLEAGIVIHEYTHGLSTRLTGGPANSGCLGGVEAGGMGEGWSDLFATAIRLKPGDTRAKDYPMGAWADNNVKGIRQYPYSTSLTTNPLTYKSVNTQTEVHSSGTTWATILYEVLWNLIDKYGKNDADLPTFDSQGVPTDGKYLTLKLVLNGLALQPCTPTFVSARDAILDADRSLTGGENLCELWTAFAKRGLGSGARYSPTARVESFTIPAGVC

SEQ ID NO: 24705 - protein, 780 aa, Hypocrea virens
  strain Gv29-8 / FGSC 10586
MKLNSLVSFVAATAGVAQAASSDDLALFAKRRTADLAQFPDPTWFAKIDTWLSSQKADGTWSDVNYLSGCPAQRANWPIQEHWNRLITFGAAWSGVNPAVSSSWAKDPKLLAAVQKGLDYWFSNDYTPDDCMGNGGDASKGCPCNTPGLWNTNWYDQAILIPQLCSTACLLVKDANLTETQRAGCERIPYRAYALRDGTYGTGGRMTGANMVLVMQNSVTLALFTDNSTILADSMTRAMSVMTFIDDAGVDGIHRDGTFLQHDGLLYNGNYGKDLLNAFIQLEGEAIGTSFAADDNTREAMSTYIKGDEWMIYTDSQTRTEHWDFNAIGRFVSFPTVDLQASADINFNVSKLANAVADFTGPYAVNDTIRRLLSNGTEKLTGNKGFWASDYMVHRRPGYILTNKMISTRSSNSESVNGANPYAYHMGQGTLYSYVQGNEYKDIMAAWDWNLVPGTTTLLNQPKLQASQVKYDGLKDFVGVVSDGKFGAAVEDYLDPLTQNLSYRKSWFYVDEGVIVITTDIKKNATAGDAAVITVLDNRAAEPTKALLKTGPVSQAGEQHLTSDTLYYANNGYLSYDTPFQLTLSVGKRSGNWSEISTSTQGVKTVDIFSAYTTIKGSQFTYGYFPGISSKKLNKELEKPTWNPITKKGISGIYGKDRASLAFWPGGDKSVALDLKALGWSKAGTLTFKSDQPAVYLISAQCKDKKSMRLVVTLADPTQKLTVASYSIKISGQGHKVRDMGKKSEGLERRGDGGIGFGVRLPTGGLAGSSVSREVLLELD

SEQ ID NO: 24706 - protein, 419 aa, Hypocrea virens
  strain Gv29-8 / FGSC 10586
MKLFRPVLWALVTALVADTYSLSPPQQTCVIPALKDDRDDAPAIRQAFSKCGNNGKVAFKKNTKYSIQTVLQLHNLKNVQVDMFGTLEYSTDVRYWILHGSYYYFQNISIAMEFSGEDITIDGYGSGTIDGQGQVWHDLALGVGGLYGRPIPFCLRNVKNAVAKNFEILQSGKWNFLMVEFQNILVDNITLSSTSDDFQANPGNLGNTDGFDTINSNNITIQNIWADVGDDCVSFKPGSTNIHVKNLTCYNSAGIAIGSLGQYEGVRDVVENITAEDVSLYGSRNGAYIKTYAGKRFYWPPQGGGNGYVRNVVFKNFHIENITASPVLIQQCTHWAGYNVPACADTPPTGFFSNISWYNFTGYMNEKVGTKAVSWTCSPLATCEGFSFKDINIKSATGANGTYSCTNVDGYDVTCEKTK

SEQ ID NO: 24707 - protein, 100 aa, Hypocrea virens
  strain Gv29-8 / FGSC 10586
MWSAGFSDLNVNNGCNYAQEAKNILLTGSPCSSGPVSVSQPAVPTSTTTSKPPGSSQTPPPSSGTVPQWGQCGGNGYTGPTQCVAPYKCVATSEWWSQCE

SEQ ID NO: 24708 - protein, 411 aa, Hypocrea virens
  strain Gv29-8 / FGSC 10586
MFFSKVTLGAGLLASLASAAPSPIARRQAPGAQNVVYWGQNGGSTVENNDLSAYCTPTSDIDIIVLSFLYQWGQGASALGGTIGQSCGITTSGQPQNCDALTAAITKCKNAGVKIILSLGGASAYSSFSSADQASQAGQYLWNAYGGGSGVTRPLGNNIMDGWDLDIESNPGTNQYYASLVNTLRSNFASDPAHKYVITGAPQCPLPEPNMGVIIQNSVFDYLWVQFYNNNDYPADPCSLGLPGDAPFNYNNWTTFLQTTPSKNAKLFIGVPAAPLAANGGPGGAVYYATPSQLATIVNDVKGESNFGGIMMWSAGFSDSNVNDGCNYAQEAKHILLTGSPCSSGPVSVSQPSVPTSTTTSKPPGSSQTPPPSSGSVPQWGQCGGNGYTGPTQCIAPFKCVATSEWWSQCE

SEQ ID NO: 24709 - protein, 423 aa, Hypocrea virens
  strain Gv29-8 / FGSC 10586
MTNNKARRLLAASLYLGATGVIAQQQTTWGQCGGIGYSGPTSCTSGTSCSTLNSYYAQCIPATGIITSTRTTLASTTATTTASTKTSATSLPPPTSGVRFAGINIAGFDFSCSTDGTCNVSGAYPPLKNYDGANNYPDGVGQMQHFVKDDNFNIFRLPVSWQYLVNANLGGTLDATNLGYYDQLVQGCLATGAYCIIDIHNYARWNGKIIGQGGPTNAQFVSLWSQLATKYASEPRIWFGTMNEPHDLNITTWAGTVQAVVTAIRNAGATSQYISLPGTDYQSAGQIISDGGAAALSAITNPDGSKTNLIFDVHKYLDSDNSGTNSICVTDNVDSAFAPLATWLRTNKRQAILTETGGGNTASCEQYMCQQIQYINQNSDVYMGYVGWAAGSFDPGYPLAETPVQASSGAWTDQPLVKLCLAR

SEQ ID NO: 24710 - protein, 248 aa, Hypocrea virens
  strain Gv29-8 / FGSC 10586
MRSLAILATLLAGHAFAYPKPVLESPARRDWPTINEFLTELAEIMPIGDTVSAACDLIGDAEDVAADLFGISNTENDACGDVTVLFARGTCDPGNVGVLVGPFFFRSLQTALGSKTVGVKGVPYPASVQGFLSGSVQPGIDMANQIKSVLSSCPNTKLVLGGYSQGSMVVHNAATHLDAATMSKISAVVLFGDPYDGRPVANYDASKVLVVCHDGDNICQGGDFILLPHLTYAEDADTAAAFVKPLVS

SEQ ID NO: 24711 - protein, 459 aa, Hypocrea virens
  strain Gv29-8 / FGSC 10586
MATRFFALLLLAIPIQAQSPVWGQCGGVGWSGPTTCVAGTTCVSYSEYYSQCIPNTQVSSTIPTTTLVTSFTSPPASSTSSSSATRATSTSAAACSALPGSISLKANPKLNDLFTMFNGDKVTTKDKFLCRQAEMSELIQRYELGTLPGRPATVTASFSGNTLTINCGDSGKSISFTVTISYPSSGTAPYPAIIGYGGGSLPAPAGVAMINFNNDNIAAQVNTGSRGQGKFYDLYGKGHSAGAMTAWAWGVSRVIDALELVPAARIDATRIGVTGCSRNGKGAMVAGAFDKRIVLTLPQESGAGGSACWRISDYLKSQGANIQTASEIIGEDPWFSTTFNSYVNQVPTLPFDHHSLAALIAPRGLFVIDNNIDWLGPQSCFGCMTAARTAWQALGVPNNIGYSQIGAHAHCAFPSNQQSQLTAFVQKFLLGQSTNTAIFQSDFTFSQPQWIDWTAPTLT

SEQ ID NO: 24712 - protein, 648 aa, Hypocrea virens
  strain Gv29-8 / FGSC 10586
LPRRPSQQGFHKTFGQGRSIKRDLIQGDSQRPSGDTASNLKRTRNIDRRDERSPVGQRDRLEGSSPTALGANRQRPPDNARPHPSSQSSKSSTSHVSSVPLKPVLDLIAERMTWFRARNEASKSHKRAMANQEQSHYRPSDYASSPELLATQQRQTLEEMRKAEKNLGEFDDRIAAAMQQLLQHMSEAWSKSPDASNASEDREASEAKMNTIQNTIQKEMEESFKKEATESQQLMKDLIGSQMAKLKEALTQENEQKLHSLQKTLAQEAEDRATSLRKTLMQDNEKRVAEMKDSINREHKARIIALENALSEEAKNKARIAALENAFKSQLTSLDDKIAMIDAELRMTISDQRILSESWINKAQLAEQLQQLSLSQDKKLGKLEAQVNLLPDHSPRIEELAEQICDHSKLIKDKEQMQDEANLRLDSLESTLTNFLEEGEEIKERVQKLSSTKPVSVSNDQILEVIKPEMAKNTKDTREMIMQIQHKLRPFLEQERHKRETLEEQVGDVARQITEIQKESATTKTDYSGLTEKLDGQTDEVKRLEESTNIRIGLIMDEFRSQMESVYIQVQTLNSWQTNFSTQGLYRDMVNHINRTIPEGPAAVPQIKLLKQQVSGIETRIAAWESTSNKKRKLVSGNARVVNGHQTD

SEQ ID NO: 24713 - protein, 443 aa, Hypocrea virens
  strain Gv29-8 / FGSC 10586
MMLTKSYLLAAATAASTLAAVLQPVPRASSFVTVSGTQFNIDGKVGYFAGTNCYWCSFLTNPADVDSTLSHIASSGLKVLRVWGFNDVNQQPSPGNIWFQKLSASGSTINTGTDGLQTLDYVVKSAEQHGIKLIIPFVNNWNDYGGINAYVNAFGGNATTWFTNSAAQTQYRKYIQAVVSRYSNSTAIFAWELANEPRCNQCDTGVIVQWATSVSQYVKSLDSNHLVTLGDEGLGLSTGDGSYPYTYGEGTDFAKNVAIKSLDFGTFHLYPDSWGTNYPWGTTWVQTHAAACLAANKPCVFEEYGAQNNPCTNEAPWQSTSLALAARGMGGDMFWQWGDTLSYGQSNSDPYTVWYNSSNWQCLVQNHVAAINGGTTPPPPSSTTTTKSATTTSTKTTSTASQPTGNCSPLYGQCGGLSWTGAKCCSQGTCRYSNDWYSQCVPS

SEQ ID NO: 24714 - protein, 433 aa, Hypocrea virens
  strain Gv29-8 / FGSC 10586
MAILSTFALFVALLSFLDPIDAHKTILERPKLHWGPKTPGHQFPHSPKRHKTCYVPNCLSSGHHGKNDDTPEILKAFKNCNKGGTVILNEEYTIASPLDLTFLEAVDVAITGTIKFTNDIDYWVKNSFKYDFQNSSAFWRFGGKDVNIYGRGQGLIDGNGQAWYDAFAAEPTLLRPILLVLDGLEHGSWFNLIANSTDILVSDIDIAVKSESKNPAKNGDGWDTFRSDSVVIQDSHVNNSDDCVSFKPNSTNIIVQGMQCNGSHGISVGSLGQYPAEYDIVENIYVYNVSMSNASDGARIKVWPGTNTPFEPGLSGGGGAGYVKNVTYDTFYNSNNDWAIEINQCYGQSNQTICDKYPSNITISDVIFKNMWGTTSTKYDPKVGTLTCSSTEKCLNISAYNISVIDPSGKTPQWICTNMDESLLDINCVSANS

SEQ ID NO: 24715 - protein, 628 aa, Hypocrea virens
  strain Gv29-8 / FGSC 10586
MPTAVRICVCGDESTGKSSLIASLVKDQFMTNKIQPVLPQITIPPSIGTPENVTTTIVDTSARPQDRTTLRKEIRKCNVILLVYADHYSYERVALFWMPYFRSLGVNVPVVLCANKSDLVGQSSTSQVVEEEMLPVMAEFREIDSCIRTSAREHRNVNEVFFLCQKAVTHPIAPLFDYKEGNLKPSCVEALKRIFYLCDKNQDGYLDNQEMRDFQSRCFDKPLTDDDLENIKLSISKSLRGDVDLSKGINLKGFVQLNKMYAEKGRHETIWIILRKYHHTDSLSLEENFLHPKFEVPEFCSAELSPAGYRFFVDLFLLFDKDNDGGLNDQELEALFAPTPGLPTSWADSFPSSTVRNEGGYITLQGWLAQWSMTTFLEPKTTLEYLAYLGFEPPNPKEPITSALKVTKPRKRRRRPGRVERNVFHCYILGASGAGKSSLLEAFLNRPFDDLYHPTIKPRRAVNSVELPGGKQVYLIFEELGELEPAILENQAKLDACDLLCYAYDSSDPDSFSHIVDIRKKHPQLDELPSVYTALKADRDKTMQRSELQPDQYTSSLNMSSPLHVSVTWNSISELFVSLAEAAANPSTAFPKSDDDTPDRTSLYLTLGATACAAIAAVMIWRRSTNAM

SEQ ID NO: 24716 - protein, 151 aa, Hypocrea virens
  strain Gv29-8 / FGSC 10586
MRSSSFIAVAAAAAQGVAGLGINCHGDVYCGTVYLNGGTLSDFENIFNKLDDKRKYQNGEDVGCVQHLVGHLTGNFMATICAYIQNAKDDTTGATLKSVYKELQQYGCAVCGSVPLLYAKGDDDVNHGELTINIVDDLPENCKINEPCSAS

SEQ ID NO: 24717 - protein, 93 aa, Hypocrea virens; identical to SEQ ID NO: 24690
  strain Gv29-8 / FGSC 10586

SEQ ID NO: 24718 - protein, 94 aa, Hypocrea virens; identical to SEQ ID NO: 24689
  strain Gv29-8 / FGSC 10586

SEQ ID NO: 24719 - protein, 110 aa, Hypocrea virens; identical to SEQ ID NO: 24691
  strain Gv29-8 / FGSC 10586

SEQ ID NO: 24720 - protein, 182 aa, Hypocrea virens
  strain Gv29-8 / FGSC 10586
MKLLAITALFIAGTLAVPASSYPPPPPEYGDGHKGDVGYGGDHGGDHGKDHGKDHGGHYPGDPNYPPPPPPGYHNGGSDKPPTDGDGYPSDGGDDGDDSDGGGHGGDRENDPSDLCPTLLYSNPQCCSASVLNIADLDCEPPRKRPSRKHDFKQICAAQGSDAKCCVLPLLGLGILCTDAIV

SEQ ID NO: 24721 - protein, 120 aa, Hypocrea virens
  strain Gv29-8 / FGSC 10586
MQFFAVLPLLYTTAAALGINCRGNANCVGTPECRLADLILQVSQQDPSTSYSPGQHIACCGIPGGNICAFTQGISNSITAGEALGMLQGLSAHGCGQCGSIPFKDNNVAEGQLTVNWTDH

SEQ ID NO: 24722 - protein, 204 aa, Hypocrea virens
  strain Gv29-8 / FGSC 10586
MKFNSAAIVAILAYTTLALPTPSPGKTDVGKVDLESRNGKMDVGKVDLERRNGKMDVGKVDLERRNGKMDVGKVDLERRNGKMDVGKVDLERRNGKMDVGKVDLERRNGKMDVGKVDLERRNGKMDVGKVDLERRNGKMDVGKVDLERRNGKMDVGKVDLERRNGKMDVGKVDLERRNGKMDVGKVDLERRNGKTDVSNVEDKY

SEQ ID NO: 24723 - protein, 471 aa, Hypocrea virens
  strain Gv29-8 / FGSC 10586
MVAGILVSLAALATLAASVPVEERQACSGVWGQCGGQNWAGPFCCVSGSTCVFSNDYYSQCLPGAASSSSSTRASSTTSRASSTSTRSSTTTPPPGSSTTSAPPVGSGTVTWQGNPFSGVTPWANAYYASEVSTLAIPSLTGAMATAAAAVAKVPSFMWLDTLDKTPLMSQTLSDIRAANKNGGNYAGQFVVYDLPDRDCAALASNGEYTIADGGVAKYKNYIDTIRGIVTTFSDIRILLVIEPDSLANLVTNLGTPKCANAQSAYLDCINYAITRLNLPNVAMYLDAGHAGWLGWPANQDPAAQLFANVYKNASSPQAVRGLATNVANYNAWNITSPPPYTQQNSVYNEKLYIHAIGPLLANHGWSNAFFITDQGRSGKQPTGQLEWGNWCNVIGTGFGIRPSANTGDSLLDAFVWVKPGGECDGTSNSSAPRFDSHCASPDALQPAPQAGSWFQAYFVQLLTNANPSFL

SEQ ID NO: 24724 - protein, 830 aa, Hypocrea virens
  strain Gv29-8 / FGSC 10586
MLPSETGIDGWLRYAALPDELASRHPQYSTIISLADDQCSPVFTAARELQLGLSKILSQNVTLETKLLVSAASSYIVIGTVKTFLSAGRDEYENLPLKDDGYCLVCKDGKATEIIGQNDRGALYGAFEFLRFLSRNQLLPEMRISNPSAPIRWVNQWDNLDGSIERGYAGPSIFFADGYVLDDLTRVQQYARLLASVGLNGLIVNNVNSNYNLLNPINMQGLTRIADIMRPWGVRIGVSLYFDTPKGLGGLRTSDPLDPDVIAWWGYITSELYRHVPDMLGYLIKANSEGQPGPLTYGRTLADGANMFARALQPHGDGVVMYRAFVYNHHLDESDWKNDRANAAVEYFDGLDTQFEDNVIVQIKYGPIDFQIREPPSPLLAHLRKTPIILELQVTQEYLGQQDHVVYLPPLWKTIFNFDLHVDGQQSLVRDIVSGQRFNWSRSGYAAVVNVGNDPTWLGSHLAMANLYAYGLCTWDPQQSEEDIIQGWAQLTFGLDKTIVDTITNISMASWPTYEDYSGNLGIQTLCDIVTHCHYGPCPASQDGNGWGQWTRADAHSIGMDRTVATGTGNAGQYPQVVAEQFECIDTTPDELLLWFHHVPYTHRLKSGKTVIQHFYDAHYAGALVAQTFPQQWEALRGLIDDDRFNHVAFRLRYQAGHALVWRDSINNFYYAKCEIKDERNRVGNHAWRIEAEDMTLEGYMVVPVTPFEAASGGKAIATIPGADIGTAQCTVTFPSGIYDIAINYYDHLGGRSQYQVFLNERLIGTWTGDLEDKLGHDFSDRIDGHSATRVTFNKVNVKKGDSLRIVGRPDGSELAPIDYVSLLPPGIVD

SEQ ID NO: 24725 - protein, 378 aa, Hypocrea virens
  strain Gv29-8 / FGSC 10586
MRALVSEVNNWLSLAILILSLATAARASCALPTSFKWTSTGPLADPKSGWVSIKDFSSVPFNGKHLVYASTVNSAGSYGSMNFGLFSDWSSMDSASQNAMNNGAVAPNLFYFRPKNIWVMAQEWGQYPFNYMTSSDPTNPNGWSSPQALFTGSLSSPGAPIDPALISDGTDIYLFFAGDNGHIYRSSMPNSQFPASFGSNYTTIMTAATNDLFEAVQVYKVDGQNQYLMIVECIGSAGRYFRSFTASSLSGSWISQAASESNPFAGKANSGASWTNDISSGDLIRSTNDETMTIDPCNLQLLYQGMAIGSSGDYNSLPWRPGVLTLTNPGNSSDGSSGGGSGTAAHWAQCGGQGWTGPTTCESPYKCTVSSEWYSQCL

SEQ ID NO: 24726 - protein, 324 aa, Hypocrea virens
  strain Gv29-8 / FGSC 10586
MVAISITRIHDTSLPHFSTDSTNNENNDLSTYCEPNAGIDILVLSFLDIYGLTGNIPSGNIGNYGYIGTTVATCQEAGIKIILSIGGAGSSYSVQSLSQAVAIGKYHWEAYGYSGSTSVQRPFGIVFVNGFDFDVDLNAGNQFYQYLISTLRSNFASDPTNTYYTTGAPQYFSSEFDYLWIQFYNNNGVPANTLAANGNAGGAIYYATPSQFASTVQDTRSSPAFGGIMMWDAGYSDANVNNGCTYAQEAKNILLAGSPCGGSLPVSSSLSTTTAKPTKSATSTRSVSGTSPTGTVPQWGQCGGEGYIGPTQCIPPFKCVESSQ

SEQ ID NO: 24727 - protein, 298 aa, Hypocrea virens
  strain Gv29-8 / FGSC 10586
MPSVKNALILLLGRALLAAGNPVDGERVVKRQCPGIHVFGARETTVGPGYGSSATVVNLVIAAHPGTTSEAISYPACGGQASCGGISYANSVVAGINAVVTAVNNFHNSCPDTQLVLVGYSQGGQIFDDALCGGGDPGEGYPNTAVPLSAGAVSAIKAAIFMGDPRNIHGLSYNVGTCTAQGFDPRPAGFVCPSASKIQSYCDAPDPYCCNGNDANTHQGYGQEYGQQALAFINSKLSSSGTPSGTPTSRPVASSTGSSPSATQTHYGQCGGIGYVGPTQCAAGFTCQVLNSYYSQCL

SEQ ID NO: 24728 - protein, 380 aa, Hypocrea virens
  strain Gv29-8 / FGSC 10586
MAKLSLLLGAFAASVCVQSHALPPPPTVTKAPKLEDRATTCTFSGASGAASASKSQKSCATIVLSNVAVPSGVTLDLSDLNDGTTVIFQGTTTWGYKEWSGPLLQIEGNDITIQGASGSVLNPDGARWWDGEGSNGGKTKPKFFAAHDLTSSSITNLNIKNTPVQAVSVNGVNGLTITGMTIDNSAGDSAGGHNTDGFDIGSSSNVVISGAKVYNQDDCVAVNSGTNITFTGGLCSGGHGLSIGSVGGRDDNTVQTVTFSNSQVTKSANGIRIKATAGDTGTIKGVTYSGITLSSITGYGILIEQNYNGGDLHGSPTSGIPITNLVVQNISGSGGVLSSANNIAIVCGSGACSSWTWSNVVVTGGKKYGSCQNVPNVASC

SEQ ID NO: 24729 - protein, 184 aa, Hypocrea virens
  strain Gv29-8 / FGSC 10586
MFTAQNEYASATGIEQVVTDNIKAAFNGTDTFVDTKRNEVTLNIDFDCPVICPANRATTVTCSGYTQLMSITYTAKMKLVPEVTFTGGFTRAGSKKGETSHFLKGESKKRVYTDIPNGPANELKDKAASNADPWDWTEALDKNPHIQTLVDRISDPQCYEMYVRGKWEGISGWKFVIQTDIKTA

SEQ ID NO: 24730 - protein, 401 aa, Hypocrea virens
  strain Gv29-8 / FGSC 10586
MLSSSLLVSLGLATLAAAAPSRTVKARQASSGQNAVYWGGTNNENDNLSTYCTSSSGIDIVILSFLDIYGPTGNFPAGNIGNSCYVGTNGVPQQCDGLASSIATCQAAGIKVILSLGGAASSYSLASQSQAVAIGQYLWSAYGNSGNTTVQRPFGNVFVNGFDFDIELNAGSQYYQYMISTLRSSFASDPKNTYYITGAPQCPIPEPNMGEIISSSQFDYLWVQFYNNNPTCSLGLPGDAPFNFNDWVTFISTTPSKNAKLFIGAPASTLGANGNAGGAKYYATPDQLASIVDSTKSNPAFGGIMLWDAGYSDSNVNNGCTYAQEAKSILLTGSPCGGSGSPPPPPSSTSKAPPPATSTASSGGGTVPQWGQCGGEGYTGPTQCVAPYKCVAQGEWWSSCQ

SEQ ID NO: 24731 - protein, 102 aa, Hypocrea virens; identical to SEQ ID NO: 24697
  strain Gv29-8 / FGSC 10586

SEQ ID NO: 24732 - protein, 505 aa, Hypocrea virens
  strain Gv29-8 / FGSC 10586
MYQKLAAISAFLAAARAQQVCTQQAETHPPLTWQKCSSSGCTAQSGSVVLDANWRWTHDVKSTTNCYDGNTWSKTLCPDDATCAKNCCLDGAAYSSTYGITTSSDSLTINFVTQSNVGARLYLMATDTSYQEFTLSGNEFSFDVDVSQLPCGLNGALYFVSMDADGGQSKYPTNAAGAKYGTGYCDSQCPRDLKFINGQANVDGWQPSSNNANTGIGGHGSCCSEMDIWEANSISQAVTPHPCETVGQTMCSGDGCGGTYSSDRYGGTCDPDGCDWNPYRLGNTTFYGPGSGFTLDTTKKMTVVTQFATSGAISRYYVQNGVKFQQPNAQLSGYSGNTLNSDYCAAEQAAFGGTSFTDKGGLAQFNKALSGGMVLVMSLWDDYYANMLWLDSTYPTNATASTPGAKRGSCSTSSGVPSQIESQSPNAKVVFSNIRFGPIGSTGGSTGNPPPGTSTTRLPPSSTGSSPGPTQTHYGQCGGIGYSGPTQCVSGTTCQVLNPYYSQCL

SEQ ID NO: 24733 - protein, 491 aa, Hypocrea virens
  strain Gv29-8 / FGSC 10586
MARKLSLLALASLVSLSLQQNCAALFGQCGGIGWTSPTCCVAGAQCIYVNDFYSQCLASTGGGGSTTRSSTSSTSVSRSSSVGSSSGGGGSPTGGASTYTTTDTATVAPHSQSPYPSIAASSCGSWTLVDNVCCPSYCANDNTSEFCSGCGTCTTPPSADCKSGTMYPEVHHVTNNETWHYSRSTHFGLTSGGACGFGLYGLCTKGSVTANWTDPMLGSTCNAFCTAYPLLCKDPAGTTLRGNFAAPNGDYYSQFWSSLPGALDNYLSCGECIELIQTKPDGTDYVVGEAGYTDPITLEIVDSCPCSANSKWCCGPGADHCGEINFKYGCPLPADSIHLDLSDIAMGRLQGNGSLTNGVIPTRYKRVPCPKVGNVYIWLRNGGGPYYFALTAVNTNGPGSVTKIEIKGADTSTWVALVHDPNYTSSRPQERYGSWVIPQGSGPFNLPIAIRLTSPTGEQIVNEQAIKTFTPPATADPNFYYIDIGVQFSQN

SEQ ID NO: 24734 - protein, 200 aa, Hypocrea virens
  strain Gv29-8 / FGSC 10586
MEYNLSTTRNELESGSSSACPRVIFIFARASTETGNMAGGASAGPAVANALESHYGASQVWVQGVGGPYTADLASNFLPGGTSQAAINEARRLFNEANQKCPSSVIVAGGYSQGTAVMSGSISGLSSTVQNQIKGVVLFGYTQNFQNGGRIPNFPSSKLDVFCAATDAVCYGTLFILPAHFLYTDEAADEAPDFLISRIG

SEQ ID NO: 24735 - protein, 452 aa, Hypocrea virens
  strain Gv29-8 / FGSC 10586
MQLYRSITFVFTPAILTLAGLASSSDAFDGQSRRGSHVDRPNIKPHPLHPGKQFPHSPPRDASKYCFVKPSCSHIDDSPNILEAFQRCNHGGTVVFDATYIIASPLDLTFLDRVDVAILGTIGFNNNISYWTEHSFKYEYQNSSAMWRFGGKDVNIYGLGDGLIDGNGQAWYDAFAANPSLQRPILFVLDGLHGGSVSGLQMKNPPMWFNFIANSSEIVVSDIKLNVESTNGNPAKNTDGWDTYRSDSIVLQDSIINNGDDCVSFKPNSTNIVVQGLQCNGSHGISVGSLGQYINEFDIVENVYVYNISMSNASDGARIKVWPGSYTPFQPSLSGGGGSGYVMNVTYDGLYNSNNDWAIELTQCYGSTNLTLCNEYPSNMTISNVIFKNMWGTTSKKYDPKVGTLVCSTPSTCSNIRAQNITVQPPSGKPAQWICNNVNNTLLDINCVAQES

SEQ ID NO: 24736 - protein, 341 aa, Hypocrea virens
  strain Gv29-8 / FGSC 10586
MHLAPRASCTFTDAATAIKGKTSCSTITLNGITVPAGETLDLTGLKDNTQVIFTGKTTFGYKEWAGPLISISGNGIQIQGASGHTIDCAGQRWWDGKGSNGGKTKPKFFSAHSLQNSNIKSLNVLNTPVQAFSINSVTNLGLYNVTLDNSLGDTKGGHNTDAFDVGSSTGVYISGAIVKNQDDCLAINSGTNITFTGGNCSGGHGLSIGSVGGRSDNTVKTVRILNSKVSNSQNGVRIKTVSGATGSVSDIIYDNISLSNIATYGIVIEQDYKNGGPTGTPTAGVPITGLTVNKVTGTVQSGGTNTYILCAACSKWTWTNNAVKGGTKTKKNKGVLSNVSI

SEQ ID NO: 24737 - protein, 102 aa, Hypocrea virens; identical to SEQ ID NO: 24695
  strain Gv29-8 / FGSC 10586

SEQ ID NO: 24738 - protein, 206 aa, Hypocrea virens
  strain Gv29-8 / FGSC 10586
MRLALFLYSLITFVKFSSSTVIVTITAAPAIPSGEPSYSNPTSFTSAILNSTNTYRRQYNASSLYWNTTLEKFATAYLQSDTTCRFAHSGGPYGENLAIGYANATAAVEAWGDEEEKYNFNDPGFTEQTGHFSQLVWKATRGVGCGRKLCGTRGWFVVCEYWPRGNVGGQYGEEVNKRVDGGGGTRLGGPIVAAIAIVLRLRNRES

SEQ ID NO: 24739 - protein, 378 aa, Hypocrea virens
  strain Gv29-8 / FGSC 10586
MRVTTTKIASPASTSVVFFAAMVAAQSCALPSSYRWSSSGPLANPKSPWVALKDFTNVVYNGKHLVYGSTHDSSNYGSMNFGLFSDWSQMGSASQNGMSQAAVAPTLFYFAPKSVWILAHQWGPTAFSYRTSSDPTNANGWSSPQPLFTGSISDSGDNGKIYRASMPIGNFPGNFGSSSTVIMSDSTSNLFEAVQVYTLKGLNKYLMIVECIGANGRYFRSFTATSLGGSWTAQAATESNPFAGKANSGATWTNDISHGDLARSNPDQTMTVDPCNLQLLYQGRDPNSNPSYDLLPYRPGLLTLQNPGTSTGGGGGSMSSSATLATSTVKPTTTSSAPPSGSGAAHWGQCGGIGWTGPTACQSPYTCTYSNPYYSQCL

SEQ ID NO: 24740 - protein, 347 aa, Hypocrea virens
  strain Gv29-8 / FGSC 10586
MLSCGKLALILLAASLQEAVASLSSGCGKAVGTSSGTKSMTVNGKTRQYILQLPANYNASTGYKLIFGYHWLGGTMNNVAPGYYGLRDLARETAIFVAPQGLNNGWANSGGEDLIFTDQMLDYITSNACVDKDQIFSTGWSYGGAMTFELACSRPNVFKAVAVIAGAQLSGCDGGTTPIPYLGIHGVVDSVLPISRGRDLRDKFLQLNGCASKNAPEPAGGSGTHIKTTYDCRPGYPVWWIAHSGDHVPDPKDAGQSQSWAPGETWSFFTQPGLKGQSGGGGGSSSSVTTTSKVTFTTSSTTPTTTAGGGSCSARYGQCGGIGWSGPTCCQLGTTCKYSNDWYSQCL

SEQ ID NO: 24741 - protein, 376 aa, Hypocrea virens
  strain Gv29-8 / FGSC 10586
MKFQTVVYWGQYTGEKSLADYCNSISGIDIIVLAFLNNLLPGNTLSGSLGPLCSIGASGSIQGCNNIASDIKTCQAANVKIIISLGGWYSSISLQSASQAEDVGQSLWDMYGNEPNSTAPRPFGEAFVNGFDFDIEHQDDNYNQYYQNMIKQLRSNFAKDSSNKYYITGAPQCFLPETNMGTIIQNSEFDYLWIQFYNNNCALAIDNGKNFNYKDWTDILFTTQSRNASLFIGLPASVNASTGSDSGSQYYIAPEQLATHINSQKSEQNFGGVMLWDAGYSDGNINNGCTYAQNIHHILVTGSACGHSESLMSSPLSSRTTASAQAAYTPPLETTSSILDKVPIWGQCGGQDYTGPTLCLPPYQCIQLSKWWSSCH

SEQ ID NO: 24742 - protein, 397 aa, Hypocrea virens
  strain Gv29-8 / FGSC 10586
MVRSLAYVGALLAALPSARAGFNASSTQNIAVYWGQNSANQANSQQRLSTYCANAEIDIIPIGFMNGISPVITNFANAGNNCTAFPDNANALDCPQIEEDIITCQKTYGKTILISLGGGSYSQGGFSSASAATSAAQTVWNMFGPVNPNSTVDRPFGSAVVDGVDFDFESGVNNLATFATELRSLMDASASSANRKFYLSAAPQCVYPDYADNPALNGVVSFDFIMIQYYNNGCGVSSYVPGATIQWNYNFDVWDNWAHTVSKNPNVKILLGIAANTGAASGYVSGTQLSAVISFTKQYSSFAGIMMWDMSQLYENSGFLDQVVSDLAAPGSSPPATTSTGGSKPTSTSGGSTGPTGGGGGTVPQWGQCGGEGYTGPTQCQSPYKCVVSSTWWASCQ

SEQ ID NO: 24743 - protein, 318 aa, Hypocrea virens
  strain Gv29-8 / FGSC 10586
MVRRTALLALVALSSISMAQISDNFEGGWDQTTWPTYAPSCNQGGTVSLDTTVAHSGSNSMKVVGGPNGFCGHIFFGTTKVPSGDVYVRVWLQLKTALNNDHVTFIIMPDNAQGGDDLRIGGQSQVLDYNRESDDATLPDLSPQGIASSVNLPTGSFQCFEYYLGTDGTMQTWLNGNLISGMTAGPNADNANDAGWTRKSYVPDITGVYFGWEAYSGDINTVWFDDIAIETSRIGCGGPAASGSTTVHSTASGPTTSKPTTTTKPTTTIPPSTSKTTSSTSATQTKYGQCGGQGWTGPTACPPGSTCTYLNAYYSQCL

SEQ ID NO: 24744 - protein, 347 aa, Hypocrea virens
  strain Gv29-8 / FGSC 10586
MTQKLTSLLVTALTVATGVIGHGHVNNIVINGAYYQGYDPTLFPYEPNPPIVVGWTASDTDNGFVAPDAYQSPDIICHRNATNARGHASVMAGSSVLIQWVPIPWPHPGPVLDYLANCNGDCETVDKTTLEFFKIDGIGLISGGNPGRWASDVLIGNNGTWVVQIPADLETGNYVLRHELIALHSAGSVDGAQNYPQCFNLAVTGTGSLQPTGVLGTKLYQESDPGILFNIYTSPLTYTIPGPTVVSGLPSSVTQRSSTATATSIATVPGSVSTGGTSSKTTTVPRSTSSATTRRSSSSAITTSAPAGPSQTLYGQCGGSGYSGPTICASPAVCSTLNPYYAQCLTR

SEQ ID NO: 24745 - protein, 67 aa, Hypocrea virens
  strain Gv29-8 / FGSC 10586
TGLFASPQCCATDVLGVADLDCIVPTTAPQNAASFQSTCAASGRRPRCCVLPVAGLGVLCTSPVGTQ

SEQ ID NO: 24746 - protein, 457 aa, Hypocrea virens
  strain Gv29-8 / FGSC 10586
MALSSTLPLAAAILVSCIAQIAAAQQPGTSTPEVHPKLTTYKCTTSGGCVAQDTSVVLDWNYRWMHDKNFNSCTVNGGVNSTLCPNEATCGANCFIEGVDYAASGVTVSGSSLTMNQYMPSSSGGYNSVSPRLYLLGSDGNYETLKLNGQELSFDVDLSTLPCGENGALYLSEMAANGGANQYNTAGANYGSGYCDAQCPVQTWKNGTLNTDHSGYCCNEMDILEANSKANAFTPHSCTATACDSSGCGFNPYANGFHNYWAPGGTLDTSKVFTIITQFNTDNGLPSGNLVSITRKYRQNGVDIPSAQSGGDTISSCSSASAYGGLTTMGQALARGMVLVFSIWNDNGGNMNWLDSGNNGPCSSTEGNPANIVANNPTTHVIFSNIRWGDIGSTTGSGGSTPPPPSTTLKTSTTSSRTTTSSAPGCTQTHWGQCGGKGYTGCTTCTAGTTCQYNNDC

SEQ ID NO: 24747 - protein, 164 aa, Hypocrea virens
  strain Gv29-8 / FGSC 10586
MVNEHNIHRSNHSAPDLSWDTTLAGYAQTIAEGCVFAHDMTQGGGGYGQNLASFGSTGNIDDLQIESGRRGVTDQWYNDEMENWTYYGQSNPPSGSNLDAWGHFTQVVWKSSTKVGCYTAKCPAGTVLSFPSWYTVCNYSPPGNFGGEYAENVLPPLGHPTVTV

SEQ ID NO: 24748 - protein, 239 aa, Hypocrea virens
  strain Gv29-8 / FGSC 10586
MRTSLFIGSAIIGATSAYKATTTHYYDGQEGACGCGSSSGAFPWQLGIGNGVYTAAGSQAFFDTAGASWCGAGCGKCYKLTSTGEAPCSTCGTGGVAGQSIIVMVTNLCPNNGNAVWCPNVGGTNQYGYSYHFDIMAENQVFGDNVVVDFEPIACPGQAVADWGTCLCNGIQETDTTPVLGSDTSPPPPGTTSSTPPSSGGQKQTLYGQCGGIGWAGPTVCQPPATCKTQNPWYSQCLN

SEQ ID NO: 24749 - protein, 840 aa, Hypocrea virens
  strain Gv29-8 / FGSC 10586
MKCARVLALFLGAAIPAQAAFTWKNVKIGGGGGFVPGIVFHPKTKGVAYARTDIGGLYRLNSDDSWTPVTDGIANDAGWHNWGIDAVALDPQNDQKVYAAVGMYTNSWDPNNGAIIRSSDRGATWSFSNLTFKVGGNMPGRGAGERLAVDPANSNIIYFGARSGNGLWKSTDGGVTFSKVTSFTATGTYAADPTDPNGYNNDKQGLMWITFDSTSSTSGGATSRIFVGTADNITASVYVSTNAGSTWTAVPGQPGKYFPHKAKLQPTEKALYLTYADGTGPYDGTLGSVWRYDITAGTWKDITPVSGSDLYFGFGGLGVDIQKPGTLVVASLNSWWPDAQLFRSTDSGTTWSPIWQWASYPSMTYYYGISTPKAPWIKNDFIDVTSESPSDGLIKRLGWMIESLEIDPLDSNHWLYGTGMTIFGGHDLANWDTVHNVTIQSLADGIEEFAVQGLASAPGGSELLVALGDENGYTFTSPNSLSTSPQNVWSTPTWATSTSVDFAGNSVKNVVRVGNTAGTQQVAISSDGGVTWSINYGADTSMNGGTVAYSANADTILWSTASSGVRRSQYQGSFTAVSSLPAGAVIASDKKTNTIFYAGYASTFYVSKDTGSTFTTGPKLGSSTSIRDIIAHPTTAGTLYVSTDAGIFRSTDSGTTFTIVSTALTNVYQIALGVGSGSNWNLYALGTGSAGARLYASGDNGATWTDIQGSTQGFGAIDGVRLAGSASTAGQVYVGTNGRGVFYAQGTISGGNGGSPSSSISSSKPSTTTSSRTTLSSSTISTTRTSIVTSTTRTSSSASPSGTGLAQHFAQCGGIGWTGPTQCVSPWKCQEQNEYYYQCV

SEQ ID NO: 24750 - protein, 378 aa, Hypocrea virens
  strain Gv29-8 / FGSC 10586
AQGRHFCYVRPNTDGDDDAPAIMDALNNKCNSKSLVIFPGPVYNIQTNMTTLDLQDVVIYQFGRMLWSTDINYWLSVSMPVGFQNQSTVWYFGGNNVIWDGWGVGTLDGNGQVWYDWAKSQGNLAHRPMNINFRTLTNSVIRRLRFVQSQMWTMAITYSKHWSTLNTDGCDTIFSDSITFRRWIVSNGDDAIALKMNSSNIAVYDSYFENGQGIAIGSMGQYNGKYEYLENFYAKNITLKNTAHVSYLKTWAGISRGYPPNGGGGGYGVARNITIEDVKLIGGRQQPFFAWQCENYSGFAGQDCDSSLFKMEDVAWRRVSGTVQSGVTEAAYFQCSAAAGGCDNFEVTDFDVTHAGSDELLAIWDCFNVNGPQGFACT

SEQ ID NO: 24751 - protein, 242 aa, Hypocrea virens
  strain Gv29-8 / FGSC 10586
MKAALFITSTIVGAASAFKARYYDGQEGACGCGSSSSGAASWQLGISSGVYTAAGSQALYDTAGASWCGAGCGKCYKLTSTGQAPCSTCGTGGVAGQSIIVMVTNLCPNNGNAQWCPTVGGTNQYGYSYHFDIMAKTPVFGDNVVVDFEPVVCPGQATSDWETCLCIDMQETDTTPVGLGDPGSPPSSSSSPPPATSSTPPSGGGTQVLFGQCGGIGWTGPTTCQPPATCKAQNQWYSQCLN

SEQ ID NO: 24752 - protein, 419 aa, Hypocrea virens
  strain Gv29-8 / FGSC 10586
MNKPISSLLLAATLLASGSIAQQTVWGQCGGIGYSGPTNCAAGSACSTLNPYYAQCIPGATTMSTSTKPTSVPASTTRASSTSSATPPAGSGLTRFAGVNIAGFDFGCGTDGTCVTSKVYPPLKNYAGTNNYPDGVGQMQHFVNDDKLTIFRLPVGWQYLVNNNLGGTLDANNLAKYDQLVQSCLSLGVYCIIDIHNYARWNGGIIGQGGPTNDQFTSLWSQLATKYASQSKVWFGIMNEPHDVNINTWATTVQAVVTAIRKAGATSQFISLPGNDWQSAGAFISDGSAAALSQVKNPDGSTTNLIFDLHKYLDSDNSGTHADCVTNNINDAFSPVATWLRQNNRQAILTETGGGNTQSCIQYLCQQFQYLNQNSDVYLGYVGWGAGSFDSTYILTETPTGSGSSWTDTSLVSSCIARK

SEQ ID NO: 24753 - protein, 97 aa, Hypocrea virens; identical to SEQ ID NO: 24694
  strain Gv29-8 / FGSC 10586

SEQ ID NO: 24754 - protein, 397 aa, Hypocrea virens; identical to SEQ ID NO: 24702
  strain Gv29-8 / FGSC 10586

SEQ ID NO: 24755 - protein, 257 aa, Hypocrea virens
  strain Gv29-8 / FGSC 10586
MHLNNIFSTLATTASAVNAMGINCQGSALCVGSNGELSSALDQLRGMDQNQQFTDGQHITCVGSPVSLGNPSLCLFYQKTGRSWTVAQTVRFVQALLDHGCEGCGSIPVDSGNNVQNGMLTANMVAAMGGPPPSRRGMDIVRAVSQKEKPADENAAIKKRGTTTTPSLAKRLGINCQGSSTCQVGGIFNTPAGTLDDLGNSIAGGPDGLWGDGQQIGCIAHVTGRLCAFYQNRVCGSVPTNDGNNVVNGQLTVNYVA

SEQ ID NO: 24756 - protein, 508 aa, Nectria haematococca
  strain 77-13-4 / ATCC MYA-4622 / FGSC 9596 / MPVI
MYRVLATASALLATARAQQACTLNTENKPALTWAKCTSSGCSNVRGSVVVDANWRWTHSTSSSTNCYTGNTWDKTLCPDGKTCADKCCLDGADYSGTYGVTSSGNQLNLKFVTVGPYSTNVGSRLYLMEDENNYQMFDLLGNEFTFDVDVNNIGCGLNGALYFVSMDKDGGKSRFSTNKAGAKYGTGYCDAQCPRDVKFINGVANSDEWKPSDSDKNAGVGKYGTCCPEMDIWEANKISTAYTPHPCKSLTQQSCEGDACGGTYSATRYAGTCDPDGCDFNPYRQGNKTFYGPGSGFNVDTTKKVTVVTQFIKGSDGKLSEIKRLYVQNGKVIGNPQSEIANNPGSSVTDSFCKAQKVAFNDPDDFNKKGGWSGMSDALAKPMVLVMSLWHDHYANMLWLDSTYPKGSKTPGSARGSCPEDSGDPDTLEKEVPNSGVSFSNIKFGPIGSTYTGTGGSNPDPEEPEEPEEPVGTVPQYGQCGGINYSGPTACVSPYKCNKINDYYSQCY

SEQ ID NO: 24757 - protein, 419 aa, Nectria haematococca
  strain 77-13-4 / ATCC MYA-4622 / FGSC 9596 / MPVI
MLLRPIIRPHYEPTPLQPYKAFPTSSPRRKTCFVKPGKKGGDDASKILRAFKKCNNGGTVVLDQEYTICTQLDLRFLKHVDIALTGTVKFCDDVERWLPRTFQFPFQDGSSWWLFGGEDINIYGAGTGTIDGNGQAWYDAHAADSKVKRPLLFVTDGWEGGSITGLKLRQSPNWHNLIANSSDILISDIDIFSRSTSKNFAKNLDGWDTYRSDNIVIQNSYIDHDDDCVSFKPNSTNIIVQGLVCNSSHGISVGSLGQYPGVFDNIENLYIYNISMSNATDGARLKVWPGADVQKPEGWIGGGGEGRVRNVTYERFFNDNNDGAIKIDQCYGAVSAAECEADPSKVILTDILFKDFWGTVSKKNDPVAGSLICSSEDSCDNIRAENVTVTPPSGKDAKWACRNMDEELLDLNGVGCVDA

SEQ ID NO: 24758 - protein, 401 aa, Nectria haematococca
  strain 77-13-4 / ATCC MYA-4622 / FGSC 9596 / MPVI
MRFSAASIVALAASTAAQGTTPKSDLDASVWQGLSSVKETRSWQDLPRNRPAKRQSGWNPPSNLATPLKEVWDHCLKTYSDALGFKNYGWDQLIAGKGKLNMCVRWESDQPVTAAYREEIATTLQTQYNKWFKWLYGYDNFPYTDIKVNVVGWAVKDKSLLQGSTSGIDVYTDVDSEGIPQCSEKCGRFFHQDGNYNQCPGGADRHYDQSLWLTKGMAGGAGGDWGQRLGPEGVGHILLHEMGHTFALDDFYDWTPTGITNFVMLAGSSTTITDFDGWMLRNWWYELSRERGWQSGVSSGSSSGSSSPSAAASKPATTAAASKPTSTKAAVTKPTTTTTKAAAAKPTTTKASAPAAPTAQTGATAAAYAQCGGSSFTGPTTCVSGFKCVKSNEWYSQCVSA

SEQ ID NO: 24759 - protein, 444 aa, Nectria haematococca
  strain 77-13-4 / ATCC MYA-4622 / FGSC 9596 / MPVI
MKCTSIAALGAALAGTLVSAVPAGFVTTNGEKFSLDGEDFFFAGSNAYYFPFNVWGTDHYQDVKVGLVAAKDAGLKVIRTWAFHENNRTYVSGGLPKYNTGGEETVMQFFNSDGTVDIDLGVLDVVIEAAEATGMKLILALTNNWADYGGMDVYTVNLGGKYHDDFYRLPAIKKAYKNYVSAVVNRYKDSPAVFAWELANEPRCGADGSRNLPRGPDCGPELLTSWMDEMSTFIKSLDADHLVTTGSEGGFNRVSSDWAYNGADGADFDAELKLPNIDFNTFHSYPQAWSKTTQWVEQWIVDHAEAANGKPVVHEEYGWTDKSTRVSVLSKWQEVSLQHEVSDMYWQFGYSGYSYGKNHDDGNTIYLEDDEAQPLVYQHAAAVNGGEVPPPSSTTIGTTPGPTQTNGPRQVKYGQCGGSGWTGPTLCESGSTCQVQNQWYSQCL

SEQ ID NO: 24760 - protein, 627 aa, Nectria haematococca
  strain 77-13-4 / ATCC MYA-4622 / FGSC 9596 / MPVI
MAAVRICVCGDESTGKSSLIASLVKDQFVSNRIQPVLPQITIPPSIGTPENVSTTIVDTSARPQDRTTLRKEIRKCNVILLVYADHYSYERVALFWMPYFRSLGVNVPVVLCANKSDLAGQGTTPQVVEEEMLPVMAEFREIDSCIRTSARDHRNVNEVFFLCQKAVTHPIAPLFDYKEGHLKPACVSALMRIFYLCDKDQDGYLNEQEMRDFQARCFDKPLTADDLDNIKLSISKTLPTSDLERGIDLPGFLQLNKLYAEKGRHETIWIILRKYHYTDSLSLEDKFIRPKFDVPEYASAELSPAGYRFFVDLFLLFDKDNDGGLNDRELEALFAPTSGLPSSWTDSSFPSSTVRNEAGHITLQGWLAQWSMTTFIEPKTTIEYLAYLGFEPPNPKDPITAALKITKPRKRRRRPGRVERNVVLCYVLGASGAGKSALLDSFLNRPFDGLYHPTIKPRRAVNSVELPGGKQVYLILEELGELEPAILENQAKLDACDLICYAYDSSDPDSFSHIVNLRSKYPHLDELPSIYTALKADKDKTNQRSELQPDQYASSLSMSLPLHVSVTWGSISELFVAYADAATNPSTAFPKSNEEGPDRTSLYVALGATACAGVAALMIWRRATNAI

SEQ ID NO: 24761 - protein, 380 aa, Nectria haematococca
  strain 77-13-4 / ATCC MYA-4622 / FGSC 9596 / MPVI
MRTSTLLAVANLGTAFAAVQIYGQCGGGAFTGETDCADGSTCVEMNEWYSQCVPESTEAPATEVSSVEEEEENNDAETAPVETSAPVVPSQPAEEEGDDEESAPVETSIAAVPSQPAEEGDNEESTPVVEPTSAAAAPTSGSGSGSGSGSGSGSGGITRTIPASSGSTAAATAIPVSGELDGGMMYYDRSPAVCKDQSETGEDDAMFILEDGATLRNVIIGPGQAEGVHCKGTCTLENVWFEDVCEDAITLKQKSGTSIIRGGGAFHASDKVVQFNGRGTVEISDFYVEDYGKLVRACGNCKDNGGPRNVVIENIAAVDGGVLCGINTNYGDTCTISNSCQDSGKTCDLFEGNSDGSEPTKLSSGPDGTSCKADSFSETC

SEQ ID NO: 24762 - protein, 316 aa, Nectria haematococca
  strain 77-13-4 / ATCC MYA-4622 / FGSC 9596 / MPVI
MPVSKSVSPPKRTLLLAPPTLASHSSALSSVLADYDRSVTDLQMLDRLSAGLVKLPSSTYDRVLILADASFMLGESLALMNRAVLGPVAEALKPNGRLQSQDGNSLEESTLSKEAVLAGLVASRGGFEKPDYGDNEGAVTLKFGLKKKNQPAPLADGSVPLNFKKKKPVEVKPVVPVVPAGVGFIDLSDDLDDDDLIDEDTLMTEEDLLRPINIPVECQPKAGKRRRACKDCSCGLAERLVKEDAEKRAEADKKLESVKLATDDLAEIDFTVQGKVGSCGNCSLGDAFRCDGCPYIGLPPFKPGEEVRLLNNDVQL

SEQ ID NO: 24763 - protein, 219 aa, Nectria haematococca
  strain 77-13-4 / ATCC MYA-4622 / FGSC 9596 / MPVI
MACLGYTGGVPNPTDHISNSKVIEVKAGQVYDGKWAKYDRGSGACKGQNEGGDKDAVFLLHEGATLKNVIIGKDQSEGVHCKGHCTLEFVWFEDVCEDAISIKEDKAGKESWIIGGGAYHASDKVVQHNGCGTVNIINFYVEDYGKLYRSCGNCSKQCKRNVYIEGVTAKNGGELAGINANYGDTATLKNVCADTKQKCTMYNGCAGGCEPKKIGACPA

SEQ ID NO: 24764 - protein, 516 aa, Nectria haematococca
  strain 77-13-4 / ATCC MYA-4622 / FGSC 9596 / MPVI
MLAQVASVLLAAASVATAQSIVGTAYGFASGVTGGGAAAAAIPSSVEQLAEWLSDDTERVIVIDKEYDFTGTTATGAGCDRISCSSSNGGQLYLGDLSCGGSDNTAVSSISYDTAGTTALPVGSNKSIIGTNGKGVLKGKGLSLQKGASNVIIQGIEFTDINPGIVWGGDALDLQGGNDGVWVDHCKFSLVGRMFVVSHYDGSRLTLSNNEFDGVTTTSASCNGNHYWTMMFIGEGDQVTLDKNYFHDVSGRAPKLGADGVTCTFQASNNLFSNMKGHAFDGYNGATALIEGNAFESVNTPITESGASVSTFFNVPDESAAGSCESSLGRACAINSVDSSSGDWPSLSGSGALSTWSNLKEYLVEPVAASEVSSLVKGGAGPANLGTASSTDETESDATEPSTAESSPAVEEAEKTENAPAAAATSEAAAPVETAPVETAPAEAAPVESAPAETGSDNSDSDSGSEVAQWGQCGGLHYIGPTQCASGTSCVAHNDYYSQCVSSATRRMKRALRAKY

SEQ ID NO: 24765 - protein, 468 aa, Nectria haematococca
  strain 77-13-4 / ATCC MYA-4622 / FGSC 9596 / MPVI
MTAYKLLFTAALAGTAFAAPLVEERQACAAQWAQCGGFSWNGATCCQSGSYCSKINDYYSQCIPGEGPATSKSSTLPASTTTTQPTSTSTAGTSSTTKPPPAGSGTATYSGNPYSGVNLWANSYYRSEVTNLAIPKLSGAMATAAAKVADVPSYQWMDSFDHISLMEDTLVDIRKANLAGGNYAGQFVVYDLPDRDCAAAASNGEYSLDNDGANKYKNYIQTIKKIIQSYSDIRILLVIEPDSLANLVTNMDVAKCAKAHDAYISLTNYAVTELNLPNVAMYLDAGHAGWLGWPANQGPAAKLFASIYKDAGKPAALRGLATNVANYNAWSLSSAPPYTQGASIYDEKSFIHAMGPLLEQNGWPGAHFITDQGRSGKQPTGQIQWGDWCNSKGTGFGIRPSANTGDSLLDAFVWVKPGGESDGTSDTSATRYDYHCGASAALQPAPEAGTWFQAYFEQLLTNANPSFL

SEQ ID NO: 24766 - protein, 208 aa, Nectria haematococca
  strain 77-13-4 / ATCC MYA-4622 / FGSC 9596 / MPVI
MPSFTKTILLALAPFAAASPLAARQSGFSGSTQNGLEGACKDVTVIFARGTSEMGNVGSVAGPPFFQALAKEIGSDKLAVQGVEYPASIAGIMDLGSDGGKKMVAVVEQAYKKCPNTKVVLSGYSQGAMLVHNAAKSLPAATTSKIAAVVTFGDPFKSQSFQGIDEGRCKVFCRSGDSVCSGSFVITAAHLQYGQDAQAAADFVAGNL

SEQ ID NO: 24767 - protein, 488 aa, Nectria haematococca
  strain 77-13-4 / ATCC MYA-4622 / FGSC 9596 / MPVI
MKAFLITSLLSALWANAQLIGPVGPTTALSQKTHECSILDYGAVNDNSTDVADSIEKAFKTCVLPHPGSRLIVPDGKYLIKRSVVLSNGTNWAFQLDGLITLAYGGNWTVDRELILQGFAGVGPLNATINGEGDGQFLQNGLTIINPVDFEFYSSNGKGAIQGQGYIYRNLADTFRPRLVRLISPIDTAVHDIILVDSPKFHIVFDFAENLEVYHLTIRGANLGSYDGVDVVGTNYWVHDIEVTNRDECVSVKSPSNHALIENLVCNQAGSGISIGSLNVSASISNVHARNINIIQGNNIAFIKTYPGGSGHVTNITFENFRSKASLYGLDINQYWQNTFEPDTGAVALSNLVFKNFSGSVADGAKRPPLFLAANDLSFAINVTVEDFSIWTESGTSVVNKISNVYGNGDDSYGEADRVKSLASGQSPTPYTSVYTVTATPSGWTAPSFPTWAAASTGYGTDVPIPVYTPAALWKPNGDYDKHYWGSF

SEQ ID NO: 24768 - protein, 125 aa, Nectria haematococca
  strain 77-13-4 / ATCC MYA-4622 / FGSC 9596 / MPVI
MLQSATAKGINCDGSALCGDQKGFLDKVSDFVTDNINGVDPNYHFSNGERIACAGHICAFLQKTSNGASGQEVREAILRLKNHGCKGCGSAPFIDNDVDKGEPTANYVTSTCDDGVCNGALNPKK

SEQ ID NO: 24769 - protein, 233 aa, Nectria haematococca
  strain 77-13-4 / ATCC MYA-4622 / FGSC 9596 / MPVI
MHAPSIVTVLAALPAAMACLGYTGGVPKATGSKSLSAPKTLKKGEVFDAGWVRYDRGVKCSGQAEGGSKDAVFILEEGATLRNVIIGANQREGIHCKGSCNIEFAWFEDVCEDAISILGSGTANIIGGGAYHASDKVIQHNGCGHVNIVNFYANDYGKVYRSCGNCKGNTNCKRSVHMEGTTAVKGGELIGINTNYGDKATYSNNCYPKTQCQGYKGCDKSKGECEPSKAAKC

SEQ ID NO: 24770 - protein, 244 aa, Nectria haematococca
  strain 77-13-4 / ATCC MYA-4622 / FGSC 9596 / MPVI
MKASALIIAAVTGASAAVTTVLPASAGVQSEPTAIPVRKGDKYNGGMKRFVRNPTTCKDQYETGEKDASFILEDGATLSNVIIDRSSGEGVHCKGTCTLNNVWWADVCEDAATFKQKSGTSTINGGGAFSAQDKVLQFNGRGTLNVNDFYVQDYGKLVRNCGNCEGNGGPRNINIKGVVAKNGGELCGVNHNYGDVCTITDSCQNKGKSCQAYTGNDQKKEPPKFGPAGDNGKSCLVKSLRTNC

SEQ ID NO: 24771 - protein, 235 aa, Nectria haematococca
  strain 77-13-4 / ATCC MYA-4622 / FGSC 9596 / MPVI
MLSKSIIGAILAWPALVAAAPHNVEERATPELTITQKLRLADTEIDRFKLLPDDKDFVFDFNKQDGLAAGVANAVTFPALVGTGQTFTVGQFEPCSMAVVHIHPRAAELQAVISGRIYTEMVPESGVTDAEGNQRVIRNEIGAKMMTVFYQGSFHTQMNPDCEPAVVVTTFSSEDMGASLIANNLFALKNETIANTFGQSIAGEDIDKVRDAIPKTITFKVEECLAKCGKTKRQA

SEQ ID NO: 24772 - protein, 481 aa, Nectria haematococca
  strain 77-13-4 / ATCC MYA-4622 / FGSC 9596 / MPVI
MSRISYKSPLPRGLFIIILHNASFGYAPWARHGWPAIRAVHYYPPYQRCCSTNAKVNEVNQTTGQTLSYDTSVGLFDFNGPIELSIQPSEKVYPSIETVRVRPLSYNLKADVHGRTIKLALTKPANLVVEVNGDVFRVLHLFSDEIQKDTISRDEAKKDSSILYYGAGYHELKDQVNITSGQTVYLAPGSFVKGGFNFQNASNAAILGRGVLYKSPYDAITINYSKNIRVQGVTVINPGHYSAMMGSSDGVTVSGLRSISAVKWGDGIDVFCCQNVVLEKLFMRNSDDCVAMYQHRWDYYGDSKNLTLRDSSLWADLAHPIHLGLHGNTVTPETMEDVTISNIDILDHREPQVDYQGCLAINVADENLLKNIQFQDIRVEDFRLGSLLSFKVLYNSKYSSGPGRGLHNITVKNLSYNGKGGNIPAIAGYDKDRRVEFVDFQGLEINGQHVWDGMRKPGWYSTSDFVPLYVGSHVVNLTYSS

SEQ ID NO: 24773 - protein, 376 aa, Nectria haematococca
  strain 77-13-4 / ATCC MYA-4622 / FGSC 9596 / MPVI
MTKINFLLAALAGSAIAAPSVPLIDAPEHFKRADSCTFSGSSGAAAAMKAQSSCTTLTLNNVAVPAGTTLDLSKLKDGAHVVFKGTTTWGYKEWTGPLLKISGKKITVDGAGATLNADGARWWDGKGGNGGKKKPKFFAAHSLTDSVFNDLYIKNTPVQAVSINTVNGLTINKMTIDDAEGDSKGGHNTDGFDIGESTGVTINGAKVYNQDDCVAINSGKDITFSGGLCSGGHGLSIGSVGGRSNNVVDTVKFLNSQVTKSTNGLRVKTMKNTSGQVKGVTYSDITLSKISKYGILIEQNYDGGDLHGDPTSGLPITGLTLKNISGSGAVDAKGTNIAIVCGKTGCSNWTWSNVKVNGGKDYGSCQNVPSVATCKA

SEQ ID NO: 24774 - protein, 406 aa, Nectria haematococca
  strain 77-13-4 / ATCC MYA-4622 / FGSC 9596 / MPVI
MKLVSLILLFLGVSVEASRRKTCIVKAGGTNATDDAPAIIEAFEKCGRRGRVIFHPTTYHINSVLNITWLDDVYIDLKGTLLWSTDIEYWLQNSLDVGYQNQSTAFILGGNKVVLDGHGTGTLDGNGDYWYQWIRKQANSSNYPGRPHAITLNGLTNSIVRGVNFLRSQMWTMSIIYSHRVTNTDGADTIRSSFIKFDNWTVYSGDDSISLKANSTDVSITNSRFYNGLGIALGSIGQYNKQFETIERLHVDNCSFYNTLHAVYFKTWTDDQNGYPPNGGGGGLGFAADMSFKNLKSVGMRGAAVAISQCTRFRGAPGQGNCTNSQFQIRDISVKGLTGTTKSSRVASLQCSAVAPCTNISLFDTDLRFDNGTEAPDYLCGNVKGERGFECTGEPCTGPSATGECS

SEQ ID NO: 24775 - protein, 637 aa, Nectria haematococca
  strain 77-13-4 / ATCC MYA-4622 / FGSC 9596 / MPVI
MRSVDSLLLLGLTGLASQANAHPAKRQPNDSPLSKRGVDLDAFRLPELAKYVPQDEVPDISNARIAPSSDYTKTAEEFVKSVVGKATFRLVSDHYVGTNGVAHVRFKQTVNDIDVDNADFNVNIGADGKVFSYGNSFYTGKIPGPLVKRDTSDPVTALKSTVEVLDLPVDASDAKAEPKGDEHYTFTDTSGTVKKPEAKLVYLIDGEQNLKLTWRVETDVLDNWLLTYVDADKTEKVVGVVDYVADLATYEVYPWGVNDPSKGSRSVVEDPWNIATSEFTWISDGSANYTTTRGNNAIAQVNPSGGTAYLNNYRPSSSSLEFEYTFSTTQTDPVSYRDASITQLFYTANKYHDLLHLLGFNEAAGNFEVNNNGQGGAGNDFVILNSQDGSGTNNANFATPADGSPGRMRMYLWTYSTPRRDSSFDAGVVIHEYTHGLSNRLTGGPANAGCLSGTESGGMGEGWSDFMATAVHLGARDTRSTNHVIGDWVYNNANGIRAYPYSTSLTTNPYTYRSVNSLSGVHAVGTYWATALYEVLWNLIDKHGKNDADTPTFDSNGVPTDGKYLAMKLVIDGMALQPCNPNMVQARDAILDADVALTGGDNQCELWTGFAKRGLGTGARYSSTSRTESFALPSGVC

SEQ ID NO: 24776 - protein, 324 aa, Nectria haematococca
  strain 77-13-4 / ATCC MYA-4622 / FGSC 9596 / MPVI
MKASMFLVGASAILASASPIRAPLEKRLVKRALTTEWVYEYVTVTVTEGDAPVTEKAVPTAVVFLEEPSQPAPEPTTEVKKPVSRRPKQQPTTTKVAPAPKPTYVEPEPEPTTEKPSVVVVTTKQEPTTSKEEAKPVATEESGSSSGSYDLSLEGDYTSIMLNYHNIHRANHSAPDLIWDDTLAGYAENTANGCVFEHDMTQGNGGYGQNLASWGATGDIDDMQKKSAAGGITNQWYNSEMGNWAFYGQENPPDGMDIQLYGHFTQVVWKDSTKVGCATVKCPAGSVLQYPSWYTVCNYNPQGNFGGRYGDNVLQPKGEKRVTV

SEQ ID NO: 24777 - protein, 392 aa, Nectria haematococca
  strain 77-13-4 / ATCC MYA-4622 / FGSC 9596 / MPVI
MKFSQASLLAACLPAISARFIETAEADNVILKPDELYLIETAPGKTQWVTEDQKWELRRNGQRFMDITDTPSLGSTRLNAQTVSFPKKCVKQDEVADLSKNLEKKNMKANLEKLTSFHTRYYKSNYGLESSDWVLEKVNQIIKDAGAQDTVYAESFPHTWQQHSVIATIPGQSNSTVVIGAHQDSINLFLPSILAAPGADDDGSGTVTIMEVFRALLNSKDVVDGKAPNTIEFHWYSAEEGGLLGSQAIFQSYEQSGRDIKAMLQQDMTGYVQKTLDAGQPESVGVITDFVDPGLTTFIKTVVEEYCNIPWVETKCGYACSDHASASKAGYPSAFVIESAFEYSDPHIHTTDDNIKYLSFDHMLEHARMTLGLVYELGFYDFSDSSEDRGDL

SEQ ID NO: 24778 - protein, 227 aa, Nectria haematococca
  strain 77-13-4 / ATCC MYA-4622 / FGSC 9596 / MPVI
VALPLVLAATAQGHIARDTACKDVHIFLAKGNNEPYPGRQGKLAGAICSGLDSCDYEDIQFYNPLEAPYCGSVFEGAKNGIQQITAYNKRCPDSKLVVSGYSQGGHVVGDILGGGGGVFFQDCVQEPNKGLDPKTRPANKIVAAMIFGDTRHTANQPYNVLSGAGKDGLFPRPGDQLANLAKYGDVLHNYCVDTDPICAQGDVVETHLNYFDVFTDDVAGWVKERVN

SEQ ID NO: 24779 - protein, 204 aa, Nectria haematococca
  strain 77-13-4 / ATCC MYA-4622 / FGSC 9596 / MPVI
MRLLLLPLVSLLGVTLAADDVVTITAPAAIPSNEPEWKNDKTFVSAVLNSTDFYRAEHNASSLEWNRTLEDFATDYLDDNDDCEFEHSGGPYGENLAIGYGNTTASIEAWGDEREDYDFDKPKFSKATGHFSQLVWKDTTDVGCGRKLCGDRGWFLVCEYWPRGNVIGQFTDQVNKKEGNDAVRPRPGVALALAIVVGYLVVWV

SEQ ID NO: 24780 - protein, 401 aa, Nectria haematococca
  strain 77-13-4 / ATCC MYA-4622 / FGSC 9596 / MPVI
MRSSTLIALVGPLAVHAASGNGHSTRYWDCCKPSCSWSGKASVSAPALTCDKNDNPISDADAKSGCDGGSAFACTNYSPFAVNDNLAYGFAATKLSGGSEATWCCACYALTFTTGPVKGKTMVVQSTNTGGDLGENHFDLQMPGGGVGIFDGCSSQFGGSGLGGAQYGGISSRSDCDKFPELLKDGCYWRFDWFQNADNPDFTFEQVQCPKALTDISGCKRNDDSSFPAYKGDTSSSGSTGSKASTSKAAVQSQKTQAPASTKVQQPSNPQTQVQSSASNPQKTQVQNSASNPQKTQVQNSASQPQQTQAPVKEPATPKTTKVGASKTRSGCSVPKKTKQTAQATAKASATKSAPATAQSAVAAWYQCGGSKSAYPNGNLPCASGSTCVQHNEYYAQCVPN

SEQ ID NO: 24781 - protein, 224 aa, Nectria haematococca
  strain 77-13-4 / ATCC MYA-4622 / FGSC 9596 / MPVI
MSSLRQSLVTLALAMPLALACVAKNSIPEATETISNTEPIEVAAGEVFDGKGARYDRGADPITGQADTVFILREGATLRNVIIGPDQHEGVYCIGGGCTIENVWFEDVCEDAISIKEDAAGTTTNIIGGGAFHAADKVIQHNGCGAVNIKDFYAEDYGKVYRACGTCDACKRDVHVEGVSAYGGGEVVGINIETGDTAELVNVCTDAKTPCQLYDGPGSKAGEC

SEQ ID NO: 24782 - protein, 210 aa, Nectria haematococca
  strain 77-13-4 / ATCC MYA-4622 / FGSC 9596 / MPVI
PQADGTSVLDAPMTIAAGETFDGKNVMFDRGVSCTGQDEGGDSDAVFILEAGASLSNVIIGPNQIEGVHCNGGCTLTNVWWDAVCEDAFSIKKQADGETTTINGGGAKGAEDKVIQHNGGGTVVINDFTVSDFGKLYRSCGNCKEMPARHVKVSGGSASEGKVLVGINPNMGDTASISGISVTNVKEQCVAFNGVTDGSEPEKVGSCDAD

SEQ ID NO: 24783 - protein, 286 aa, Nectria haematococca
  strain 77-13-4 / ATCC MYA-4622 / FGSC 9596 / MPVI
MVAFSFLFAGLTLATGALSAPGAIPLSKRAGTPSSTGTHDGFYYSWWTDGGADATYTNGPGGEYTVKWSDGGNLVGGKGYNPGGRRTVEYSGTYSPEGNSYLVLYGWIKSPLIEYYVVESFGTYNPSSGGEKKGEVTSDGGTYDIYVSTRTNAPSIEGTQTFQQYWSVRREKRVGGSITTGNHFDAWAEAGLELGSFDYMIMATEGYFSSGSATITVGGSEPAESEASPVTSQPGSGSGSGSGSSGSNVSACAPQWGQCGGQSWTGATCCQSGTCTEHNPWYSQCL

SEQ ID NO: 24784 - protein, 371 aa, Nectria haematococca
  strain 77-13-4 / ATCC MYA-4622 / FGSC 9596 / MPVI
MTFFKTSSLLAFAYSAAKVAAHGHVDWLITNGVAFRGYDAPAMSWNPNQPPVVGWITGATDNGYVEPNSFSDPDIICHRAARPAKGHVTVEAGDKVVLQWNTWPESHKGPVIDYLAKCPGDCETADKNSLEFFKIGESGLLDMTMQSGRWAADVLVANSFSWTLQIPAQLEPGNYVLRHEIIALHGAGQTNGAQNYPQCFNLKVTGGGSLAPSGVKGTQLYKSNDPGILFNLYTSSLSYKIPGPTLVPGLPSTVGQLAPQATATSSATTPGQTQGPSSTSTTRSSSSTSLTISGVTTLRTVTATTTSSSSSSSSSSSKASPSPTDDDIICGPATGGLPKYSQCGGKDYTGPTVCQWGSTCQVLNPYYSQCL

SEQ ID NO: 24785 - protein, 286 aa, Nectria haematococca
  strain 77-13-4 / ATCC MYA-4622 / FGSC 9596 / MPVI
MKAFMPLVAFFGTVTAQLQQITNFGSNPSGAKMFIHVPTNLPSNPAIVVAIHYCQGTAQSYYQNTPYAQLSDQKGFIVIYPESPYSGTCWDVSSKATMTHDGGANSNSIANMVRYALQTYKANPAKVFVTGSSSGAMMTNVMAATYPDLFAAGIVYSGVPAGCFFTNSVNGWNSDCAQGRVNKSPADWAQMVKDAYPGYNGARPKMQIYHGGADNILLSPNYQETIDQWAGVFGYNSVSPQSSNNNVPQAGYKTDTFGPKLVGIFAQNVGHSVPVRGADDMKFFGL

SEQ ID NO: 24786 - protein, 249 aa, Nectria haematococca
  strain 77-13-4 / ATCC MYA-4622 / FGSC 9596 / MPVI
MYFSKLAISMLAATGAVAHPHARRAAQNDVVVVEYVTKVVTEYGTSQPTAAPQRQAKQHNWWTWKPSQPEQVEQPAATTVVVEAPKATSAPAASAPAASSGSSGSSSGNLDADQKGALDAHNAARAAVGNPDLVWDDELAAGALEYAKQLVGIGSLVHSGADGFGENLYQGGEGEETPLTNAVNMFNDEKKDYSGQAIDSTNYMTFGHYTQVVWKSTTKVGMAKAEGNGKCFVVARYQEPGNMIGEAAY

SEQ ID NO: 24787 - protein, 258 aa, Nectria haematococca
  strain 77-13-4 / ATCC MYA-4622 / FGSC 9596 / MPVI
MSMLLLAGTALAAPAAKSVAERANDSIDNVLPPIVPINTRSGDRDLIAKLITAPTQVERAKLLDQPGDYVFDFEAATGSGESKGKGGRSTSATALTMPALIGNGASMTVAFLGPCGMNTAHVHNRATELNIIVKGRLVTNFVIENGAKPIQNTMDTWQMSVFPKGAIHQEFNPDCEDAVFVAGFNDPDPGVNQIAQNFFSLNGDVVSATLGGVQTIDGKDIESFREVIPANIALGIDACLNKCGIKRNAKRSISEILA

SEQ ID NO: 24788 - protein, 425 aa, Nectria haematococca
  strain 77-13-4 / ATCC MYA-4622 / FGSC 9596 / MPVI
MPSFHQLSLLLGTILPAALAAPFASNHKLQEGVIHGKYIVTLKTDSDDTTVQSHLHWVEGVHRRSLSKRRIVGIQSTYNATNWHGYFGEFDEDTIKEIEASPEVAFIEPDHKIHLQGDYEDGKVYFWEQPGQISKRALTTQQGATWGLGTISHREPGFTTYTYDTSVGANSYAYVVDSGVQVNHSEFEGRAIAGYSVSPAAHVDTVGHGTHVAATIAGKTYGVAKKAQIISVKVSQGRESSNSASLQGFDWAVNDIVSKKRAGRSVINLSLGGPASQAWTAAIASAYKSGILAVVAAGSGDEDRNPLPTSRRSPANAPNALTVGAIDSDWNPTSFTNYGPEVDIMAPGDHIESAGIGSSNAVATMSGTSMACPHVAGLALYLQVKENLSAPAAVTKRIKALGTPGRISGNLNGSANLVAFNGVRQ

SEQ ID NO: 24789 - protein, 233 aa, Nectria haematococca
  strain 77-13-4 / ATCC MYA-4622 / FGSC 9596 / MPVI
MKFFALTTLLAATASALPTSNPAQELEARQLGRTTRDDLINGNSASCADVIFIYARGSTETGNLGTLGPSIASNLESAFGKDGVWIQGVGGAYRATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSARGG

SEQ ID NO: 24790 - protein, 289 aa, Nectria haematococca
  strain 77-13-4 / ATCC MYA-4622 / FGSC 9596 / MPVI
MRASLDQTLLLSCPDIQIFGARETTVSPGFGSAGALIDMIKADHSGVTAEAIEYPACGGQSSCGGVQYGDSAKQGTEAVTTAVNDFHSRCPDSQIVLVGYSQGGHIMHNAICGGGDSGAGITDTAVPITASAVAQVKAAILLGDPRYVSGLAYGVGTCTSGGFDARPAGFVCPNAAKVQLYCDAEDPYCCDGNDANHHQQYVTLYGTEALAFVNGKLGASGEAAPVQPSTGSDDSAGGSPSATGGNGQEQGTNCAALWGQCGGQAFTGATCCSEGTCKQFNQYYSQCLN

SEQ ID NO: 24791 - protein, 484 aa, Nectria haematococca
  strain 77-13-4 / ATCC MYA-4622 / FGSC 9596 / MPVI
MHSFRTLYLVGAFALTLVNAVSLPAGVPRDVSEFRDKHHYKPPHHGHRKIITIRPSKNDHDDASERFKRGVLKANGGGTLYLPKGKTFVIGKALDLTGLNDIHVHLDGEIRFTDDVEYWQENAWYHPFQKSIMFWKWGGKNIKIYGEGVIEGQGQRWWNEFEAGTGSILNPDNKYYRPILFYAENTTNLEISGIHLKDSPCWNNFIVSSKNIRYTDVVATALSNNGSIIPKNTDFMNTMNTSTVHIERAWVNIDDDCFSPKPNSSDLYVNTMYCNGTHGQSMGSLGQYEGEVSNVHDVHIENVWMLNGDYSGARIKVWAGEKTGTGYVNNVTFKNFWVARMDYGIFLDSCYFNKSAEECNKYPSGMDITNIHFENFTGYTSGVYGNAVARLSCSASESAVCSNITLKDFNVETPCGGKPVIICDGMHGDIGVDCVPYESEEAQAALKAKCKIPIVGIDTDPWGSGVIERKKDAFHPISREIGDD

SEQ ID NO: 24792 - protein, 519 aa, Nectria haematococca
  strain 77-13-4 / ATCC MYA-4622 / FGSC 9596 / MPVI
MYRAISLATALIASVRAQQACTSTQETHPPLTWSKCTSSGCTEVSGSVVVDANWRWTHTVEGSTNCYTGNKWDTSICPDGKTCAEKCCVDGADYAATYGVTTSGDQLSLSFVTKGAYATNVGSRLYLMEDDETYQMFSLLGNEFTFDVDVSQISCGVNGALYFVSMDEDGGKAKADGNKAGAKYGTGYCDAQCARDVKFINGEANVENWTPSESDPNSGTGNLGACCPEMDIWEANDISTAYTPHPCKTLTYHTCEGDDCGGTYSTTRYAGTCDPDGCDFNPFRQGNETFYGPGSEFTVDTTKKVTVVTQFIKGTSGGLSEIKRFYVQNGKVIGNPESKVASNPGNSVTEEFCSAQKKAFGDDDDFVAKGGFSQMSDALAAPMVLTMSLWDDHKANLLWLDSTYPVDSTGAGSKRGTCSTDSGVPKEVEAEAPNSKVSFSNIKFGPIGTTFEGGDSASSGSGSSSTSPSKAPSSGSDSSSAAGAYQRCGGQGWTGATTCVSGYTCKEQNTWYSQCVASA

SEQ ID NO: 24793 - protein, 242 aa, Nectria haematococca; identical to SEQ ID NO: 24532
  strain 77-13-4 / ATCC MYA-4622 / FGSC 9596 / MPVI

SEQ ID NO: 24794 - protein, 454 aa, Nectria haematococca
  strain 77-13-4 / ATCC MYA-4622 / FGSC 9596 / MPVI
MLLGNLISVSAFCALLSPALAKPSHGLPKRPHVEVSPYSTGKDFPAPSKRDSHRYCYVKPGKGSNSNDASRILKAFKKCNNGGTIVLDKEYTVASPLDLTWLKHVDVVITGEVNFKPDPYYWAENSFKFPFQNMSSFWKVGGEDIHIYGDLSNEQSVLDGHGQAYWKEIETNKTLLRPILFTFEGAHGASMTNLRMRNSPNWFNIIANSTDVLISDLDIRASSLDGVKIANSDGWDTYRSDNVVIQNSYIDNTDDCVSFKPNSTNVLVQNLVCNGSHGISVGSLGQYKGETDIVENLYIYNISMSNASDGARIKVWPGIETKFQSLLNGGGGLGRVRNVTYDRFYHENNDNAITITQCYGQKNQTLCNEFPANLTIEDITLKNMWGTTSKKYDPRAGTLVCSAPDRCSNIVAENITVTVPSKEPPVYDCQNLDTTTLDITCVDPADKDRDTSQG

SEQ ID NO: 24795 - protein, 231 aa, Nectria haematococca
  strain 77-13-4 / ATCC MYA-4622 / FGSC 9596 / MPVI
MHSASLVSLIAALPAAMACLGYEGGLPTPTDSKSLSAPQYIKAGQTFDAGWVKYDRGQSCSGQSEGGEADTVFVLEEGATLRNVIIGKNQKEGVYCLGSCNLEFVWFEDVCEDAISIKGDGTANIIGGGAYKASDKVIQHNGCGHVNIVNFYANDYGKVYRSCGNCKNNCARSVHMEGTTAVNGGELIGINTNLGDKATYSNNCYPKVQCQGYNGCDKANGDCEPTKAALC

SEQ ID NO: 24796 - protein, 307 aa, Nectria haematococca
  strain 77-13-4 / ATCC MYA-4622 / FGSC 9596 / MPVI
MKATVLLSLLPALAQSAVIAPRQSRTGDGSQGDSDATQGDLGGRPPPRFPFPITKFPVAKETVVFENVKYIMPGEVFDGGMKRYERPEGSCNEQAEGTDADAVFNLMPGSTIRNVIIGKNQAEGIHALGDAWVENVWWEDVCEDALTSKGLNTQLRVIGGGARSATDKIFQDNSLGGKYNITGFYAEDFGTFYQSCGNCLNQAKRNATIQNVVAVNGLRMGIINPNYGDEFRLKNSQIDNVTSIVDKEIGNNVQTVPYYIGNGPDEKYALYNETRDHIVDFDGKVTNQYEPEDPYEWLSEFWPEGFN

SEQ ID NO: 24797 - protein, 100 aa, Nectria haematococca
  strain 77-13-4 / ATCC MYA-4622 / FGSC 9596 / MPVI
MKFPVVLALASIVCALPASEKRQTYVPCTGLYGTSQCCATDILGLANLDCGNPPSTPSDADNFSAICAEIGQRARCCVLPIASTLLDQGVLCNTPSGVQD

SEQ ID NO: 24798 - protein, 384 aa, Nectria haematococca
  strain 77-13-4 / ATCC MYA-4622 / FGSC 9596 / MPVI
MRYLLPLSGLTGLALAQNGAWQQCGGQNWSGSTTCISGYTCSFINDYYSQCVPGSNPNPPSTTLSTVTQPSSSPTNNPNPGTGKFVWVGTNEAGGEFGEGNLPGTLGKDYIFPDTAAIDTLIGQGYNTFRVQLKMERLTSTLTGSHNQAYLDGYSKVINHITSKGAYAVLDPHNYGRFFGNVITDTSAFQTWWKNFAAVFKNNDHVIFDTNNEYHSMDQTLVLKLNQAAIDGIRSTGAKQYIFVEGNQWSGAWSWPDVNDNMKALTDPEDKIVYQMHQYLDSDSSGTNEACVSSTIGAERVKAATAWLKKNGKVGIIGEFAGGANSQCKAAVQGMLDYLEDNSDVWKGVLWWAAGPWWGNYMYSFEPPSGTGYQYYNSLLKSYV

SEQ ID NO: 24799 - protein, 360 aa, Nectria haematococca
  strain 77-13-4 / ATCC MYA-4622 / FGSC 9596 / MPVI
MISPLFMLAGFAASALALPTALEARAGCTFTDAASAIKGKASCSTIILNNIAVPAGTTLDLTKLKDGTHVIFQGKTTFGYKEWEGPLIAFTGNNLLIEGASGHSIDCQGQRWWDTKGSNGGKTKPKFFSAHSLKNSNIKNLNVLNTPVQAFSINGVTNLGVYGVHMDNSLGDTQGGHNTDAFDVGSSTGVYISGAVVKNQDDCLAINSGTNITFTGGNCSGGHGLSIGSVGGRSDNVVKTVRILNSVIANSDNGVRIKTVYGATGSVSDVKYDTITLQNIAKYGIVIEQDYDNGSPKGVPSAGVPITDVTINKVTGTVKSSGTDIYILCASCKNWTWTGNKVTGGKTSDKCKGVPTGASC

SEQ ID NO: 24800 - protein, 254 aa, Nectria haematococca
  strain 77-13-4 / ATCC MYA-4622 / FGSC 9596 / MPVI
MKFSMVIAGLFASAAIATPQGNITPNTMGALEKRASFPIPASKGSVTYKSAQSVKGTFDGGMKTYGRGAKCTGQKEGGDKDAVFILENGATLKNVIIGADQIEGVHCKGSCTIENVWWKKVCEDALSLKGDGNALIKGGGATGASDKVIQHNGLGTVTIDGFTVVDFGKLYRSCGNCKKMGTRNVVVKNVKAYNGKLLTGINSNKGDKATISGTCATSVKKICTEYEGTVPGKEPKELRSGVSAACKYTTVKSC

SEQ ID NO: 24801 - protein, 228 aa, Nectria haematococca
  strain 77-13-4 / ATCC MYA-4622 / FGSC 9596 / MPVI
MKFLPFVALLAGLSRALPLDAAANDGSLTTRALFSSDELLDGDAGSCPSAILVYARGSLEFGNLGFLGGLVGDGIKTVLGEDQVWTQGVGGDYSAAIGDNGLPDGTSPEAIQEMIGLFELADKKCPNATLVSGGWSQGAALVAASIRDLNPTIRGKIAGVILFGYTKNKQNNGRIPNYPADRLRVFCNDGDAVCEGELSITIPHLFYLSEARREAPEFLIEQINKYQA

SEQ ID NO: 24802 - protein, 227 aa, Nectria haematococca
  strain 77-13-4 / ATCC MYA-4622 / FGSC 9596 / MPVI
MLANIAITLAATITPVLACKGYEGGLPTPTSTKQISAPIYVKNGEVFDAGWAKYDRNPSSCSGQAEGGEKDTAFVVERGGTLRNVIIGKTVGEGVYCKGGGCNLEFVWFEDVCEDAISIVNRAGDVTNIIGGGAYHASDKIIQHNGCGKVNIINFYAEDYGKVYRSCGTCEKCAREVYIEGVTARKGGEVAGITKANGDKATLVNVCTDAKTPCQNYSGPGKKDGPC

SEQ ID NO: 24803 - protein, 382 aa, Neosartorya fischeri
  strain ATCC 1020 / DSM 3700 / FGSC A1164 / NRRL 181
MSQTKSLSLLAVLLSATRVAAHGHVTNVVVNGVSYAGFDINSYPYMSDPPKVAAWTTPNTGNGFIAPSAYNSPDIICHQNATNAQAYIEIAAGDRIQLQWTAWPESHHGPVIDMLASCGESCTTVDKTSLKFFKIDGVGLVDNSAVPGTWGDDQLIANSNSWMVEIPKSIAPGNYVLRHELIALHGAFEEGGAQNYPQCFNLKVTGSGTDSPAGTLGTELYTESDPGLLVDIYKSIASYAVPGPAMYSGAVSITQTTSAITSTGTATVGSGADSTPVPSSAASSKYSTIAVQVPTTKAQYTPVPSSSPSTFVTSPAPSTPVPSSSSVPVTSSTAAPQPTPAPGGTQTAYGQCGGRNWTGPTACASGSTCKTWNPYYSQCVPN

SEQ ID NO: 24804 - protein, 215 aa, Neosartorya fischeri
  strain ATCC 1020 / DSM 3700 / FGSC A1164 / NRRL 181
MNLRLLTLALAGLAAASPVAIQERQFSSGNELRDGACKPITFIFARASTEPGLLGMSTGPAVCNNLKAAKPGQVACQGVGPAYTADLGSNALPENTSPAAINEAVDLFKQAASKCPDTQIVAGGYSQGTAVMDGSIKRLPDEVKEKIKGVVLFGYTRNAQERGQIANFPKDKVKIYCAMGDLVCDGTLIVTAAHFTYGANTGDAARFLLGKLSTA

SEQ ID NO: 24805 - protein, 368 aa, Neosartorya fischeri
  strain ATCC 1020 / DSM 3700 / FGSC A1164 / NRRL 181
MRSVELLSLAALGSLVAAAPAPSRVSDLTKRSSTCTFTAASQATESASGCSEIVLDNIEVPAGETLDLSDVDDGTTIVFEGTTTFGYKEWSGPLIRFGGKDITVKQNSGAVIDGEGSRWWDGEGTNGGKTKPKFMYAHSLEDSTITGLSIKNTPVQAISVQATNLYLIDITIDNSDGDDNGGHNTDGFDISESTGVYIRGATVKNQDDCIAINSGENIEFSGGTCSGGHGLSIGSVGGRDDNTVKNVTITDSTVTDSANGVRIKTVYDATGSVSEVTYSNIKLSGITDYGIVIEQDYENGSPTGTPTTGVPITDLTIDGVTGTVESDAVEVYILCGDGSCSDWTWEGVDITGGETSSKCENVPSGASC

SEQ ID NO: 24806 - protein, 363 aa, Neosartorya fischeri
  strain ATCC 1020 / DSM 3700 / FGSC A1164 / NRRL 181
MKVTVLASAILALINGALALPANAPTLDVTLTQVDNTRIKATVKNIGNEEVTFVHLNFFQDAAPVKKVSLFRNATEVEFTGIKRRYLTEGLSDDALTTLAAGATFEDEFDIASTADLTEGGTVTIRTDGVVPMATDRKVSGYIPYQSNELEIEVDAAKAATVPQAIKLLDRRTKVASCSGSRASALSTALRNTVSLANAAASAASSGSSARFQEYFRTTSSSTRNAVAARFRAIANEASSQSSGKTTYYCTDPYGYCDSNTLAFCLPSSNVIANCDLYYSDLPALTRSCHAQDQATTSLHEFTHAPGVYSPGTDDFAYGYRASTALSASQALLNADNYALFANGTPPSFPSPHPLSSAQTNMV

SEQ ID NO: 24807 - protein, 403 aa, Neosartorya fischeri
  strain ATCC 1020 / DSM 3700 / FGSC A1164 / NRRL 181
MLSIKRTLLLLGAVLPAVFGAPVQETRRAAQKIPGKYIVTFKPGTDAATIESHTLWATDLHKRNLERRDATSGEPPIGIEKNYKIKDFAAYAGSFDDTTIEEIRKSADVAHVEEDQIWYIDALTTQKGAPWGLGSISHKGQASTDYIYDTSAGAGTYAYVVDTGINVNHVEFEGRASLAYNAAGGSHVDSVGHGTHVAGTIGGKTYGVAKKTNLLSVKVFQGESSSTSIILDGFNWAANDIVSKGRTRKAAINMSLGGGYSYAFNNAVENAFDEGVLSVVAAGNENTDASNTSPASAPNALTVAAINRSNARASFSNYGSVVDIFAPGQDILSAWIGSNTATNTISGTSMATPHIVGLSVYLMGLESLSGPAAVTSRIKQLATNGVVTNAQGSPNKLAYNGNA

SEQ ID NO: 24808 - protein, 572 aa, Neosartorya fischeri
  strain ATCC 1020 / DSM 3700 / FGSC A1164 / NRRL 181
MAFNFNWSPLMADASFYTRAQDLLTAALNKSPKPPIIVDDIIVTELNLGSIPPELEILEIGDLAEDRFRGIFKMSYSGDAFLTLKTRVQANPLNTYLLTRPSFATPRPLAAATPLTIPLQITLSDFKLSGFVILVFSKQKGITVVFRNDPLESLKVSSTFDSIPFVRDFLQKEIEAQLRILFMDELPAIIHRLSLRLWVPEYRAGEELQTQTESANGEGPGQDPLASPPQDPVDALGNALNESEIESLSLDSSVETHSLFSQKNLLRLAALTDSQRTLSLFTPSIREVVYRAWTSPSDQTDASGGVTSPFSPVLSRTQSQVGSMSSFPDSASMVSNQSRSSTPSHTFSGYGLSLGAGRHSKAHARKRKKRVVDLRRPKTTDDAPSVSDESAFTESTSTPSICSAPMPVLDEQTDDPVTPPLSPDRDLHLPAIPERHGMSISRPALRREIASEMIRDTAESKPSSNPVGQAIQDEDLSATPRAAVRAHGASVLEKEKQATGSSAGSSRQLPSTILPFINDSPTGRVVDQALVERLAGEIARRMRDEKFLASNACGPFWDRHSQEESPPPAYGH

SEQ ID NO: 24809 - protein, 314 aa, Neosartorya fischeri
  strain ATCC 1020 / DSM 3700 / FGSC A1164 / NRRL 181
MVVLSKLISSILFASLVSAAVIERQATSINQAFTSHGKKYFGTASDQRLLQNSQNEAIVRKDFGQLTPENSMKWDATEPSRGSFNFAGADFLVNYAKQNGMKVRGHTLVWHSQLPSWVSAITDKNTLTSVLKNHITTVMTRYKGQIYHWDVVNEIFNEDGSLRDSVFSRVLGEDFVRIAFETARSVDPSAKLYINDYNLDSASYGKTQGMVSHVKKWLAAGIPIDGIGSQTHLALTALASSGVSEVAITELDIAGASSQDYVNVVNACLGVPKCVGITVWGVSDKDSWRSSSSPLLFDSNYQPKAAYNAIIAAL

SEQ ID NO: 24810 - protein, 765 aa, Neosartorya fischeri
  strain ATCC 1020 / DSM 3700 / FGSC A1164 / NRRL 181
MKWSILLLVGCAAAIDVPRQPYAPTGSGKKRLTFNETVVKRAISPSAISVEWISTSEDGDYVYQDQDGSLKIQSIVTNNTQTLVPADKVPEDAYSYWIHPNLSSVLWATNYTKQYRHSYFADYFIQDVQSMNLRPLAPDQSGDIQYAQWSPTGDAIAFVRGNDVFVWTNASTSQITNDGGPDLFNGVPDWIYEEEILGDRFALWFSPDGAYLAFLRFNETGVPTFTVPYYMDNEEIAPPYPRELELRYPKVSQTNPTVELNLLELRTGERTPVPIDAFDAKELIIGEVAWLTEKHDVVAVKAFNRVQDRQKVVAVDVASLRTKTINERDGTDGWLDNLLSMAYIGPIGESKEEYYIDISDQSGWAHLWLFPVAGGEPIALTKGEWEVTAILSIDKPRQLVYFLSTKHHSTERHLYSVSWKTMEITPLVDDTVPAVWSASFSSQGGYYILSYRGPDVPYQDLYAINSTAPLRTITSNAAVLDGLKEYTLPNITYFELALPSGETLNVMQRLPVKFSSKKKYPVLFTPYGGPGAQEVSKAWQALDFKAYIASDPELEYITWTVDNRGTGYKGRAFRCQVTSRLGELEAADQVFAAQQAAKLPYVDADHIAIWGWSYGGYLTGKVIETDSGAFSLGVQTAPVSDWRFYDSMYTERYMKTLESNAAGYNASAIRKVAGYKNVRGGVLIQHGTGDDNVHFQNAAALVDTLVGAGVTPEKLQVQWFTDSDHGIRYHGGNVFLYRQLSKRLYEEKKRKEKGEAHQWSKKSVL

SEQ ID NO: 24811 - protein, 332 aa, Neosartorya fischeri
  strain ATCC 1020 / DSM 3700 / FGSC A1164 / NRRL 181
MLHTSIVSVTASLALVLNANAQAALYAQCGGEGYSGPTSPMPPWNKHCTKYYNNHNDHNNDHRYTHRAKVLHHFTGFNINSTKPSASNPLGNPTLPGWTTSGGLNWVGFLVSKYNTSLTLSYNFAYGGATTNASLVAPYTSTVLSFIDQVTEFTNSIASKPSYAPWTSENSLVGVWMGVNDVGNSYWLSNIDELLIKIMDSYFGQLQILYDAGVRNYVLLGVPPINRSPLMLSQGTDATTAEAAVIAKYNNLIATYLAKFKSKNSGVTATIVDTQAPFNKALDNPTAYGAPNATCFNSDGTSCLWFNDYHPGIAIQNLTAQAVASALKGSFF

SEQ ID NO: 24812 - protein, 321 aa, Neosartorya fischeri
  strain ATCC 1020 / DSM 3700 / FGSC A1164 / NRRL 181
MKFVATLIACGLSGLALAAPTATVDSLEKRGPNDAAFGYASLNGGTTGGAGGTTTTVSSYAAFTAAVSSDAKKVVYVSGPIKQSAKQVKVGSNTSIIGKDSTAVLEGFGLLVKEKSNVIIRNLGVKKVLAENGDAIGIQYSNNVWVDHVDVSSDRDHDKDYYDGLIDLTHAADYVTISNCYIHDHWKASLVGHSDNNGDEDTGHLRVTYANNYWSNINSRAPSLRFGTGHVYNSYFENVSDGINTRDGAQVLVESNQFVGSSKALYSTDAGYAVEKDNDFGGAKNTALKGTLTTVPYSYSLVGSSKVKSAVVGQAGQTLKF

SEQ ID NO: 24813 - protein, 378 aa, Neosartorya fischeri
  strain ATCC 1020 / DSM 3700 / FGSC A1164 / NRRL 181
MKYQGLLAIAGCIASASAVSVSGAAEGFAKGVTGGGSATAVYPSTTAELVSYLGDSEARVIVLTKTFDFTGTEGTTTATGCAPWGTASACQLAINQNDWCTNYEPDAPSVSVTYDNAGTLGITVKSNKSLLGSGSSGVIKGKGLRIVSGASNIIIQNIAITDINPKYVWGGDAITINNADMVWIDHVTTARIGRQHLVLGTSASNRVTISNNYFNGVSSYSATCDGYHYWGIYLDGSNDLVTMKGNYIYHFSGRSPKVQGNTLLHAVNNYWYDSSGHAFEIGSGGYVLAEGNVFQNIDTIVESPVDGQLFTSPDSTTNKVCSTYLGHVCQVNGFGSSGTFSQADTGFLSNFAGKNIASASAYTVVQSSVPSSAGQGKI

SEQ ID NO: 24814 - protein, 395 aa, Neosartorya fischeri
  strain ATCC 1020 / DSM 3700 / FGSC A1164 / NRRL 181
MKAIGATLLGLALAVQAQQPLYAQCGGNGWTGSTQCVAGACCSSINAWYYQCLSGNCMPSTTMTTTATRTTSTSTSGPTGSLPPSFKWSSTNALVGPKNDGRNLAGIKDPSIIEVDGTYHVFASTAQASGYNLVYFNFTDFNQAGNAPFFYLDQSGIGTGYRAAPQVFYFQPQQLWYLIFQNGNAAYSTNKDISNPAGWSAPKNFFSSVPSIITQNIGNGYWVDMWVICDSSNCYLFSSDDNGHLYRSQTTLSNFPNGMGNTVIALSDSNPNNLFEASNVYRVGNEYLLIVEAIGSDGNRYFRSWTAPSLTGTWTGLANTEANPFARWNNVVFSGTAWTKSISHGEMVRSQVDQTMTISPCKLRYLYQGLSPTATGDYNSLPWKLALLTQTNSAC

SEQ ID NO: 24815 - protein, 561 aa, Neosartorya fischeri
  strain ATCC 1020 / DSM 3700 / FGSC A1164 / NRRL 181
MAAALGANFNQPVLWEDLADLDIFRVNDTFYYSASTMHYSPGAPILQSYDLVNWEFVGHSVPTLDWGSIYNLDGGQAYVKGIWASTLRYRKSNGLWYWIGCIQFSTTYIYTAPSVTGPWTKSGVINTCYYDCSLLIDDDDTMYVAYGGTTISVAQLSSNGLSQTKSQQVFKSTIGAIEGSRFYKVNGEYYIFNTLPANAEYVLKASSPWGPYTQKLLLKDIATPITGGGVPHQGGIVDTPAGNWYYMAFVDSYPGGRVPVLAPITWGSDGFPVITTVNGGWGAQYPYPLTPRPLSPPTGKDTFQGTTLGPQWEWNHNPDTSHYSVNNGLTLKTATVTTNLYAARNTLTHRILGPDSAATIELTISNIKPGDRSGLAMLRDSSAYVAVINNSGIFRVSMVAGLTMDANWNTLSTGSEVAGVNLSGSPSKIWLRAYANIQPGSGRTASFYYSTDGSSFHSIGTPYTLNNTWQFFMGYRYGIFNYATVSLGGSVLVSSFEMESGAPSSGTSTTTASQPSATTVPTAGATQSKWGQCGGSGWTGPTACASGSTCSSANPWYSQCL

SEQ ID NO: 24816 - protein, 231 aa, Neosartorya fischeri
  strain ATCC 1020 / DSM 3700 / FGSC A1164 / NRRL 181
MTMTTAAVFGCTGAVGSQILATLLAIDTFPSVKTISRRLPNVQSPKLEAIEEGDSSKWGGMISSFSPKPSVVFNAVGTTRAAAGGLQNQWKIDHDLCIENARAAKEAGVKTYVFISGAGIRGFVARYLPFSKMKIGVEDAIKDLDFEHAIILRPGMIIGRENPKSALLENIVGGLNKLGQGIQDSLGQDQTVIARAAVAAARMADEGKAPSKYWVVEMADIVRLGRDEWKE

SEQ ID NO: 24817 - protein, 447 aa, Neosartorya fischeri
  strain ATCC 1020 / DSM 3700 / FGSC A1164 / NRRL 181
MTTFLSLTTAAAVLTLARGSNALVRPGNVGKLPALGWNSWNAFGCDIDAAKIMTAANEVVNLGLKDLGYEYINIDDCWSVKSGRDASTQRMVPDPEKFPDGISGLADQIHDLGLKVGIYSSAGLTTCAGYPASLGYEDIDAQTFAEWGIDYLKYDNCGVPSNWTDAYTYCVPDPGSKSTNGTCPDNKNPAPAGYDWRTSLTAERYRRMRDALVSVDRTILYSLCNWGQADVNDWGNETGNSWRTTGDITPSWPRIAAIANENSFLMNYVDFWGYPDPDMLEVGNGNLTLAENRAHFALWAAMKSPLIIGTALDSISQDHLAILSNKILLKFHQDPVVGRPAHPYKWGYNPDWTFDPAHPAEYWSGASSVLGGTLVLMLNSEDTKQRRTAVWKEIPELKDVLGRQGKRRTGFRVTDVWTGKDLGCVRDHYSVELESHDVAALVVGRAC

SEQ ID NO: 24818 - protein, 110 aa, Neosartorya fischeri
  strain ATCC 1020 / DSM 3700 / FGSC A1164 / NRRL 181
MQFTLKALSVFAASLFFSAVSAVPQCKPGDAWPDVHDCHNFFECAAGGIPVLKTCGPGTAYCPTTGVCDYEFKIPSCHPRGAIPKGPEHGKAPQGWGFPGGHGRPGGMGH

SEQ ID NO: 24819 - protein, 769 aa, Neosartorya fischeri
  strain ATCC 1020 / DSM 3700 / FGSC A1164 / NRRL 181
MHSNLGLAGLAGLLATASVCLSAPADQNITSDTYCYGQSPPVYPSPEGSGTGSWAAAYAKAKNFVAQLTPEEKVNLTAGTDANNGCSGNIAAIPRLNFPGLCVSDAGNGLRGTDYVSSWPSGLHVGASWSKALAKQRAIHMAKEFRKKGVNVILGPVVGPLGRVAEAGRNWEGFSNDPYLSGALVYETVDGAQSVGVATCTKHYILNEQETNRNPGTEDGVDIAAVSSNIDDKTMHELYLWPFQDAVLAGSASIMCSYNRVNNSYGCQNSKTLNGLLKTELGFQGYVMTDWGAQHAGIAGANAGLDMVMPSTETWGANLTTAISNGTMDASRLDDMAIRIIASWYQMNQNSDSPSPGVGMPTNMYAPHQRVIGREASSKQTLLRGAIEGHVLVKNTNSALPLKSPQLLSVFGYDAKGPDALKQNFNWLSYSPAIQENHTLWVGGGSGANNAAYVDAPIDAIKRQAYEDGTSVLYDLSSEDPDVDPTTDACLVFINSYATEGWDRPGLADKSSDSLVKNVAGKCANTIVTIHNAGIRVIGDWIDHENVTAVIFAHLPGQDSGRALVELLYGRANPSGKLPYTVAKKAEDYGSLLHPSLPETPYGLFPQSDFDEGVYIDYRAFDKANITPQFEFGFGLSYTAFEYSGLRISNPKKSPQYPPSAAIQQGGNPHLWDKTVTVSAEVKNTGRVAGAEVAQLYIGIPNGPVRQLRGFEKVDVSAGETTQVKFALNRRDLSTWDVEAQQWSLQRGTYRVYVGRSSRDLPLTGSFTL

SEQ ID NO: 24820 - protein, 658 aa, Neosartorya fischeri
  strain ATCC 1020 / DSM 3700 / FGSC A1164 / NRRL 181
MRFAIPLGAACAWAGVALAALQIAEDDSTITLNNDRFKAVWSKSKGSVVDMFLDGQDLLGPQSGSTGIGPYLDCYCVPSGFYTAGATNPRMQYVEGTDSTGTNYAGVILNDTYTPTGQQFQQYWFLRDGETGLHMFSRLAYYNETTPFLRNLQEFRTLFRPNTQLWTHLTSSELQTAPLPSKNAVSKQVVVQDATWRFNNTPDDAYYTQFSEYFTKYTFSNQWRDNDVHGLYGDGTNSNGSTYGAWLVMNTKGPLHSDLTVDGIVYNYIVSNHHGEGTPNITNGFDRTFGPQFYLFNGGKGSTSSLQDLRSEAAKLADPSWNAEFYDSIAKHVVGYVPSSKRGSVDGRVKLPKGATNPIAILTVDGQYFQDNSVVPSSYQYWTDIDTSGKFRIDRVVEGKYRLTVYADGIFGDFVRDGVTVKAGKTTTVKEKWDAESAGKEVWRLGTPDKSSGEFRHGVARDPTHPLHPPEYLIYWGAYDWQSDLPKGIDYRIGSSDPATDFNTVHWSVFGPTPDNPDVEYNTTHDWKINFSLTKKQLRNSKKATLTIQLAGAKTASGNTDVYNASEPYINLSHESYINDQKEPLSFVIGFNQSSSCIVRSAVSCYQVRSRMEFPADWLKVGENTLTLHLPYNATDTETAILPATVYVQYDALRLELD

SEQ ID NO: 24821 - protein, 378 aa, Neosartorya fischeri
  strain ATCC 1020 / DSM 3700 / FGSC A1164 / NRRL 181
MLKLIGSLVLLASAAEVIASPLAESVAPSITLEKRASCTFSGSNGAAAAMASQKACSTIVLSNVAVPAGTTLDLSDLADGTTVIFEGETTWGYKEWSGPLLQISGKNIKVEGASGATLNPDGARWWDGQGGNGGKTKPKFFAAHGLTSSSSITNLHILNTPVQAVSINGCDGLTVTDMTIDDSAGDTQGGHNTDAFDIGSSSNIIISGAKVYNQDDCVAVNSGTGITFTGGLCSGGHGLSIGSVGGRSDNTVENVSFTNSQVTKSDNGLRIKASKGKTGTIKGITYSGITLSSIRKYGILIEQNYDGGDLKGDPTSGIPITDLTMENISGKGAVASSGHNIAIVCGSGACSNWTWKNVEVTGGQTYGSCENVPSVAQC

SEQ ID NO: 24822 - protein, 1015 aa, Neosartorya fischeri
  strain ATCC 1020 / DSM 3700 / FGSC A1164 / NRRL 181
MAHIYRLLLLLLSNLWFSAAAQNQSETEWPLHDNGLSKVVQWDHYSFQVNGQRIFIFSGEFHYWRIPVPELWRDILEKVKATGFTAFAFYSSWAYHAPNNRTVDFSTGARDITPIFELAKELGMYMIVRPGPYVNAEASAGGFPLWLTTGEYGSLRNDDPRYTAAWTPYFANMSQITSKYQVTDGHNTLVYQIENEYGQQWIGDPKDRNPNKTAVAYMELLEASALENGITVPLTSNDPNMNSKSWGSDWSNAGGNVDVAGLDSYPSCWTCDVSQCTSTNGEYVPYKVIDYYDYFQEVQPTLPSFMPEFQGGSYNPWAGPEGGCPQDTGAEFANLFYRWNIGQRVTAMSLYMLYGGTNWGAIAAPVTATSYDYSAPISEDRSIGAKYSETKLLALFTRTAKDLTMTEAIGNGTQYTTNTAVRAFELRNPQTNAGFYVTFHNDTTVGGNQAFKLHVNTSVGALTVPKNEGVIQLNGHQSKIIVTDFTLGKRTLLYSTAEVLTYAVFENRPTLVLWVPTGESGEFAIKGTKSGKVENGDGCSGINFKREKDYLVVNFSQAKGLSVLRLDNGVRVVLLDKAAAYRFWAPALTDDPIVQETETVLVHGPYLVRSASVSKSTLALRGDSVEKTTLEIFAPHSVRKITWNGKEVKTSQTPYGSLKATLAAPPTIKLPALTSWRSNDSLPERLPSYDDSGPAWIEANHMTTSNPSPPATLPVLYADEYGFHNGVRLWRGYFNGSASGVFLNIQGGSAFGWSAWLNGHFLDSHLGTATTSQANKTLTFSSSILNPTENVLLIVHDDTGHDQTTGALNPRGIIEARLLSNDTSSPAPGFTQWRIAGTAGGESNLDPIRGVFNEDGLFAERMGWHLPGFDDSAWTPENSTTSASSALSFTGATVRFFRTVVPLDIPAGLDVSISFVLSTPSAAPKGYRAQLFVNGYQYGRYNPHIGNQVVFPVPPGILDYQGDNTIGLAVWAQTEEGAGIQVDWKVNYVADSSLSVAGFGKGLRPGWTEERLKFA

SEQ ID NO: 24823 - protein, 881 aa, Neosartorya fischeri
  strain ATCC 1020 / DSM 3700 / FGSC A1164 / NRRL 181
MLRSLLLLAPLVGAAVLGVRDNSQECPGYKATNIREGRNSLTADLTLAGTPCNTYGTDLKNLKLLVEYQTDKRLHVKIYDADEEVYQVPESVLPRVDGKGGSGKKSALKFDYQANPFSFKVKRGGEVLFDTSGSNLIFQSQYLNLRTWLPEDPNLYGLGEHTDSLRLETTNYTRTLWNRDAYAIPEKTNLYGTHPVYYDHRGQDGTHGVFLLNSNGMDIKIDKTEDGKQYLEYNTLGGVFDFYFFTGATPKDASIEYAKVVGLPAMQSYWTFGFHQCRYGYRDVFEVAEVVYNYTQAKIPLETMWTDIDYMDRRRVFTLDPERFPLEKLRELVTYLHNHNQRYIVMVDPAVSVSDNVGYNDGMEQGIFLQTQNGSLYKGAVWPGVTAYPDWFHPDIQKYWNDQFAKFFDRKTGVDIDGLWIDMNEAANFCPYPCSDPEGYSRDNDLPPAAPPVRPSNPRPLPGFPGDFQPSSSSKRSTKGSKVGLPNRDLINPPYMIRNEAGSLSNKTINTDIIHAGEGYAEYDTHNLYGTMMSSASRNAMQHRRPEVRPLVITRSTYAGAGAHVGHWLGDNISEWSKYRVSIAQMLAFASMFQVPMIGSDVCGFGGNTTEELCARWARLGAFYTFFRNHNEITGIPQEFYRWPTVAESARKAIDIRYRLLDYIYTAFHRQTQTGEPFLQPMFYLYPKDKNTFSNQLQFFYGDAILVSPVTDGSQTSVDAYFPDDIFYDWHTGAALRGRGANVTLGNIDVTEIPIHIRGGSIIPIRSESAMTTTELRKKGFELIIAPGLDGTASGSLYLDDGDSIEQRATLELEFTYRKGRLRVKGKFGFRTDVKINAVTLLGQSAPASKSGSVASFDSGRQAVTIKTSLDLTGPSEIDLN

SEQ ID NO: 24824 - protein, 439 aa, Neosartorya fischeri
  strain ATCC 1020 / DSM 3700 / FGSC A1164 / NRRL 181
MSIDVNWRSATYGPDGEALAERIRSFIHDRFQQVALPRFIRSVQVHAFDFGTIPPELEIKDFCEPFADFYEEDDDDHTSDASEELGSEHSSQWNRTHPELNEPSYREDTAVNHSLRDPFPDGFPTSPLRSPLGEHLNPHFLPRAGTPGIPGGTSTLGYHLMSLGGLSGTQTPLAAVAGGNPFASGWSDSGMGPGNRGRSERHAGMKHQRAEPEIDTSNSTSRPSTANTLPSHPSSSSKNSGQGATGRNDHPSLHAGEHIEDPVAPGHLPLPPRMRERRPEDFQVLCHVKYAGDVRLSLTAEILLDYPMPSFVGLPLKLNVTGITFDGVAVIAYIRKRVHFCFLSAEDADALIGSEQQQQQESAGDDHRPQSRPDSSASASQKRHGGLLQEIRVESEIGRKEDGKQVLKNVGKVERFVLAQVRRIFEEELVYPSFWTFLI

SEQ ID NO: 24825 - protein, 1006 aa, Neosartorya fischeri
  strain ATCC 1020 / DSM 3700 / FGSC A1164 / NRRL 181
MKLLSVCAVALLAAQAAGASIKHKLNGFTIMEHSDPAKRELLQKYVTWDEKSLFVNGERIMIFSGEVHPFRLPVPSLWLDVFQKIKALGFNCVSFYVDWALLEGKPGKYRAEGNFALEPFFDAAKQAGIYLLARPGPYINAEASGGGFPGWLQRVNGTLRTSDPAYLKATDNYIAHVAATVAKGQITNGGPVILYQPENEYSGACCNATFPDGDYMQYVIDQARNAGIVVPLINNDAWTGGHNAPGTGKGEVDIYGHDSYPLGFDCGHPSVWPKGNLPTTFRTDHLRESPTTPYSLIEFQAGSFDPWGGPGFAACAALVNHEFERVFYKNDLSFGAAILNLYMTFGGTNWGNLGHPGGYTSYDYGSPLTESRNVTREKYSELKLIGNFVKASPSYLLATPGNLTTSGYADTADLTVTPLLGNGTGSYFVVRHTDYTSQASTPYKLSLPTSAGRLTVPQLGGTLTLNGRDSKVHVVDYNVAGTNILYSTAEVFTWKKFGDSKVLVLYGGPGEHHELAVSLKSDVQVVEGSNSEFTSKKVEDVVVVAWDVSASRRIVQIGDLKIFLLDRNSAYNYWVPQLDKDDSSTGYSSEKTTASSIIVKAGYLVRTAYTKGSGLYLTADFNATTPVEVIGAPSNVRNLYINGEKTQFKTDKNGIWSTGVKYSAPKIKLPSMKDLDWKYLDTLPEVQSTYDDSAWPAADLDTTPNTLRPLTMPKSLHSSDYGFHTGYLIYRGHFVADGSETTFDVRTQGGSAFGSSVWLNEAFLGSWTGLNANADYNSTYRLPQVEKGKNYVLTVVIDTMGLNENWVVGTDEMKNPRGILSYKLSGRDASAITWKLTGNLGGEDYQDKIRGPLNEGGLYAERQGFHQPEPPSKKWKSASPLDGLSKPGIGFYTAQFDLDIPSGWDVPLYFNFGNSTKSAYRVQLYVNGYQYGKFVSNIGPQTSFPVPQGILNYQGTNWVALTLWALESDGAKLDDFELVNTTPVMTALSKIRPSKQPNYRQRKGAY

SEQ ID NO: 24826 - protein, 321 aa, Neosartorya fischeri
  strain ATCC 1020 / DSM 3700 / FGSC A1164 / NRRL 181
MRYSWLIGTVCAAGALAKPVDKRSYVTDWTIVTVTETITLPYQPPPTSAPAYSPIQAVQLTQTVASVDPAPAPAPVEPEASSASPIPTPEAVNAAPVGVVEELPGASAWASAWTSAWTSAWTSAWTSSAPEAAQPTTLATSTSTTASAPSAPAAGGSNAYQSAVLYNHNIHRSNHSASSMTWNTTLESSAHELASRCVYQHDTDIGGGGYGQNIGYGVSADEIGVMITNLMYNDEFGYYDGLYGQANPDMTYFEKWGHFSQIVWKGSVSVGCATVVCNSLGNVDSSQPSPFTVCNYYPPGNFAGEYSDNVLAPLGHAYYSA

SEQ ID NO: 24827 - protein, 719 aa, Neosartorya fischeri
  strain ATCC 1020 / DSM 3700 / FGSC A1164 / NRRL 181
MFRVGSWLYGKKPAANASTQSLDSLVELRDPATLILNDDVDGAEAGLAEGTSTFHNLGRGVVAFIRATLGFEQDIMRQASERLNEAETSASVDQHRAQHNSHAPNTYHSPMYSPGTEFALCQAIAQLMSAIVGVLNESLTESIKAFYRLRKAYITLDAILKMEQKYMEESRSATLVESTTSGSVPSSQRHSSSNLQSSSSSISSAKVKEATADTLAAPSKDTDVNERLADLSLSGEAPVAEDPGQTPTPINTDILDHDPDSDIFQNQIDVFVHSGSNFCFGVLLLLISMVPPSFSKLLSIIGFHGDKERGLKMLWQASKFHNLIGGIAAFAILGYYNGFVRYCDIMPDSIPGKDGDVQGYPQKRLELLLAKMRERFPKSQLWLLEESRMSGANKNLDRALELLCGEERSPLKQVEALRVFERSLNAMYLHKYELCADSFLECVDLNSWSRSLYYYIAGSCHLSLYRDVKETDSAKAAKHAELAEKYFRMAPTVAGKKRFMARQLPFDVFVARKFAKWEARAKEWKVSLVDAVGIDPIEEMIFFWNGHSRMTDEQLQESLQKLAWSESNANTTWSREGPEEKAILKLLRAAVHRSLRKHTQAKEMLEDILGQDRTLFKGHLKDDWICPVAHFEMAANLWMERPTYIANHSGAKQDSDKESAGPADAKDALQYERERVRKCKEYLEKAAKWESYELDARIGLKVTAAMEAVQKWESTHPTV

SEQ ID NO: 24828 - protein, 320 aa, Neosartorya fischeri
  strain ATCC 1020 / DSM 3700 / FGSC A1164 / NRRL 181
MAKQTLLLSPPSLSSQPGKLNETLQSYNRNATDLQMLDRLALGLASLPDSTYSTIVILAGGDNSFSESLKLINRQTFNQIIGSLRRGGYIYGQDAVSGVAFDHNEAILAGLIHVGNGKYLKPDIEEMQAVPLRLGRKNDHLAGAPSLEGSAAEHPFPPEVSEGKTASGDNRVAVVGSQKFRENIVSAATMDNNEASDDELINEDNLLDDSELSAPIIQPPECRPKAGKRRRACKDCTCGLAQKLQEEDAVKRADADEQLDAMKLLHDDLAEVDFTVRGKVGSCGNCSLGDAFRCEGCPFIGLPAFQPGEEVRLLNNDVQL

SEQ ID NO: 24829 - protein, 257 aa, Neosartorya fischeri
  strain ATCC 1020 / DSM 3700 / FGSC A1164 / NRRL 181
MAPITEEVVHGLKDMIEKLENRVQELEGRLGGESKPKSIAEQMRIVLMGPPGAGKGTQAPRLKEKYCVCHLATGDMLRSQVAKKTELGKEAKKIMDQGGLVSDEIMVNMIKNELDTNTECKNGFILDGFPRTVAQAERLDDMLEARKQKLQHAIELQIDDALLVARITGRLVHPASGRSYHKIFNPPKNDMKDDVTGEPLIQRSDDNAETLKKRLSTYHAQTAPVVEYYKKTGIWRGIDASQEPGQVWKSLLGVFQK

SEQ ID NO: 24830 - protein, 356 aa, Neosartorya fischeri
  strain ATCC 1020 / DSM 3700 / FGSC A1164 / NRRL 181
MLGKMILLPLFVLLCHSLASASLAYRGADISSLLIEEKAGIKYKDVNGQAQPLENILKANGVNSVRQRVWVNPSDGSYNLDYNVKLAKRVKAAGMSVYLDLHFSDTWADPSHQTTPRGWSTNDIGTLTWQVYNYTKEVCDTFASNGIDVSIVAIGNEIRNGLLWPLGKPNNYANIANILHSAAFGVKDSTLSPKPKIMIHLDNGWDWSAQKFFYDSVLSSGAKLVKSDFDLIGVSYYPFYNPSATLSALTTSLKNLRSTYGKDVLVVETDWPVSCPNPAYAFPSDLKDIPFSVAGQKTFVQRVANVVAQTPGGIGLYYWEPAWVQNAALGSSCADNLMVDWRTDQARTSLSVFGTI

SEQ ID NO: 24831 - protein, 423 aa, Neosartorya fischeri
  strain ATCC 1020 / DSM 3700 / FGSC A1164 / NRRL 181
MRFSIISLVSLPLFLGLTYAGGVEKDERNNVCTVKANGKQKDDMPNLFKAFKECGNGGTIIFPEDQSYWIGTRLNPLLNDVTVQWRGKWTFSDNLDYRRNNSFPVAFQNHRVGFIISGHNVTIDGNGNTWYTAEKGVTQSGRPMPFVFWNVSEVNVENFYVKDPPLWSLNIMNGTNMRFNNIYCNATSVDAPYGYNWVQNTDGFGSFSAVNTMDAVNIQLTNFVYQGGDDCITIKPRSYNIDIQNVTCVGGNGIAVGSLGQYLEDSSVENVRVDKVKIIRYNEDMHNSAYIKTWVGALVPQSSYESAGLPCGGGWGNVRNILFSNFEVQGANAGPSVNQDSGNNGSYSGSSLMTVSNIVFANFTGYTSGGTSVTSKVSCSEVHPCYNIEFDDVLLYPGKNASNLGTGSCKYTANGGVHGLEGC

SEQ ID NO: 24832 - protein, 873 aa, Neosartorya fischeri
  strain ATCC 1020 / DSM 3700 / FGSC A1164 / NRRL 181
MRFGWLEVAALTAASVANAQVFDDSHGNNQELAFSPPFYPSPWADGQGEWADAHRRAVEIVSQMTLAEKVNLTTGTGWEMDRCVGQTGSVPRLGINWGLCGQDSPLGIRFSDLNSAFPAGTNVAATWDKTLAYLRGKAMGEEFNDKGVDILLGPAAGPLGKYPDGGRIWEGFSPDPALTGVLFAETIRGIQDAGVIATAKHYIMNEQEHFRQVSEAQGYGYNITETLSSNVDDKTMHELYLWPFADAVRAGVGAVMCSYNQINNSYGCQNSQTLNKLLKAELGFQGFVMSDWSAHHSGVGSALAGLDMSMPGDISFDDGLSFWGTNLTVSVLNGTVPAWRVDDMAVRIMTAYYKVGRDRLRIPPNFSSWTRDEYGWEHFAVSEGAWTKVNDFVNVQRSHSQIIREIGAASTVLLKNKGALPLTGKEVKVGVLGEDAGSNPWGANGCPDRGCDNGTLAMAWGSGTANFPYLVTPEQAIQREVISNGGNVFAVTDNGALSQMADVASQSSVSLVFVNADSGEGYINVDGNEGDRKNLTLWKNGEAVIDTVVSHCNNTIVVIHSVGPVLIDRWYDNPNVTAIIWAGLPGQESGNSLVDVLYGRVNPSAKTPFTWGKTRKSYGAPLLSEPNNGNGAPQDDFNEGVFIDYRHFDKRNETPIYEFGHGLSYTTFGYSHLRVQALNSSSSAYVPTSGETKPAPTYGEIGSAADYLYPEGLKRITKFIYPLLNSTDLEDSSDDPNYGWEDSEYIPEGARDGSPQPLLKAGGAPGGNPTLYQDLVRVSATITNTGNVAGYEVPQLYVSLGGPNEPRVVLRKFDRIFLAPGEQKVWTTTLNRRDLANWDVEAQDWVITKHPKKVHVGSSSRKLPLRAPLPRVY

SEQ ID NO: 24833 - protein, 238 aa, Neosartorya fischeri
  strain ATCC 1020 / DSM 3700 / FGSC A1164 / NRRL 181
MKFSLSVALSLAAATAQAATQFCDQWGSVTEGNYILYNNLWGQAQATSGSQCTTFESLSGNTIVWNTKWSWSGGQGQVKSFANAALQFTPKKLSSVKSIDSTWTWNYSGSNIVADVAYDMFLSTSPGGDHNYEIMVWLGALGGAGPISSTGSPIATPTVAGIKFNLYLGPNGSMQVYSFVAQSTTKSFSGDMRDFFTYLEGNQGLSSDLYLVDVQAGTEPFSGSNAVFTVSDYSVSVA

SEQ ID NO: 24834 - protein, 323 aa, Neosartorya fischeri
  strain ATCC 1020 / DSM 3700 / FGSC A1164 / NRRL 181
MFARQSLRFAQPLKQGFRKYSTEAPSKGKSSLAPIYVAVGLTGLGVGLYRYNSASAEAPPAERPKVFTGGDQGWVDLKLAQIENLSPNTKRLRFEFPDKEAVSGLHVASALLTKFKPHGAEKPVIRPYTPVSDEEQPGYLDLVVKVYPNGPMSEHLHSMNVDQRLEFKGPIPKYPWEANKHKHICLIAGGTGITPMYQLARKIFKDPEDQTKVTLVFGNVREEDILLKKELQELENTYPRRFRAFYVLDHPPKEWTGGKGYITKELLKTVLPEPKEENIKIFVCGPPGMYKSISGPKVSPKDQGELTGILAELGYSKDQVFKF

SEQ ID NO: 24835 - protein, 416 aa, Neosartorya fischeri
  strain ATCC 1020 / DSM 3700 / FGSC A1164 / NRRL 181
MIFKFSQKALVALCLVVGLAEAVPSKSRVVSRASTFDYNGIVRGVNIGGWLVLEPWITPSIFDNAGDAAVDEWTLTATLGQDQAKAVLSQHWSTFITQGDFHRIAQAGMNHVRIPIGYWAVSSLPDEPYVDGQLEYLDNAISWARDAGLKVVIDLHGAPGSQNGFDNSGRKGPIAWQQGNTVSQTVDAFRALAERYLPQSDVVAAIEALNEPNIPGGVSEAGLRDYYDQIADVVRQINPDTSVFLSDGFLSTASWNGFKTGEDVVMDTHHYEMFDNYLISLDIHGHVKSACDFGKQIKGSDKPVVVGEWSGAVTDCTKYLNGKGVPTRYQGEYANNPKYGDCGDKTQGSVADLSDQERADTRRFIEAQLDAYEGKNGWLFWTWKTEGAPGWDMQDLLANGVFPSPLTDRQFPNQCA

SEQ ID NO: 24836 - protein, 264 aa, Neosartorya fischeri
  strain ATCC 1020 / DSM 3700 / FGSC A1164 / NRRL 181
MIPTTYRLLAVPIFLWLQLLPSIHASNAAGNTVIVTVTPTIPHPASYTSPEIFKDAVLSTSNAYRREHNASQLTWNETLTKYAKHWAEGCKWKHSGGPYGENLAFGYQDPAAAVAAWGDEGQKYDYKLPTGFSEETGHFTQLVWRATREVGCAAFNCGDQDGNDAKDKEGRYTRAQGWYVVCEYSPAGNVVGNQNAFFRVNVQPASTYSGPETTGSATGTSTSASASGSATATATGGVEELYDGRLRDQYQNAFIGLIVFMNLV

SEQ ID NO: 24837 - protein, 234 aa, Neosartorya fischeri
  strain ATCC 1020 / DSM 3700 / FGSC A1164 / NRRL 181
MWSSIAALPVLVPVALACLGYEGGVPTPTAHYSNSAVIEVAAGQVFDAGWAKYDRGSGACNDQSEGDWKDAVFYLHSGATLKNVIIGANQAEGVHCDGPCTLQFVWFEDVCEDAITIKNDKAGQETWIIGGGAYHASDKIVQHNGCGTVNIINFYAEDYGKVYRSCGNCDNQCKRNVYVEGTTARDGGEVVGINLNYGDTATLKNVCADADHPCVFYDGCAGDCEPKKVGYCSG

SEQ ID NO: 24838 - protein, 321 aa, Neosartorya fischeri
  strain ATCC 1020 / DSM 3700 / FGSC A1164 / NRRL 181
MSASAFVAVASCLAALVHGYANPGSCSGACNVHDPALIRRQSDGKYFRFSTGNKISYASSSSIQGPWTVLGSVLPSGSSINLDGKDDLWAPDVSLVNGVYHVYYSVSTFGSQSSAIGLATSSTMDLNSWTDHGSTGIQSSSSKPYNAIDANLFNDGGTYYMNFGSFWHDIYQAPMNSAATAAASSSYNIAYNPSGTHAVEGAFMYKYGSYYYLFFSAGICCGYDTSRPASGEEYKIKVCRSTSATGNFVDASGVACTNGGGTVVLESHGTVYGPGGQGVFTDPSLGPILYYHYVDTTIGYADGQKLFGWNKIDFSSGWPVV

SEQ ID NO: 24839 - protein, 440 aa, Neosartorya fischeri
  strain ATCC 1020 / DSM 3700 / FGSC A1164 / NRRL 181
MLITNPALLGILASLAPLALGAPNQSTQARSRKCVIPSSYTSSQGTADDSPAVAGAFAQCAENSVIIFQEGVDYNIFHPIKATNLSNVEIRVLGNLHLPQDITAVQNIVKSGQNTWFTFQGPRVDWTGADDINNGWINSYGQAWWDANPANSSSFPNRPHLMSYKTSQASIKNFRSRKPIAWNVKLHGDDITVTHAIVDAKSTGGFPFNTDGFDVEGTNISITDSVMYNGDDAIAVNTPSHNIVFARNTIGYQSHGMSIGSLGKDPTDFANITNLRFEDVTVIDALYAARFKSWSGGKGLVKNVVWKNIRVFNVTFPIFVTQSYSDQSASRSGTIDPSSSVMMEDFTWSNFSGSINTYHPGDGSCVTNPCWYNAGLPNLKHTEAIVLECNTESSCKNFRTEGIRLYPQSKDSPSVICMKATAELNPKLGFECKNGTFVPQ

SEQ ID NO: 24840 - protein, 88 aa, Neosartorya fischeri
  strain ATCC 1020 / DSM 3700 / FGSC A1164 / NRRL 181
MHFIYQALSALAASLLFSSVTAGIAHCKVGEAWPDTSNCHNFYECASGGAPVLKTCGPGTAYCPTTGVCVHEETVASCFHRGHHSEKE

SEQ ID NO: 24841 - protein, 373 aa, Neosartorya fischeri
  strain ATCC 1020 / DSM 3700 / FGSC A1164 / NRRL 181
MKFSFLTVASFLIGQVALAALSAKKFASASDLQFTIDGKTGYFAGSNSYWIGFLTNNADVDLVFDHMKESGLKILRVWGFNDVNTVPGQGTVYYQVHANGKSTINTGADGLQRLDYVVHSAEKRGIKLIINFVNNWDDYGGMNAYVKAYGETDHNAFYSNKNIQNAYRRYVKAVVSRYTNSPAVFAWELANEPRCKGCDTEVLYEWIKSTSEYIKKLDKRHMVCIGDEGFGLDLLSDGSYPYTYVEGSNFTRNLAIPTIDFGTFHLYPDSWGTTHEWGNGWAQSHGAACKAAGKPCLFEEYGVTSNHCALETPWQKTSLNTTGVSGDLYWQYGDTLSTGQSPNDGNTIYYGTDEFKCIVKDHVAAIKAKQGWV

SEQ ID NO: 24842 - protein, 845 aa, Neosartorya fischeri
  strain ATCC 1020 / DSM 3700 / FGSC A1164 / NRRL 181
MSKLQQFPLSKGWSFRDSEDTSEDAWMPVPVVPSVVHQDLQANSKLKDPYIGFNELEARWVNEKSWTYKTVFQKPAAPAGSCIVLAFDGLDTFAKVKLDGNVILENDNMFLARRVDVTKALEAEGDHVLEIDFDCAFLRAKELRKQDPKHNWASFNGDPSRLSVRKAQYHWGWDWGPVLMTAGIWRDVRLEVYSARVADLWTEVQLASDHQSAQVTAFAEVESVHSGSHRACFTLSLHGQEIAREEIGVTENGTAKATFDVKEPSLWWPHGYGDATLYEVSVSLRKEQEELHKVSKKFGIRTAEVVQRPDKHGKSFFFRVNGVDIFCGGSCWIPADNLLPSITAERYRKWIELMVHGRQVMIRVWGGGIYEDNSFYDACDELGVLVWQDFMFGCGNYPTWPNLLESIRKESVYNVRRLRHHPSIVIWVGNNEDYQVQEQAGLTYNYEDKDPESWLKTDFPARYIYEKLLPEVVQEFSPSTFYHPGSPWGDGKTTSDPTVGDMHQWNVWHGTQEKYQIFDTLGGRFNSEFGMEAFPHMSTIDYFVENEADKYPQSHVLDFHNKADGHERRIATYLVENLRTATDLETHIYLTQVVQAETMMFGYRGWRRQWGDERHCGGALLWQLNDCWPTISWAIVDYFLRPKPAFYAVARVLNPIAVGVRREHHDWSVTHAQPPKTSKFELWVASSRQQEVQGTVELRFLSVNTGLEVRERIVHENVSIVPNGTTNLIVDGLIDHRVHSEPHVLAARIWVDGQLVARDVDWPQPFKYLDLSDRGLEIKKISESEDEQTLLISTQKPVKCLVFEEREGVRISDSAMDIVPGDDQRVTIKGLKPGDAPLKYKFLGQ

SEQ ID NO: 24843 - protein, 407 aa, Neosartorya fischeri
  strain ATCC 1020 / DSM 3700 / FGSC A1164 / NRRL 181
MALTLAATALVLLPLVTAQQIGSIAENHPELTTYRCSSQAGCVAQSTSVVLDINAHWIHQNGAQTSCTTSSGLDPSLCPDKVTCSQNCVVEGITDYSSFGVQNSGDAMTLRQYQVQNGQIKTLRPRVYLLAEDGINYSKLQLLNQEFTFDVDASKLPCGMNGALYLSEMDASGGRSALNPAGATYGTGYCDAQCFNPGPWINGEANTAGAGACCQEMDLWEANSRSTIFSPHPCTTAGLYACTGAECYSICDGYGCTYNPYELGAKDYYGYGLTIDTAKPITVVTQFMTADNTATGTLAEIRRLYVQDGKVIGNTAVAMTEAFCSSSRTFEELGGLQRMGEALGRGMVPVFSIWDDPGLWMHWLDSDGAGPCGNTEGDPAFIQANYPNTAVTFSKVRWGDIGSTYSS

SEQ ID NO: 24844 - protein, 388 aa, Neosartorya fischeri
  strain ATCC 1020 / DSM 3700 / FGSC A1164 / NRRL 181
MKVLAAIALSATAFTGAVAAVLTQEAFLNNPRIHHDQEKYLIELAPYRTRWVTEEEKWALKLDGVNFIDITEEHNTGFYPTLHSASYVKYPPKMQYAEEVAALSKNLSKENMKANLERFTSFHTRYYKSQTGIQSATWLYDQVQRVVSESGAAEYGATVERFSHPWGQFSIIARIPGRTNKTVVLGAHQDSINLFLPSILAAPGADDDGSGTVTILEALRGLLQSDAIANGNASNTVEFHWYSAEEGGMLGSQAIFSSYKRDRREIKAMLQQDMTGYIQGALNAGVEEAIGIMVDYVDQGLTQFLRDVVTAYCSVGYLETKCGYACSDHTSASKYGYPAAMATEAEMENTNKKIHTTDDQIKYLSFDHMLEHAKLTLGFAFELAFAPF

SEQ ID NO: 24845 - protein, 528 aa, Neosartorya fischeri
  strain ATCC 1020 / DSM 3700 / FGSC A1164 / NRRL 181
MLSKATLLLSLPFWARVANAAFGITTTSSSYVIDANSASPLKFTVNRSNCDITSINFYGAELQYQGTGSHIGSGLGSASVSATQSGDYIKVTCSTSTLTHYFVVHNGDPIIHMATHITAEPSIGELRFIARLNNELLPNEEPFGQVSNTAGGTAIEGSDVYLVNGQTRSKFYSSERFIDDHRHCVSGSAHRVCMILNQYESSSGGPFHRDINTNNGGQYNALYWYMNSGHAQTEANRMGLHGPYSMYFSRSGTPGTNIDTSFFANLDIKGYVPANARGKVSGKASGADSTFKWVVHWYNDEAQYWTYTASDGSFTSPAMKPGTYTMVYYQGEYKVASTSVSVSAGSTTTKNISGSVTTGKTIFKIGEWDGQPTGFRNAANQLRMHPSDSRMASWGPLTYTVGSSSLSDFPMAIFKSTNSPVTIKFTASSSQTGAATLRIGTTLSFAGGRPQAKVNSFTGPVPSAPKDLNSRGVTRGAYRGFGEVYDVAIPAGTIVAGTNTITISVVSGSSGDTFLSPNFIFDCVELFQ

SEQ ID NO: 24846 - protein, 648 aa, Neosartorya fischeri
  strain ATCC 1020 / DSM 3700 / FGSC A1164 / NRRL 181
MESIVWLLLLSPALVAGSLHPRIDNGLAKTPQMGWNSYNYYSCSPNEAIVRSNAKALVDLGLADLGYRYVTTDCGWSVADRLPNGTLTWNETLFPSGFPAMGKYLHELGLLFGVYGDSGTKLCGSPPDQVGSLYHEEQDAKTFAEWGADSLKYDNCYSDAATNYPNVNYEPSTSPRPRYEIMSSALARVGRPILFQICEWGIDFPALWAPALGSSWRIGNDIIPEWRSIFRTLNQAVPNTDFAGPGQWADLDMLYVGNGVFSLPEEQTHFSLWAILKSPLTIGAALKDDDTSINQASLEVLKQKDVIGFNQDALGVSASLKRRWSDEGYEVWSGPLSGNRTVVAVINWRDESRDLTLDLPDVGLQYAQVARNIWGKTVVRDVRTSYTAGVAGHGTMLLELQGTIPSGLYPAKIFAKSTDQKTTFESIYAATTSANYELAITFSRPSTETVTITTSSGQTISISGKSGRIALTAGSNTITIQHKTPIESIQITPPTGTYYANTVFNVTGSAKHTTCGSGCSPVGSKIGDLSPNSNAYTSIPATTVGSKYLAIDYINNEVAFSSSWGWGSNSRNLTVSVNDGAPVRLEVPLSGRHSELFSPGKGWWDTATLGVLTSGWKKGENKVVFGNQGGEDGFQTYAADFVGVRILD

SEQ ID NO: 24847 - protein, 407 aa, Neosartorya fischeri
  strain ATCC 1020 / DSM 3700 / FGSC A1164 / NRRL 181
MPTVATLLGMAMSGAAIASAAALGAYNVDPNSISVSGLSSGGFMSAQLGVAYSDTFKVGFGVFAGGPYDCARGQSYTTCMYNQNPSITTPIANMKTWSGNKINPVSNLQSRKIYMWTGTADTTVGPNVMSQLKTQLANFDTAANVSYITTSGAVHTFPTDFDASGDNSCSSSVSPYISNCQYDGAGAVLKWMYGSLNARNTGTLSGSIVSFSQTGEYGASGMDTTGYLYVPKACQPGSSTVCKLHVALHGCLQSYSMIGSKFVSNTGYNMWADTNNIIILYPQAVADNTMHTIWTGMPLPNPNGCWDWVGWYGANADQVGGVQMAAIVNQVARVVSGYGAGSSSSTTTATPTTTTGSQTTTTTTVTTTAVAPLYGQCGGIGWTGPTACATGVCTAYSPYYAQCLLVV

SEQ ID NO: 24848 - protein, 217 aa, Neosartorya fischeri
  strain ATCC 1020 / DSM 3700 / FGSC A1164 / NRRL 181
MSLRSLFVAGLATLALAAPAPQIQARQGMSSNELESGPCRDVTFIFARGSTEQGNMGFIVGPGVCSSLKNDLGSDKVACQGVGGAYTAQLAPNFLSQNTDQASIDAATDMFDLANTKCPNTKIVAGGYSQGSAVIDNAIQALDSDLKAKVKGVVLFGFTRNVVDKGQIPGYPKDQTKIYCALGDLVCDNTLIITAAHLSYGADADDAAKFLASKVQG

SEQ ID NO: 24849 - protein, 467 aa, Neosartorya fischeri
  strain ATCC 1020 / DSM 3700 / FGSC A1164 / NRRL 181
MKITALASAILAVVHGALALPARAPALDITLSQVNNTRIKAVVKNSGSEKITFVHLNFFNDPSPVKKVSLYRNATEVEFTGIKQRLRSDGLSNEALTTLAPGATYEDEFDIASTANLTQGGPVTVRTQGFVPIAMNNKIAGYIPYSSNELELEVDAVKAVAVPASIKPLDRRTKITSSCTGDRAAVLNTALRNAASIAGKAANAASSGSSALFAEYFKSTSGNIRSAVAARLKAVASEASLNGGGSTTYYCSDPYGYCDSNVLAYTLPSTNEVVNCELFYTLQEVTNDCHGQDQATTIIHEFTHAPGVYPPGTEDLGYGYSAATALSANNALNNADSYALFANAVYLNCQGQTGGQTMWDGNSQPGQTAPGTQTMWDGNSQPGQTEPGTQTMWDGNSQPGQTEPGTQTMWDGNSQPGQTEPGTQTMWDGNSQPGQTEPCTQTMWDGSSEPGQTEPDAHTTWGNFYQA

SEQ ID NO: 24850 - protein, 846 aa, Neosartorya fischeri
  strain ATCC 1020 / DSM 3700 / FGSC A1164 / NRRL 181
MMHTLNVVLLAAGLLFDVAHAAASQAYTWKNVVTGGGGGFVPGIVFNPSAKGVAYARTDIGGAYRLNSDDTWTPLQDSVGNSNWHDWGVDALATDPVDTSRLYLAVGMYTNEWDPNVGSIMRSTDKGNTWSETKLPFKVGGNMPGRGMGERLAVDPNKNSILYFGARSGHGLWRSTDYGATWSNVTSFIWTGTYFQDASSTYTSDPVGIAWVTFDSTSGSNGSPTPRIFVGVADTSKSVFVSEDAGSTWSWVTGEPQYGFLPHKGVLSPAEKTLYISYSNGAGPYDGTNGTVHKYNITSKVWTDISPTPMASTYYGYGGLSVDLQVPGTLMVAALNCWWPDELIFRSVDSGATWSPIWAWNGYPNLNYYYSYDISNAPWLQDDTSTAQFPVRVGWTVEALAIDPFDSNHWLYGTGATIYGGHDLKQWDTVHNVTLKSLAVGIEEMAVLGLISPPGGPPLLSAVGDVGGFYHSDLDKAPAQSFHNPTYGTTNGIDYAGNKPSNLVRSGASDTLPTVAMSTDFGKTWSANYAASSTTPTGQVALSADADTVLLMNSNGVMVSKYSSTFSAVSSLPSGAAIASDKSNNTVFYGGSAGAFYVSTDGATSFTKTASLGSSTAVNAIRAHPSIAGDVWATTDTGLWHSTDYGKTFTKIDGGCTAGWSFGLGKASPTGSYAVIYGFFTVDGTTALFKTEDMGMNWQMISDSTHGFGAASANVVNGDMSNYGRVFVGTNGRGIFYGQPSGSLPSPTATATTTKTTSTSTKTSGTTTSSTTLSTTTKTSTTTTSTTKTTTSPTSTGTSTPYGQCGGTGYTGPTACPSGWKCTYQNAYYSQCEFEHLKKTGKHLDR

SEQ ID NO: 24851 - protein, 405 aa, Neosartorya fischeri
  strain ATCC 1020 / DSM 3700 / FGSC A1164 / NRRL 181
MRFTQLFIAVSTASLALAAPPKSKTKRTSAFQWFGCNESGAEFGSGNIPGVLGTDYIWPNTTAIGILREAGMNIFRVPFLMERLVPNNMTGSPDATYMADLVSTINYITSTGAHAIVDPHNFGRYYGNIITSTSDFAAFWTTVATQFKDNDLVIFDTNNEFNAEDQTTVLDLNQAAINAIRAAGATSQYIFVEGNSWSGAWTWDSVNDNLKTLTDPVADSNKLIYEMHQYLDSDGSGTSESCVSATIGQERLASATAWLIANAKKAFLGEFAAGANSVCASAVTGMLEYMEANANVWLGAEWWAAGPWWGDYIYSMEPTAGMAYEYYLEVLEPYFPGGSYTATSTGTGTATATATSTSSTTAVTGTSTAVAQHWGQCGGQGWTGPTGCESPYTCQVQNAYYSQCL

SEQ ID NO: 24852 - protein, 535 aa, Neosartorya fischeri
  strain ATCC 1020 / DSM 3700 / FGSC A1164 / NRRL 181
MASAISFQVYRSALILSAFLPSITQAQQIGTYTTETHPSMTWETCTSGGSCATNQGSVVMDANWRWVHQVGSTTNCYTGNTWDTSICDTDETCATECAVDGADYESTYGVTTSGSQIRLNFVTQNSNGANVGSRLYMMADNTHYQMFKLLNQEFTFDVDVSNLPCGLNGALYFVTMDEDGGVSKYPNNKAGAQYGVGYCDSQCPRDLKFIQGQANVEGWTPSSNNENTGLGNYGSCCAELDIWESNSISQALTPHPCDTATNTMCTGDACGGTYSSDRYAGTCDPDGCDFNPYRMGNTTFYGPGKTIDTNSPFTVVTQFITDDGTDTGTLSEIRRYYVQNGVTYAQPDSDISGITGNAINADYCTAENTVFDGPGTFAKHGGFSAMSEAMSTGMVLVMSLWDDYYADMLWLDSTYPTNASSSTPGAVRGSCSTDSGVPATIESESPDSYVTYSNIKVGPIGSTFSSGSGSGSSGSGSSGSASTSTTSTKTTAATSTSTAVAQHYSQCGGQDWTGPTTCVSPYTCQVQNAYYSQCL

SEQ ID NO: 24853 - protein, 364 aa, Neosartorya fischeri
  strain ATCC 1020 / DSM 3700 / FGSC A1164 / NRRL 181
MHFFQSSLVAATMGAALVAAAPAADLETRSSCTFTSTSALKSGKASCSTITLHNIAVPAGETLDLTGLKTGTTVVFDGTTTFGYKEWEGPLISASGTSITIKQNPGGKIDCDGARWWDGKGGNGGKKKPKFFSAHKLNKSNINGLKVYNIPVHGFSIQSDHLTIKDVLIDNSAGTKLGHNTDAFDVGSSTYITIDGATVYNQDDCLAVNSGEHITFTNGYCNGGHGLSIGSVGGRKNNVVNDVTISNSQIINSQNGARIKTVYGATGSVTGVKFQDVSLKGITKYGIVVQQDYENGKPTGNPTNGVKVSDITFEKVTGSVTSSATDIYILCGSGSCTNWTWSGNSVTGGKKSSKCKNVPAGASC

SEQ ID NO: 24854 - protein, 815 aa, Neosartorya fischeri
  strain ATCC 1020 / DSM 3700 / FGSC A1164 / NRRL 181
MKFWLQQLGLAVLCASSAAARTAEHAYEFKSVAITGGGYITGIVGHPAEKNLLYARTDIGSTYRWEQELNKWIPLTDFLGPEDENLLGTESVAMDPTDPNRLYLAQGRYLSSNNSAFFVSNDRGATFTRYRAPFPMGANELGRNNGERLAVNPFKPNELWMGTRNAGLMKSSDRAKTWTNVTNFPDAAANGIGITFVIFDPQHEGTIYVGACIPGGLYYTTDGGKNWESIPGQPMQWDPSLLVYPNETQPQSAGPQPMKAVLASNGALYVTYADYPGPWGVAYGAVHVYNTTASIWTDITPNANNTSPKPYTPQAFPAGGYCGLSVAPDDPDTVVVVSLDRDPGPALDSMYLSRDGGKTWKDVSQLSTPPGSGGYWGHPIAEAALSNGTTVPWLSFNWGPQWGGYGAPSPVKGLTKFGWWMTAVLIDPSNPDHVLYGTGATIWATDTIAQADKNLAPKWYIQAQGIEETVTLAMISPREGAHLLSGAGDINGFRHDDLDTPQPMFGLPVFSNLNTLDWAGQRPEVIVRGGPCGHQYPDGCGQAAYSTDGGSEWTKFQTCIKGVNTSVHNPGVMTIDASGKYVVWTSAMYVVSPSVQAVTPPANDSGPYASSDWGKTWTSPRGLTVQTPYISADRVQPKTFYAFSGGVWYVSTDGGLSYDAFNATKLGLPAHTGAVPVVSVDRAGEIWLALGSNGVYHTTDFGKRWKRITHKGTVADLITVGAAAPGSTKPALFIRGSPGHPKKSDYGIYRSDDNGSTWDRVDDDDHRYGGFNLIQGDPRVYGRVYLGTGGRGLLYADIVPGQSDKEGNVPGTGGI

SEQ ID NO: 24855 - protein, 453 aa, Neosartorya fischeri
  strain ATCC 1020 / DSM 3700 / FGSC A1164 / NRRL 181
MKFLALAALFASTVSSIAVDGLIPGARVIPANDVVALKKVGAHHQKHPHRRTVIIRPSFNDEDDVSADFLWGIKWANRGGRLLLQKGKKYVIGKKLDLTFLKDIEVQLDGELKFTNDVPYWQANNFYYDFQKSISFWRWGGEDIKIFGSGVLNGNGQRWYNEFAGQEILDPNNKYYRPILFVTENATRVSVEGITQLNSPCWTNFFVRTKDISFNNVFIHAYSTNASALPKNTDGFDTLNVDGLTVTNTRVDIGDDCLSPKPNTTNVFVQNLWCNGTHGTSMGSIGQYPGVLDIIENVWIENVTLLNGENGARLKAWAGPNVGYGRINNVTYKNIHVENTDNPIVLDQCYFNINATQCAAYPSRVNFTNIVFENIYGTSSGKHGKVVADLTCSPNAVCSGIRLKNIHLTSPAGSPPVIVCDGIQGDIGVECQSSTNLTTKRSIGLARNLKYKA

SEQ ID NO: 24856 - protein, 552 aa, Neosartorya fischeri
  strain ATCC 1020 / DSM 3700 / FGSC A1164 / NRRL 181
MRGAILATAAALAGTAMADVAHMRRHGHDSFHQRRAAVAEADATCGCTTEVVTVWGPPTLIPVATPTPSTVTSEAVTTLHSTSTSTVTIVASASTPATSSSPATPKVPLPTPAITNFPSTGVYTIPATTVTVFDTTTVCGATTTELPAGTHTYGGVTTVVETATTVVCPYATVEPSGTTVTSVIKTTTYVCPTPGTYTIAPTTTTVPTSTVVVYPTPAVITPGTYTQPEQTVTVTRTDYTYVCPFTGQNEPTSAPAAPSTTAVPATTTAAVPSTSSAAPSSSSTAPASTGAVGGQMGMTYTPYTKGGDCKDKSSVLSEVANLKSKGFTHVRVYSTDCNSLEYIGEAARTSGLQMIIGVFISSTGVSGAQDQVTAISKWAQWDLVSLIVVGNEAIQNGYCDASTLAGFISSAKSAFQSAGYTGKVTTTEPINVWQAYGSTLCGVCDIIGANIHPFFNADVSADQAGKFVAQEIKVLEGICPGKDVLNLETGWPHAGNANGKAVPGASEQAIAIKSIAQEVGSKSVFFSYFDDLWKEPGQFDVERYWGCIDTFN

SEQ ID NO: 24857 - protein, 254 aa, Neosartorya fischeri
  strain ATCC 1020 / DSM 3700 / FGSC A1164 / NRRL 181
MYQPLLLLPLLLTSAFATPHDPTTHQALDKRASFPIPSSKGSVTYSSPKSVSGTFDGGLKTYGRGVKCSGQKEGGDKDAVFILEDGATLKNAIIGADQIEGVHCKGSCTIQNVWWTDVCEDALSLKGSGSGTHRIIGGGARNADDKVIQHNSGGKVTIQDFTVQNFGKLYRACGNCSKQFKRTVEISGVKASSGKSLVGINSNYGDTATISGCASSVKEICVEYEGTDNNDKEPKKKGSGPSNACKYKEPLSKC

SEQ ID NO: 24858 - protein, 368 aa, Neosartorya fischeri
  strain ATCC 1020 / DSM 3700 / FGSC A1164 / NRRL 181
MRALSVFFALFCFLALSSASPGQDVVKRVTSGSLQQVTNFGSNPSGTLMYIYVPKNLATKPGIVVAIHYCTGTAQAYYTGSPYAQLAEQYGFIVIYPQSPYSGTCWDVSSQSALTHNGGGDSNSIANMVTWTISQYNADTSKVFVTGSSSGAMMTNVMAATYPELFAAATVYSGVSAGCFYSSSNQVDAWNSSCAQGNVISTPEVWGGIAKAMYPGYTGPRPRMQIYHGSTDTTLYPQNYYETCKQWAGVFGYNYNSPQSTQSNTPQANYQTTIWGPNLQGIFATGVGHTVPIHGEQDMEWFGFAGGSSTTTTQPTTTSTTTSSGGSSTGTGVAAHWGQCGGNGWTGPTVCASGYTCTVVNAWYSQCL

SEQ ID NO: 24859 - protein, 472 aa, Neosartorya fischeri
  strain ATCC 1020 / DSM 3700 / FGSC A1164 / NRRL 181
MKRGALLVPFVPLALACVDPGDSNHSCASVFSVSSAAAASFCATFTVSAVTETTGVPAALLSNCDYKTKHLSSACSCLGPATAAAPTQTSAVTPTVAPTTLKANAVAPTTEAPAPTKSSTFAGNGGTTCTVTEYAAISSAVASCSNILLSDVYAPPSSTIDLQNLQTGAAVIFAGTTTFGDTPDDDFDPIVISGTDVTITGADGHVIDGNGAAYWDGKGSNGGSSKPDHFIVAKHMYYSRIENLNIQNWPVHCFDIEHTENLIISGITLDNSAGDAPNSASGSKPAAHNSDGFDIKSSTNLTLQNSWVHNQDDCVAVSSGTDIVVDNMYCYGGHGLSIGSIGGKSDNTVDGVTFSNSQVINSSNGCRIKSNSGTTGEVSNIRYENITVSGITDYGIDIQQDYLNGGPTGKPTNGVKIENITFVDVTGTMSDGKDYYILCGDGSCSNFVFENVGITGGSGDSCNYPTDTCLEA

SEQ ID NO: 24860 - protein, 348 aa, Neosartorya fischeri
  strain ATCC 1020 / DSM 3700 / FGSC A1164 / NRRL 181
MKSTFGLLALAAAAKLVSAHATVHAVWINDVDQGAGNSADGYIRTPPNNSPITDVTSADMTCNVNGKNSVAKTLSVKAGDKVTFEWHHDSRSASDDIIASSHMGPVMVYMAPTEKGTAGNGWVKIAEEGYSNGKWAVANLIANKGKHSITVPDVPAGEYLLRPEIIALHEGNRQGGAQFYMECVQVKVTSAGTKTLPAGVSIPGAYKATDPGVLFDMYNSFTSYPIPGPAVWDGSSSGSSGSSDSSPATTAPEASVTSAPTKQGSADTSASPTTFVTATKPTTTAAPAAPPASTGSNSGSGSSGSGSASGSVKIYQQCGGKNYSGATSCEAGLTCKEWNPYYHQCLKA

SEQ ID NO: 24861 - protein, 324 aa, Neosartorya fischeri
  strain ATCC 1020 / DSM 3700 / FGSC A1164 / NRRL 181
MHLPSLVLGLLGLGLTASASPIEERSNRSKAPDGCLTVGSSGKYSTIGAALDALGDSKSDACIFIGAGTYKEQITIDYKGKLTMYGETTDTSSYKKNQVTITHTISSPQAGTLDKSATVNVRSDGFKMYNINVINGYGKGSQAVALVANADKLGFYGCSFVGYQDTLYAKAGRQYYSNCYIEGATDYIFGNASAWFGECDIMSVGPGYITAMSRTTADQTTWYAIDNCNIYGKPGVDLTAKVYLGRPWRVLARVIYQNSQLSNIINPKGWTTMAEGATPLYYEYNNKGAGADTSKREYESSISGAVSMNTVLGSGWNSWIDTTY

SEQ ID NO: 24862 - protein, 406 aa, Neosartorya fischeri
  strain ATCC 1020 / DSM 3700 / FGSC A1164 / NRRL 181
MLYYRNLALLSLLSLSSAAPSQVERSPDAVFKPRAVCTPTAGGSSSIDDVPAIRKAISSCGNGGTIVFPAGSTYYLNSVLDLAGCSNCDIQVEGLLMFSGSTEYWGGKTAMININKINALKLRSLTGSGVIDGNGQNAYDLFASNSDYERPTLLYITGGSNIEVSGLRQRNPPNVFNSVKGDAKDVTFTNLRMDATSRSDNPPKNTDGFDIGSSTHVTISSVSVSNDDDCVALKPGCNYVTVENVTCTGSHGISVGSLGKSSADTVQNVYAHRITMIDSTKAAGIKTYPSGNGHGLSTVKNVTFSDFNVRGCDYAFQIQSCYGESASYCASHPGNAILQDIIVKGFSGTTSGKDDWVVADLNCGARGTCDVSMSDFSVKAPSGKATVLCANTPSSLGVTCTSGASG

SEQ ID NO: 24863 - protein, 456 aa, Neosartorya fischeri
  strain ATCC 1020 / DSM 3700 / FGSC A1164 / NRRL 181
MRPLSSAALLSAIGAVAAQVGPWGQCGGQSYTGGTSCVSGWACVFLNDWYSQCQPGAEYTPPLCGRNDNPNIFQATTTSTSVSATAPPSSTSSSTASVSSSTSSTPIPTSSGSFVKAEGLKFNIDGETKYFAGTNAYWLPFLTNNADVDSVFDHLQQTGLKILRTWGFNDVNSVPNPGTVYFQLHDPSTSTTTINTGADGLQRLDYVVSAAEKHGIKLLIPLVNNWDDYGGMNAYIKAYGGSKTEWYTNSKIQSVYQAYIKAVVSRYRDSPAIMAWELSNEARCQGCSTDVIYNWATKTSAYIKSLDPNHMVATGEEGMGLTVDSDGSYPYSTYEGSDFEKNLAIPHIDFGVFHLYTADWGITDNSWGNRWVTSHAKLCEAAGKPCLFEEYGLKDDHCSAAVVWQKTSLTTAGMAADLFWQYGQTLSTGQSPNDRYTIYYGTSDWQCAVIDHVSRI

SEQ ID NO: 24864 - protein, 634 aa, Neosartorya fischeri
  strain ATCC 1020 / DSM 3700 / FGSC A1164 / NRRL 181
MRGLLLAGALALPASVFAHPAHQSYGLNRRTVDLNAFRLKSLAKYVNATETVIEAPSSFAPFKQQSYVEAATQHVKMIAPDATFRVVDDHYVGDNGVAHVHFRQTANGLDIDNADFNVNVGKDGKVFSYGNSFYTGQIPSSAALTKRDFSDPVTALKGTTNTLQLPITVDSASSESTEGKESYVFKGVSGTVSDPKANLVYFVKDDGTLALTWRVETDIDSNWLLTYIDAKSGEQIHGVVDYVAEADYQVYAWGINDPTEGERTVVKDPWDSAASEFTWISDGSTKYTTSRGNNGIAQSNPNGGSSYLNNYRPSSSSLSFKYPYSPSSSPPSSYIDASIIQLFYTANTYHDLLYTLGFNEKAGNFEYNTNGQGGRGNDYVILNAQDGSGTNNANFATPPDGQPGRMRMYVWTESTPYRDGSFEAGIVIHEYTHGLSTRLTGGPANSNCLNALESGGMGEGWGDFMATAIRLKPGDKRSTDYTMGEWAANRPGGIRQYPYSTSMSTNPLTYTSVNSLNAVHAIGTVWATMLYEVMWNLIDKHGKNDAPKPTLRDGVPTDGKYLAMKLVIDGMALQPCNPNFVQARDAILDADTALTGGENQCEIWKAFAKRGLGAGAQYSSRNRVGSTEVPSGVC

SEQ ID NO: 24865 - protein, 434 aa, Neosartorya fischeri
  strain ATCC 1020 / DSM 3700 / FGSC A1164 / NRRL 181
MFGQSILLAAVCQFLTLTAALQEEFDSLSPRPSIAITPQGAFKPFPFSPARHKTCHVKSHGDGTDDSKYILRAFRKCSPGGRVVFDKGKVYTIGKAMDIRFLKRVDVDIQGKIVMTNDIDYWLANSFKYAFQDSSSFVQIGGTDINIYGGGEIDGNGQAWWDARMNNKTIQRPILVTYMDLHGGSVSNITLRNSPNWFQLVFNSSNIVFDSMYLNASSSNSNPTANSGEDTYRSDNIVIQNSRIFNSDDCVSFKPNSTNILVQNLYCNGSHGISVGSLGQYVGQVDIVENILVYNTSLNNASDGARIKIWPGAIGNSTNTGGGSGWVRNVTYDGMHNYNNDWAIEMTQCYFAPNQTACNEHPASLIVEDILFKNFDGTTSKKRAPFIATLVCSSPDVCKNIRAENINVLSPSGTDEAICTNMDRSLLDLHCTKG

SEQ ID NO: 24866 - protein, 817 aa, Neosartorya fischeri
  strain ATCC 1020 / DSM 3700 / FGSC A1164 / NRRL 181
MASIAHLIFSGLLAATVANSQQYEGSSRNEDAFNYVQPRNTTIFGQYGHSPAVLPSPNSTGLGEWHAAYAKAREFVSLLTLEEKADMVTGQPGPCVGNIVAIPRLGFNGLCLQDGPMAIRVADYASVFSAGVTAASTWDRDILYERAFAMGQEFRAKGAHIALSPVAGPLGRSAYGGRNWEGFAADPYLTGIAMELSVQGYHDAGVQATPKHFIGNEQETQRNPTFDPNGTVTDVLQEALSSNIDDRTMHELYLWPFANAAHAKAASFMCSYQRLNGSYACQNSKVLNGLLKEELGFQGYVMSDWGGTHSGVASIEAGLDMNMPGGLGPYGTIPEAGSFFGGNVTQAVKNGTVDEARVDDMIVRIMTPYYWLGQDQDFPSVDPSSADLNTFSPRSTWLREFNLTGERSRDVRGDHAKLIRRHGAEATILLKNENNALPLKSPKALAIFGNDAGEPTMGAVNKANFEFGTLAAGGGSGTGRFTYVVSSLEAIKSRAKRANTLVQYWLNNTEVATTDVTTLWVPTPPDACLVFLKTWAEEGEDREHLSVDYDGNNVVFSVARKCNNTIVITHSSGINELPFADHPNVTAILAAHYPGQESGNSIVDVLYGDVNPSGRLPYTIARNGSDYNAPPTTEIATTGKEDWQAWFDEKLEIDYRYFDAHNISVLYEFGFGLSYTTFNLSDINAEPLVKSISSVPEQLPIQPGGNPALWENVYNVSVVVTNSGDVKGKAVPQLYVTFPDNTPAGTPPKQLRGFDKVPLKPGESRAVSFQLMRRDLSYWDVVSQQWLIPEGEFVIRVGFSSRDLREMIRITPVTDST

SEQ ID NO: 24867 - protein, 739 aa, Neosartorya fischeri
  strain ATCC 1020 / DSM 3700 / FGSC A1164 / NRRL 181
MQNLFLSLLAAAVTVHAYGSGGSNWDQAYSRAKDALQKLSQTEKVGLVTGVKWMGGPCVGNTYKPESIDYPSLCLQDSPLGIRFANPVTAFPAGINAGATWDTQLLYARGAAMGAEAKGLGVHVQLGPVAGPLGKNPNGGRNWEGFSVDPYLSGVAMEKTIRGMQDSGVQACAKHWLGNEQEHYRDTISSNIGDRAAHELYVWPFMDAVKADVASVMCSYNKVNGTWACESDAINNKLMKEELGFPGYIMSDWNAQHSTVNSAVSGLDMTMPGSDFSNPPGSIFWGSNLEAAVADGSVPQSRLDDMVTRILAAWYLVGQDKGYPPVAFSSWNGGKANVDVTADHGTVARAVARDSIVLLKNDQRTLPLRKPKSLAIVGLDAIVNPAGPNACSDRGCNNGTLAMGWGSGTAEFPYLVGPLDAIQKRAAADGTKIVPSTTDDPTAGASAAAAAETAIVFINSDSGEGYITVEGNLGDRNNLDPWHNGNELVKAVAAASKNVIVVVHSVGPIILETILAQPSVKAIVWAGLPGQESGNALVDVIYGDTAPSGKLPYTIAKQAADYGASWINAETDDFTEGLYIDYRHFDAKGIAPRYEFGYGLSYTTFKYSGLWVNVYTSAGAANGKVVPGGPADLFEVVGQVSVFVRNNGRVAGAEVAQLYIGLPDSAPATPPKQLRGFQKMMLQPGQMGRATFELTRRDLSYWDVQQQKWVVPSGTFKVYVGSSSRDIREEGSFRVRRGW

SEQ ID NO: 24868 - protein, 241 aa, Neosartorya fischeri
  strain ATCC 1020 / DSM 3700 / FGSC A1164 / NRRL 181
MYQKSLLFSLLATSALAQFPIPDSKGSVTFDAPYEVAAGKTYDGGYKTYGRGVSCSGQGEGGQDDAVFLIQEGGTLKNAIIGSDQIEGVYCLGACTIENVWWEAVCEDALSLKGGSGPYNIIGGGAQGADDKVIQHNSGGQVNIDGFTVYDFGKLYRSCGNCDEQHARTVTIRNVVANSGKTLVGINSNLGDTASIDSSTCATDVKKICVEYKGNNSGDEPEEVSEGPSDACQYSEPLSSC

SEQ ID NO: 24869 - protein, 216 aa, Neosartorya fischeri
  strain ATCC 1020 / DSM 3700 / FGSC A1164 / NRRL 181
MTDRKELVAVEHHLVPTLGSNGVYTAAGSQALFDTAGASWCGAGCGKCYNLTSTGNPPCTGCGTGGAAGESIIVMVTNLCPYNGNQQWCPQVGATNNYGYSYHFDIMAQSEVFGDNVVVNFEPIACPGQATSDWETCVCYGKTATDETPVGMTPGGSNPSPPTSTTTTETTTTITTSGATQTLYGQCGGSGWTGPTACASGATCKVLNSYYSQCLS

SEQ ID NO: 24870 - protein, 840 aa, Neosartorya fischeri
  strain ATCC 1020 / DSM 3700 / FGSC A1164 / NRRL 181
MWSGIPVFALLSSIGIAAAENGLDGWLRYASVPCNGNCQRALPSHIVTLNSTKSSQVYVAGQELQDGLHQILGKHASVKSTGCSTDSSIVVGTVEAYRQVCNTGSQAPELDVDGFWLSIRGKSVQIVGQTERGALYGAYEYLSMLAQGNFSQVSYATSPHAPIRWVNQWDNMDGSIERGYGGPSIFFKDGVIPQDLSRVKQYARLLASVRINGIVVNNVNANASLLMPSNMDGLARIADVFRPYGIRVGISLNFASPSTLGNLSTYDPFDSSVIAWWGNVTDQLYARIPDMAGYLVKANSEGQPGPTTYNRTLADGANMFARALKPHGGVVMFRAFVYDHHISEDNWYNDRANAAVDFFKPLDGKFDDNVVVQIKYGPIDFQVREPASPLFANLYKTNTAIELQVTQEYLGQQSHLVYLPPLWQTILRFDLRVDQKPSPVRDIISGQRFDRPLGGWAAVVNVGTNTTWLGSHLAMSNLYAYGRLAWEPTLDSEDIVQDWIRLTFGLDRRVLDTLTQMSMESWPAYENYSGNLGIQTLTDILYTHYGPNPASQDGNGWGQWTRADHLSIGMDRTVKNGTKFSGQYPAEVAAMYENIETTPDNLMLWFHHVNYTQRLHSGKTVIQHFYDAHYDGAETAQTFVSRWESLRERIDAERYQHVLARLIYQAGHSIVWRDAINNFYRNLSGIADEKERVGYHPWRVEAEDMQLDGYVPYAVSPFETASNFTAIVTASNGTTGTASATLDFKTGTYDLGINYYDMYGGKSHWTVYLNDRVVGQWQGNSEDVLSHTPSIYLDGHSATRITFRDVKIHKGDRLKIVGEPDGVEPAPLDYAVVLPRGIVD

SEQ ID NO: 24871 - protein, 532 aa, Neosartorya fischeri
  strain ATCC 1020 / DSM 3700 / FGSC A1164 / NRRL 181
MYTTKSLLSTLIPIMIPLSLGSVSSPNLLPTPPMGFNNWARFMCDLNETLFLETASAMISTGLLEAGYNRLNLDDCWMAYDRAADSSLQWNTTKFPHGIPWLAYRLKTQGFHLGIYQDAGNLTCGGYPGSFGYEALDAQTFAAWGIDYLKLDGCNVFPEHSRTLEEEYKARYAHWHNVLRQMHPPLIFSESAPAYFADPANLTSWYEVMDWVPAFGELARHSTDILVYVGEGSAWDSIMVNYHYNTLLARYQRPGYFNDPDFLIPDHPGLTLEEKRSQFALWASFSAPLIVSAYIPGLSGEELAILRNEELITVDQDVLGLQATLASRGEEVDVLTRSLAHGDQLLTVLNRGDGVPVVRVPVEWMGLQRGCAYVVKNLWDGEVQVLEEEIVIRLNSHATQVYRIALPEECSTVIPTGIVFNTASGNCLTDENGERVGFEACRGSETQVWQVSELGHLHPLSRTSHCLTAGSQASVQLCTGQKNQQWTYEITGNLKNEHTKMCLTEGTGISQCGFERDSQVFGLPSGVDIKSS

SEQ ID NO: 24872 - protein, 471 aa, Neosartorya fischeri
  strain ATCC 1020 / DSM 3700 / FGSC A1164 / NRRL 181
MLDFMDYIQLAFAEATNWNRDNSYSFLTATAQSLLDFSTPERLRVHLSSLATPHFATSYTLGTVGLIDGSVSYLYSTVPLNNTPSRSALIPLRKLARGYRQVQPPVAPVEDWGWQSLLGGLGSSESKPSGNGDSQPSLGRKATLLNATLHLPPPTTLNALFLRRISPTMQLSLAVCSTRGAPLSNSAPQASLLGQLSHDTGKYSNEYLFSTDNSLFGWRGLWNFGPDPRHPKENPSPRLSLLSAGAEAYYSPVSSLIGMSTGLRFSTLPAATEMPSSSSSTSSTTTTSNHGTPISTFPYTLTLVLTPLTGSLSTTYSLRASPNLAFSSRFGFNVYSWESEMVAGCELWRKRRKSSPPPVDDDGLEWARRKMRMADTPGVPPVEPPSTHNRDEENESVLKIRVDQSWNVRLLWEGRVKELLVSAGVGLGPSSFSSSSWAANSTAAGGGQSVGGGVSGKSYWHGVGVSVSYSS

SEQ ID NO: 24873 - protein, 395 aa, Neosartorya fischeri
  strain ATCC 1020 / DSM 3700 / FGSC A1164 / NRRL 181
MVVFSKVTAVVVGLSTIVSAVPVVQPRKGFTINQVARPVTNKKTVNLPAVYANALTKYGGTVPDSVKAAASSGSAVTTPEQYDSEYLTPVKVGGTTLNLDFDTGSADLWVFSSELSASESSGHAIYKPSANAQKLNGYTWKIQYGDGSGASGDVYKDTVTVGGVTAQSQAVEAASQISSQFVQDKDNDGLLGLAFSSLNTVSPRPQTTFFDTVKSQLDSPLFAVTLKYHAPGTYDFGYIDNSKFQGKLTYADVDNSQGFWMFTADGYGVGDGAPNSNHISGIADTGTTLLLLDDSVVADYYHQVSGAKNSNEYGGYVFPCSTKLPSFTTVIGGYNAVVPGEYINYAPVTDGSSTCFGGIQSNSGLGFSIFGDVFLKSQYVVFDSQGPRLGFAPQA

SEQ ID NO: 24874 - protein, 658 aa, Neosartorya fischeri
  strain ATCC 1020 / DSM 3700 / FGSC A1164 / NRRL 181
MATQRRDESPSGLSDIVEPDGLLGIGLTSRHIEAFGRKVTSTAGHLMGPITDSSNGGHYHTAMADIHRELRRPTTQRKVFSLTQTTPTDLVRSKLSTSEIQSRALSSLPDELLANIPEDSSSYSLFEGFKATQDDHEFRKAHRRRSSKGKKLLKDGEAAGALPSAPTDLKKERDLLSRRLDLMGVRKNMCSSEIHEIDNKIANLHNMRKIVLDRLAGLEMEEAELEHQLTEIDNKLEDIQEEAPKTPVTAATPKSSAVNDDSFVSEDAAMDASFMSESIYQKLPSHSPRSLKQRSIRKRSMPILHEHFAPGSQIKEMQAHTDMVTAIDFDYPFGTMVSAALDDTVRVWDLNIGRCTGFLEGHNASVRCLQVEDNIVATGSMDASVKLWDLSRARTVTRDNRLNKHEEGEGEDDNASDAFSLFSATTLEDCYVFSLDAHVDEVTALHFRGNTLISGSADKTLRQWDLVKGRCVQTLDVLWAAAQASTLAADTQWRPSGRLPDASADFVGALQCFDAALACGTADGMVRLWDLRSGQVHRSLVGHTGPITCLQFDEVHLVTGSQDRSIRIWDLRMGSIFDAYAYDKPITSMMFDTKRIVAAAGENVVKVYDKADGHHWDCGAGVGADESGPAPATVERVRLKDGYLLEGRKDGTVAAWTC

SEQ ID NO: 24875 - protein, 516 aa, Neosartorya fischeri
  strain ATCC 1020 / DSM 3700 / FGSC A1164 / NRRL 181
MRLHAFTLLSLLGLVPSFAAASLSGSVGPLTSASAKAAKKTCNVLDYGAKADKKTDLGPPLAAAFAACKSGGLVYIPAGNYAMSTWVKLANGKAWALQIDGVIYRTGTDGGNMIMIEHTSDFELYSSTSSGAMQGLGYELHAANNWSGPRLLRLWDVSDFSVHDLILVDSPSFHFSIDTCSNGEVYNMAIRGGNHGGLDGVDVWSTNIWIHDVEVTNKDECVTVKSPAKNILVENIYCNLSGGCGMGSLGADTDISDITYKNIYTWNSNQMMMIKSNGGSGTVSNVVLENFIGHGNAYSLDIDSYWSSMSAVSGDGVELSNITIKNWKGTEANGAQRGPIKIICPDKVPCYNILIEDFAMWTETGSKQWYSCQSAYGSGFCLKSGSHHTSYAVTTTTVSSAPSGYSAAKMPLDLSTDFGSTQSIPIPTIPTSFYPGATPYSALMSKQSTKAAKARAVDMSVETPAAASRSEQVVQGASQETSQPAPESAGPVRSVPTGGNRPSRHRHGHHHFWIAA

SEQ ID NO: 24876 - protein, 386 aa, Neosartorya fischeri
  strain ATCC 1020 / DSM 3700 / FGSC A1164 / NRRL 181
MKTAVLSLLLALQAYARVTGSPSGFAAGTTGGGSATPAAPSSLDELVQWITDDTPRVILIDRTWDFIGTEGTTTGKCCSMPSTTVCNGGTSKGQAWIQDHCDGGSWVSCKYDNAALTPMDVGSNKSIVGVGNKGVIKGKGLRVRNGNKNVIIQNIHITNLNPQYVWGGDAITLDNADQVWIDHNKISLIGRQFIVSGWGKAGHVTISNNEFDGRTSWSAGCNGKHYWTLLLLGEQDYYTFEGNWLHDVSGRAPHMGTDHTKSQIFFHGVNNYFQNLGGHAFDVDTNTWVLLEGNYFENVKTPLTDTSLKAGGKLYTTSTVNAAGACLDKLGYICEWNRLAGSGAWQDRTDADVKTKAATYKNSLVGHYPVADVPAKVVANAGVGKV

SEQ ID NO: 24877 - protein, 838 aa, Neosartorya fischeri
  strain ATCC 1020 / DSM 3700 / FGSC A1164 / NRRL 181
MVQLDVEKTIEELTLGEKVALTAGIDFWHTAAVPRLNIPSLRLSDGPNGVRGTRFFNGVPAACFPCATALGATWDTKLLHEVGRLMGEESIAKGTHVVLGPTINIQRSPLGGRGFESFAEDGVLSGILAGHYCKGLQETGVAATLKHFVCNDQEHERLAVDSIVTMRAMREIYLLPFQLAMRICKTACVMTAYNKINGTHVSENKQIITDILRKEWGWDGLVMSDWFGTYSTSDAINAGLDLEMPGPTRWRGTALAHAVSSNKAFEFVVDERVRNILNLHNFVEPLGIPENAPEKALNRPEDQALLRRAAAESVVLMKNQDNILPLKKEKPILVIGPNAKTAAYCGGGSASLDAYYTVTPFEGVSAQSQGEVKFSQGVYSYKELPLLGPLLKTDDGKKGFKFRVYNEPPSEPNRQLIDELHLESSSGFLMDYKHPKIKTFTFYVDMEGYFTPEEDGIYDFGVTVVGTGKLFVDDELVVDNSKNQRQGTAMFGNATVEEKGSKELKAGQTYKVVLQFGTAPTSDLDMRGVVIFGPGGFRFGAARRVSQEELISKAAELASQASQVVIFAGLTSEWETEGHDRDHMDLPPGSDEMISRVLDANPNAVVVIQSGTPVTMPWAHKAKALLQAWFGGNECGNGIADVLYGAVNPAAKLPLSFPVRLQDNPSYLNFRSERGRVLYGEDVYVGYRYYEKVDLAPLFPFGHGLSYTTFSRSDLSLATTPEKPQLEDGEPITATVSVTNTGSVAGAEIVQLWVAPPPTGVNRPVRELKGFAKVFLQPGETKKVEIVVEKKLATSWWDEQREKWASEKGTYEVLVTGTGDEVLKTSFEVGKTRYWLGL

SEQ ID NO: 24878 - protein, 259 aa, Neosartorya fischeri
  strain ATCC 1020 / DSM 3700 / FGSC A1164 / NRRL 181
MNILQSLSILLLLPCTLADVDFTVPTIGTIFKGGDVVTAHWCESGQRPRISELSQYDLYLYAGGDTADTQHEVAVLIKDGLFTRGNSVSVKIDPGVGGNEANAYFLKMVASGPEAFAINFSNRFTLSNMTGSFPPHLVDEIRSLSDSDGSAVKEDLRKRVVGAAYAAYTVPYPLQSGPTKYAPMAKEPGSTIPVKTKAPAPQFTASVYTIATTWLPPATVQATLSASATYSIVSVENTASPAPHPHDAAMKRLMERWKD

SEQ ID NO: 24879 - protein, 400 aa, Neosartorya fischeri
  strain ATCC 1020 / DSM 3700 / FGSC A1164 / NRRL 181
MIRRLAALSALSGLATAWLPEVNKKITSTNGTNLFSSSNGKIRGVNLGSQFVFEPWIAEKAWSDMGCGGQKSEFDCVSSLGQAKANGAFASHWGSWITQDDLAEMVSYGLNTIRVPVGYWMREDLVYSDSEHFPQGGLQYLENLCGWASDAGLYIIIDLHGAPGAQTPQNPFTGQYAPTAGFYQDYQFERALKFLEWMTTNIHQNDKFRNVGMLEVVNEPVQDAGKVGSMRSTYYPNAFKRIRAAEQSLNIDRNNYLHIQMMDRLWGSGDPNESLTDTYYAAYDDHRYLKWAGVAVSKDSYISTSCSDQLNSNTPTIVGEWSLSVPDSVQWNSDWAPDSNKDFYKKWFAAQVTAYEKQQGWIFWTWKAQLGDYRWSYQDAVAAGVIPTDLNSLAGLKVCG

SEQ ID NO: 24880 - protein, 211 aa, Neosartorya fischeri
  strain ATCC 1020 / DSM 3700 / FGSC A1164 / NRRL 181
MKFALLSLAAMAVASPVAIDVRQTAIAGDELRTGPCEPITFIFARGSTEPGLLGITTGPGVCNALKLSRPGQVACQGVGPAYIADLASNFLPQGTNQIAIDEAAGLFKLAASKCPNTKIVAGGYSQGAAVMHGAIRNLPSDVQNMIKGVVLFGDTRNKQDGGRIPNFPTDRTKIYCAFGDLVCDGTLIITAAHLSYGDDVPNATSFLLSKV

SEQ ID NO: 24881 - protein, 491 aa, Neosartorya fischeri
  strain ATCC 1020 / DSM 3700 / FGSC A1164 / NRRL 181
MRISNLIMAASAAGLVSALPVREMAKKRSSGFTWVGINESGAEFGSSIPGNLGTDYTWPDTSKIQTLRDAGMNIFRVPFLMERLVPSSMTGKPDATYLSDLKKTVEFITDSGAYAVLDPHNYGRYSGSIISSTSDFQAFWKTVASEFASNDKVIFDTNNEYHDMDQTLVLNLNQAAINGIRAAGATTQYIFVEGNHYSGAWTWTDNNDNLKGLKDPEDKIVFEMHQYLDSDGSGTSESCVSSTIGQERVKSATQWLKDNSLKGFLGEFAGGVNSQCETAVEGLLSYMSENSDVWLGAEWWSAGPWWGTYMYSLEPTSGPAYSTYLPILKKYFVSGTGSSSSSSSSTTGSTTSVNKPTTSAPTQAQVVDTSSPSSTPTPSSVPAAEAPAPTPIEAAKPSSAASTTPTTTAASTSDSHSDSDSACDASEPADEAALPSATPTTPATAAASSSASASGVAKHWYQCGGINWTGPTNCESGYTCVKQNPYYHQCV

SEQ ID NO: 24882 - protein, 309 aa, Neosartorya fischeri
  strain ATCC 1020 / DSM 3700 / FGSC A1164 / NRRL 181
MSALSSENINGVYIPSALLIFGTFIVKKEFVPYAVALTAILAGLKLFTGGSKPRKVLNPTEFQEFVLKEKTDISHNVCIYRFALPRPADILGLPIGQHISLAATIEGQPKEVVRSYTPISSDNEAGYFDLLVKAYPQGNISKYLTTLKIGDTMKVRGPKGAMVYTPNMCRHIGMIAGGTGITPMLQIIKAVIRNRPRNGGNDTTKLDLIFANVNPDDILLKEELDKLAAEDPDFNIYYVLNNPPQGWTGGVGFVTPEMIKEHLPAPASDVKILLCGPPPMISAMKKATESLGYTKARPVSKLEDQVFCF

SEQ ID NO: 24883 - protein, 372 aa, Neosartorya fischeri
  strain ATCC 1020 / DSM 3700 / FGSC A1164 / NRRL 181
MAVLVALFCLVTWALCTRIPQYSTQGTQQLQQPEKTPHPHPRPEDPFPPTHAADFKIHDPSIIHVDGTYYSYSVGKHIRIHQAPSLDGPWKRTGTVLDADSVIPKGDRKAPWAPQTVHHGDTYYCFYAVSNSGCRDSAIGVATSKSPGPGGWTDHGLLVQSGTGKGSDEHPFASSNTIDPSVFVGEDGHGYLMFGSFWSGIWQVPLDETLLSVAGDTRSEARQLVYMEKAPLPASKHPNPLCREPSGARPIEGSFLSYHEPWYYLWFSYGKCCKFDTKNLPPPGREYSIRVGRSKSPRGPFVDKQGRDLANGGGEIVYASNRDVYAPGGQAVLTEKSGDILYYHYCRYPAVQETEVDADLTVNKSTSYDFWV

SEQ ID NO: 24884 - protein, 342 aa, Neosartorya fischeri
  strain ATCC 1020 / DSM 3700 / FGSC A1164 / NRRL 181
MKVSATTVVLLAGLAAGAPTKTIHSELEKRQFGTGTDGLGALASIFPILGGGGSSTSSGLGALASLIPGLGGSSSSGSGFSLPGFTLPTSIPGLGSLGSLGSSGSSSGASGLSGLSGLGGLSGLNGLSASTTDSSAEASTSGTAATSSDSNSGVALSGLLGGSITENGVKNKDACQPLTFIFARGTSELGNMGSIAGPPVATKLRSLLNNKVVVQGVDYPASIEGNAMLGAAGGPTMASLVKQALSQCPDTKVVVGGYSQGAMVVHNAANSLSEGQIAAAVLFGDPFKSQAVGKVDKADVKEYCAAGDPVCLNGVNVLAHLSYGDDAAEAAQFLVTASGVKA

SEQ ID NO: 24885 - protein, 272 aa, Neosartorya fischeri
  strain ATCC 1020 / DSM 3700 / FGSC A1164 / NRRL 181
MVPTMIYSAILALSAFTPSVLAQTRSSGCGKQPSLTNGVHNINGREYILKVPDNYDKNKAHHLVFGLHWRGGNMWNIVDGQSVQPWYGLETRAQGSTIFVAPNGKNAGWANNGGEDIAFIDAIIKQVEGDLCVDQSSRFATGFSWGGGMSYSLACSRAKQFRAVSVLSGGVISGCDGGNDPIAYLGIHGINDGVLPFQGGVNLAQKFVKNNRCQQANVGTPQPGSHGSVRTDFKGCSKPVSFIAYDGGHDAAPLGVGSSLAPDATWKFFMAA

SEQ ID NO: 24886 - protein, 450 aa, Neosartorya fischeri
  strain ATCC 1020 / DSM 3700 / FGSC A1164 / NRRL 181
MQFTQLVALALALATSEAAHQGFNYGNTKSDGSAKSQSDFQAEFSTAKNLVGTSGFTSARLYTMIQGGTANTPISAIPAAVAEETSLLLGLWASGGNFANEIAALKTAIADYGDDLAKLVVGISVGSEDLYRNSVDGVKAKAGLGTNPDEIVSYINQVRSTIAGTKLSGAPIGHVDTWTAWVNGSNSAVIDACDWLGFDGYPYFQNTMANSISDAKALFDESVAKTEAVAKGKEVWITETGWPVSGNTENLAVANLANAKTYWDEVGCPLFGKTNTWWYILQDANPVTPNPSFGIVGSTLSTTPLFDLSCSASSSAAASSTAVPSASSVAGAKASGFATAAASSGAAGSAKPTFTVGKGPGGSYNGTGFWNSTSSARPSSTAISGSSSGSASGSSGSSGSGASGASGQSSSSTGSSSAPSSSNILSNAASGLSGSIFGAVVAVCLALAAL

SEQ ID NO: 24887 - protein, 228 aa, Neosartorya fischeri
  strain ATCC 1020 / DSM 3700 / FGSC A1164 / NRRL 181
MVSFSYLLLACSAIGALAAPVESEDTSFNETALHEFAERGGTPSSTGWNNGYYYSFWTDGGGDVTYTNGAGGSYSVNWRNVGNFVGGKGWNPGSARTINYGGSFNPSGNGYLAVYGWTTNPLIEYYVVESYGTYNPSSGGTFKGTVNTDGGTYNIYTAVRYNAPSIEGTKTFTQYWSVRTSKRAGGTVTMANHFNAWSRLGMNLGTHNYQIVATEGYQSSGSSSITVY

SEQ ID NO: 24888 - protein, 1011 aa, Neosartorya fischeri
  strain ATCC 1020 / DSM 3700 / FGSC A1164 / NRRL 181
MKFLLRRFIALAAASSVVAAPSVSHLSLQDAANRRELLQDLVTWDQHSLFVRGERLMIFSGEFHPFRLPVPGLWFDVFQKITSLGFNAVSFYTDWGLMEGNPGHVVTDGIWSLDEFFTAASEAGIYLIARPGPYINAETSAGGIPGWVLRLKGIIRSNSEDYLRATDTYMATLGKIIAKAQITNGGPVILVQPENEYTTWPNVSESEFPTTMNKEVMAYAEKQLRDAGVVVPTVVNDNKNLGYFAPGTGLGETDLYGIDAYPMRYDCGNPYVWPTYRFPRDWQHTHRNHSPTTPFAIMEFQGGSGDGWGGVTEDGCAILVNNEAVRVVYKNNYGFGVGVFNIYMTYGGTNWGNLGYHGGYTSYDYGAAITEDRQIWREKYSEEKLQANFLKVSPAYLTATPGNGVNGSYTGNKDIAVTPLFGNGTTTNFYLVRHADFTSTGSVQYQLSVSTSVGNVTIPQLGGSLSLNGRDSKFHVTDYDVGEFNLIYSSAEIFTWAKGDNKKRVLVLYGGAGELHEFALPKHLPRPTVVDGSDVKMAKKGSAWVVQWEVTAQRRVLRAGKLEIHLLWRNDAYQHWVLELPAKQPIANYSSPSKETVLVKGGYLLRSACITNNKLHLTGDVNATTPLEVISAPKRFDGIVFNGQSLKSTRSKIGNLAATVRYQPPAISLPDLKRLDWKYLDSLPEISPDYSDEGWMSLTNTYTNNTRKFTGPTCLYADDYGYHGGSLIYRGHFKANGDESWVFLNTSGGVGFANSVWLNQTFLGSWTGSGNNMTYPRNISLPHELSPGKPYVFTVVIDHMGQDEEAPGTDAIKFPRGILDYALSGHEVSDLKWKMTGNLGGEQYQDSTRGPLNEGAMYAERRGYHLPNPPTSSWKSSSPINDGLTGAGIGFYATSFSLDLPEGYDIPLSFLFNNSASDARSGTSYRCQLFVNGYQFGKYVNDLGPQTNFPVPEGILNYNGVNYVAVSLWALEPQGALVGGLELVASTPILSAYRKPVPAPQPGWKPRRGAY

SEQ ID NO: 24889 - protein, 292 aa, Neosartorya fischeri
  strain ATCC 1020 / DSM 3700 / FGSC A1164 / NRRL 181
MLFTAVTLALLGQALAGPVDLEERQNSCPNIHVFGARETTAPPGYGSSSTVVNLILNAYPGSTSEAINYPACGGQSSCGGVSYGNSVVAGINAVASAVNSFNQRCPSTQLVLVGYSQGGQIMDNALCGGGDPNQGYPNTAVPLSSSAVNMIKAAIFMGDPRYIAGLPYNVGTCRAGGFDPRPAGFSCPSASKIQSYCDAADPYCCNGNDANTHQGYGTEYGQAALTFVKSKLSSSGSGGGSGGGSGGSGGSGGSGGTVAHYGQCGGQGWTGATSCQSPYTCKVVSQWYSQCL

SEQ ID NO: 24890 - protein, 450 aa, Neosartorya fischeri
  strain ATCC 1020 / DSM 3700 / FGSC A1164 / NRRL 181
MKHLASSIALTLLLPAVQAQQTVWGQCGGQGWSGPTNCVAGAACSTLNPYYAQCIPGATATSTTLSTTTTTQTTTKPTTTGPTTSAPTVTASGNPFSGYQLYANPYYSSEVHTLAMPSLPSSLQPKASAVAEVPSFVWLDVAAKVPTMGTYLADIQAKNKAGASPPIAGIFVVYDLPDRDCAALASNGEYSIANNGVANYKAYIDAIRAQLVKYSDVHTILVIEPDSLANLVTNLNVAKCANAQSAYLECVDYALKQLNLPNVAMYLDAGHAGWLGWPANLGPAATLFAKVYTDAGSPAALRGLATNVANYNAWSLSTCPSYTQGDPNCDEKKYINAMAPLLKNAGFDAHFIMDTSRNGVQPTKQSAWGDWCNVIGTGFGVRPSTNTGDPLQDAFVWIKPGGESDGTSNSSSARYDAHCGYSDALQPAPEAGTWFQAYFEQLLTNANPSF

SEQ ID NO: 24891 - protein, 771 aa, Neosartorya fischeri
  strain ATCC 1020 / DSM 3700 / FGSC A1164 / NRRL 181
MARIMSWHYGKAITLFVCLGPVALSLDTFPDCSSGPLSKLAVCDTSLDVTTRARSLVNAMTFEEKVNNTQYNSPGVPRLGLPAYNWWSEALHGVAGSPGVEFADSGPFSYATSFPQPILLGATFDDDLIKQVATVVSTEGRAFGNAGRAGLDFWTPNINPFRDARWGRGQETPGEDPLHVSRYVYHLVDGLQNGIGPANPKVVATCKHFAAYDLEDWNGVVRHSFNAEVSTQDLSEFYLPPFKSCARDAKVDAVMCSYNALNGVPACADSYLLQTILREHWKWDEPGHWITGDCGAIDDIYNGHNYTKTPAEAAATALNAGTDLDCGTVFPKYLGQAADEGLYTNKTLDKALVRLYSSLVKLGYFDPAEDQPYRSIGWKDVDSPAAEALAHKAAVEGIVLLKNDKTLPLKAKGTLALIGPYANATKQMQGNYEGPPKYIRTLLWAATQAGYDVKYVAGTAINANSTAGFDAALSAAKQADVVVYAGGIDNTIEAEGHDRTTIVWPGNQLDLIDQLSKIGKPLVVVQFGGGQVDDSSLLSNPHVNALLWTGYPSQEGGSAIFDILTGKTAPAGRLPVTQYPADYVNQVPLTDMALRPGSNTPGRTYRWYDKAVLPFGFGLHYTTFKISWPRRALGPYDTAALVSRSPKNVPIDRAAFDTFHIQVTNTGKTTSDYVALLFLKTIDAGPKPYPLKTLVGYTRAKQIKPGEKRSVDIKVSLGSLARTAENGDLVLYPGRYTLEVDVGENQYPTASFTVKGKEAILDSFPQPPETR

SEQ ID NO: 24892 - protein, 348 aa, Neosartorya fischeri
  strain ATCC 1020 / DSM 3700 / FGSC A1164 / NRRL 181
MRHVQSTQLLAALLFTTHVTAHGHVTNIVVNGVSYRGWNIDSDPYNPNPPVVVAWQTPNTANGFISPDAYGTNDIICHLNATNARGHAVVAAGDKISIQWTTWPDSHHGPVIDYLARCGSSCETVDKTTLEFFKIDGVGLVDGSTPPGVWGDDQLIADNNSWLVEIPPTIAPGYYVLRHELIALHGAGSQNGAQNYPQCFNLQITGSGTAQPSGVKGTKLYSPTDPGILVNIYNSLSTYIVPGPTLIPGAVSVVQSSSTITASGTPVTGSGSAPTTSAPTTTKATTTLSTTTTATTTKATTTAGGSTSVQSAYGQCGGSGWSGPTACATGATCSSYNSYYSQCIPTAS

SEQ ID NO: 24893 - protein, 525 aa, Neosartorya fischeri
  strain ATCC 1020 / DSM 3700 / FGSC A1164 / NRRL 181
MMRWFLLIGLASAAATDSSASFESRCQHFHKEIHLQNVHVHSTTYVPIGSNISMAYNPPICGGTSSSSISTIEFCQVALNVTTSDKSQFFMEAWLPSNYTGRFLSTGNGGLNGCVGYGDMIYASQYGFATIGTNNGHFGDTGQYFLNNPEVIEDFAYRALHTGTVVGKALTKLFYPQGYKNSYYLGCSTGGRQGWKSIQRFPDDFDGVVAGAPAFNFVNLCNWGSRFLKITGPPDSDTFVTSAQWSIIHNEIIRQCDALDGAVDGTIEDTDLCQPIFETLICNSTAVNKTSCLTGVQANTVNEVFSAMYGLDGKWLYPRMQPGSELAASFIYYSGNGFKYSDDWFKYVVYNDSNWDHSTWTLADAAAADAQDPFQISTFDGDISGFQKAGGKVLHYHGLEDAIITSDSSKAYYKHVADTMGLSPSDLDQFYRFFPISGMGHCSPGTGAASIGQGSSTYAGDDPQDNVLMAMVQWVEKGIAPEYVRGSKKSIDGQTEYRRKHCKYPKRNRYVGPGKYTDENAWKCV

SEQ ID NO: 24894 - protein, 321 aa, Neosartorya fischeri
  strain ATCC 1020 / DSM 3700 / FGSC A1164 / NRRL 181
MYLYTLILLFLASVNVNAYADPGACSGNCWTHDPGLYQRKSDGKYFRFATGGGIHIASADSLEGPWTDDGYVLPNGSIIDLNGKNNLWAPDLHYRDGTYYLYYAVSSLGSQNSAIGVATSKTMEAGSWTDHGTTGIESTPASPYNAIDANWIAVGGTQYANFGSYWNNLFQVEMTNGLKVKSGATPHQIAYNASGIHRQEAAFMFERNDYFYLTFSGGIALGYNDTWPAPGEEYFISVCRSTSATGGFVDKNGVSCLNSGGTLLLASHGFVYGPGGQGILKDSSKGFVLYYHYADTRIGKAVEDYQFGWNQLKWENDWPSV

SEQ ID NO: 24895 - protein, 469 aa, Neosartorya fischeri
  strain ATCC 1020 / DSM 3700 / FGSC A1164 / NRRL 181
MDSKRGIVAAVLALLSVVSAQQPATSSAGNPKLTTYKCTTAGGCVAQDTSVVLDWGSHWIHTVNGYTSCTTSSGVDSTLCPDEATCAKNCVIEPANYTSAGVATSGDSLTMYQYVQNNGVYTNASPRLYLLGPDKDYVMLKLLGQELSFDVDLSTLPCGENGALYLSEMSASGGRNEYNTGGAEYGSGYCDAQCPVIAWKNGTLNTSGASYCCNEMDILEANSRANSYTPHPCSATDCDKGGCGFNPYALGQKSYWGPGGTVDTSKPFTITTQFITNDGTTTGTLSEIRRQYIQNGKVIANAVSSAGVSSITEDWCTSVDSSAATFGGLTTMGKALGRGMVLIFSIWNDASGFMNWLDSGNSGPCSSTEGNPDLIKAQNPTTHVVFSNIRWGDIGSTFKGSDDSGTTTTKTTTTKTSTSTTSTKTTTSTAPGATQTHYGQCGGQGWTGPTACASPYTCKAQNQWYSQCL

SEQ ID NO: 24896 - protein, 432 aa, Neosartorya fischeri
  strain ATCC 1020 / DSM 3700 / FGSC A1164 / NRRL 181
MKFSYSFVQVVSLLLSLSPSVEGFTRSRNDACKPNHPFRPLPPSQPRTKTCHVVSNGHGKDDSKNIMQALHKCNNGGKVVFDANKVYTVGTALDMTFLKHIDLEVLGKIQFTNDTDYWQAHSFKHGFQNATTFFQLGGQDVNVYGGGTFDGNGQVWYDLYAEDALILRPILFGIIGLKGGTIGPLKLRYSPQWYQLVANSSDVIFDGIDISGYSSSKNEAKNTDGWDTYRSDNIVIQNSVINNGDDCVSFKPNSTNIIVQNLHCNGSHGISVGSLGQYKGEVDIVQNVLVYNISMYNASDGARIKVWPGVSSAMSEDLQGGGGLGSVKNITYNQMYIENVDWAIEVTQCYGQKNLTLCNEHPSNLTISDIHFKNFRGTTSGKRDPDVGTIVCSSPNVCSDIHAENINVKSPKGTDEFVCTNVDKSLLDVNCA

SEQ ID NO: 24897 - protein, 479 aa, Neosartorya fischeri
  strain ATCC 1020 / DSM 3700 / FGSC A1164 / NRRL 181
MMLLLGIFLAWLAVAAAQSSCVSAWGQCGGISYTGSTCCQSGNTCAEINSYYYQCTPATAVSTSTITGTSPSSPGSSSANTSGYTTTTVFPSPTATQNPYPPANASSCGSWALVDNVCCPYYCLSNNESESCTSSCTGGCGSPDSSMCKSGTMWGEQGTVTSNEDWHYSRSTHFGLTSGGACGFGLYGLCTKNSVTASWTDPMLGSTCDAFCTAYPLLCKDPANVTLRGNFAAPNGDYYTQFWPSLAASGNPDNYLSCGECFELIRTKPDGTDYAVGESGYTDPIVLEVVDSCPCDANSKWCCGSGADHCGEIDFKYGCPLPEGSHHMDLSDIAMGRLQGNGSLTDGVIPIRYRRVPCPKPGNIYIWLHDGAGQYYFALSAVNTNGPGSVISIEVQAGGSGPWIALEHDPNYTSSRPQERYGSWVLPQGKGPITAPVAMRLTAPDGQQVVKEGAITSFTPPATAVKGFWYIDLGVQFTR

SEQ ID NO: 24898 - protein, 983 aa, Neosartorya fischeri
  strain ATCC 1020 / DSM 3700 / FGSC A1164 / NRRL 181
MRIFSFLFLLLLGILTGQGLVSGTDNGKTTDVTWDKYSLSVKGQRLFVFSGEFHYQRLPVPELWLDVFQKLRANGFNAISVYFFWSFHSASEGEFDFENGAHDIQRLFDYAKEAGLYVIARAGPYCNAETSAGGFALWAANGQMGNERTSDEAYYEKWRPWILEVGKIIAKNQITNGGPVILNQHENELTETTYDPNHTLVVYMKQIAQVFEEAGIVVPSSHNEKGMRGVSWSTDYHNVGGAVNIYGLDSYPGGLSCTNPNSGFRLVRTYYQWFQNYSSTQPSYMPEFEGGWFQPWGGSFYDTCATELSPEFPDVYYKNNIGSRVTLHSIYMTYGGTNWGHSAAPVVYTSYDYAAPLRETREIRDKLKQTKLIGLFTRVSTDLLKTYMEGNGTGYTSDSSIYTWSLRNPDTNAGFYVLAHSTSSARDVTTFSLNATTSAGAISIPDIELNGRQSKIIVTDYNFGTNSTLLFSSAEVLTYANLDVNVLVFYLNVGQKGTFALKDEPKLAFQTYGNSNVTTSESSYGTQYSYTQGEGVTAVKFSNGVLAYLLDKESAWNFFAPPTTSSPQVAPNEHILVQGPYLVRGASINHGTVEITGDNANTTSIEVYTGNSQVKKVKWNGKTIETRKTAYGSLIGTVPGAEDVKIRLPSLDSWKAQDTLPEIQPDYDDSTWTVCNKTTSVNAIAPLSLPVLYSGDYGYHAGTKVYRGRFDGRNVTGANVTVQNGAAAGWAAWVNGQYAGGSAGSPSLAATSAVLTFNGLSLKDRDNVLTVVTDYTGHDQNSVRPKGTQNPRGILGATLTGGGNFTSWRIQGNAGGEKNIDPVRGPMNEGGLYGERMGWHLPGYKVPKSASKSSPLDGVSGAEGRFYTTTFKLKLDKDLDVPIGLQLGAPEGTKAVVQVFMNGYQFGHYLPHTGPQSLFPFPPGVINNRGENTLAISMWALTDAGAKLDKVELVAYGKYRSGFDFNQDWGYLQPGWKDRSQYA

SEQ ID NO: 24899 - protein, 441 aa, Neosartorya fischeri
  strain ATCC 1020 / DSM 3700 / FGSC A1164 / NRRL 181
MKPLSSLLLSAALSAAAPPHPASPQAPLADIPRIGVETRTEFSQNSLDDVVNASPLLSFHRDLVSIESISGNEGAAGAFVADFLESHNFTVIKQPVTTESDARFNIFAFPKSQSHSLDESHPSHGPQILLTSHIDTVPPFIPYSLHRDANDTDDRNILIAGRGTVDAKGSVAAQIFAALDTLAVQPPAPLGLLFVVGEETGGDGMKAFSQSTHLNPSPSRFHTVIFGEPTELALVAGHKGMLGFEVAAHGHAAHSGYPWLGESAISAILPALARVDHLGNIPVEEGGLPASDKYGRTTVNIGQMEGGVAANVVPSEARAGVAVRLAAGTHDEAREIVLKAVRDATGGDDRVVVNFSLEGYGPQDLDTDVAGFNVTTVNYGTDVPNLQLHPRPDGKVKRYLYGPGTIHVAHGDNEALTVAQLEEAVRGYKKLIQAALDRSTS

SEQ ID NO: 24900 - protein, 452 aa, Neosartorya fischeri
  strain ATCC 1020 / DSM 3700 / FGSC A1164 / NRRL 181
MHQRALLFSALAVAANAQQVGTQKPETHPPLTWQKCTAAGSCSQQSGSVVIDANWRWLHSTKDTTNCYTGNTWNTELCPDNESCAQNCAVDGADYAGTYGVTTSGSELKLSFVTGANVGSRLYLMQDDETYQHFNLLNNEFTFDVDVSNLPCGLNGALYFVAMDADGGMSKYPSNKAGAKYGTGYCDSQCPRDLKFINGMANVEGWKPSSNDKNAGVGGHGSCCPEMDIWEANSISTAVTPHPCDDVSQTMCSGDACGGTYSATRYAGTCDPDGCDFNPFRMGNESFYGPGKIVDTKSEMTVVTQFITADGTDTGALSEIKRLYVQNGKVIANSVSNVADVSGNSISSDFCTAQKKAFGDEDIFAKHGGLSGMGKALSEMVLIMSIWDDHHSSMMWLDSTYPTDADPSKPGVARGTCEHGAGDPEKVESQHPDASVTFSNIKFGPIGSTYKA

SEQ ID NO: 24901 - protein, 329 aa, Neosartorya fischeri
  strain ATCC 1020 / DSM 3700 / FGSC A1164 / NRRL 181
MKFGSIVLIAAAAGSAVAAPAKRASVFQWFGSNESGAEFGQNTIPGSYGKEFIFPDPSTISTLIGKGMNIFRVQFLMERLVPSSMTGSYNEEYLANLTSVVDAVTKAGSYAILDPHNFGRYNGQIISSTDDFKTFWQNLAGKFKSNNLVIFDTNNEYHDMDQALVLNLNQAAINGIRAAGATSQYIFVEGNSWSGAWTWVDVNDNLKALTDPQDKIVYEMHQYLDSDGSGTSESCVSTTIGKERVTAATKWLKDNGKVGIIGEFAGGVNDQCRTAISGMLEYLAQNTDVWKGALWWAAGPWWGNYMFNMEPPSGAAYVGMLDILEPYLG

SEQ ID NO: 24902 - protein, 632 aa, Neosartorya fischeri
  strain ATCC 1020 / DSM 3700 / FGSC A1164 / NRRL 181
MATVRICVCGDEGTGKSSLITSLVKGVFVTNKIQPVLPQITIPPTIGTPENVTTTTVVDTSALPQERSNLAREIRKSNVILLVYSDHYSYERVALFWLPYFRSLGVNVPVVLCANKSDLAADHIEAQVIEEEMLPVMAEFKEIDSCIRTSAREHRNVNEAFFLCQKAVTHPIAPLFDSKESALKPAAVAALQRIFYLSDKDRDGYLSDKEIEDFQMRCFDKPLSKEDLVHIKETIQKTHPDSVTPFGIDCRGFIHLNKMYAEKGRHETVWIILRAFQYTDNLSLQESFLHPRFEVPPFASAELSPEGYRFFVNLFLLSDKDNDGGLNDAELASLFAPTPGLPASWADGSFPSSTVRNEAGHVTLQGWLAQWSMTTFQSPKTTLEYLAYLGFESSDRSNPSTTAALKVTRPRKKRKRPGRVGRNVVLGHVVGAPGSGKSALLDAFLARGFSHTYRPTIQPRTAVNTVELPGGKQCYLILDELGELEPAILENQAKLLDQCDVIVYTYDSSDPDSFAYIPQLRSKYPHIEELPSVFIALKADLDRTTQRAEHQPHEYTAMLNMPSPPLHVSATWSSIQEVFVHIAEAAMEPSTAFPRSEEDVEGKWMAWGIALGAVVCAGAAAVMIWRRVSGSG

SEQ ID NO: 24903 - protein, 869 aa, Neosartorya fischeri
  strain ATCC 1020 / DSM 3700 / FGSC A1164 / NRRL 181
MRVLSAIALVASLVPSALSAPASESRVSTQLQSRDAAGYSSPPYYPAPNGGWLSSWADAYEKAQRVVRNMTLAEKVNLTTGTGIFMGPCVGQTGSALRFGIPNLCLQDSPLGVRNSDHNTAFPAGITVGATFDKDLMYARGVELGEEFRGKGINVFLGPSVGPIGRKPRGGRNWEGFGADPSLQAIGGAQTIKGIQSRGVIATIKHYIGNEQEMYRMSNIGQRAYSSNIDDRTLHELYLWPFAEGIRAGVGAVMTAYNEVNSSACSQNSKLLNEILKDELGFQGFVMTDWLGQYGGVSSALAGLDMAMPGDGAIPLLGNAYWGSELSHSILNGSVPVSRLNDMVTRIVATWYKMGQDGDFPLPNFSSNTQDATGPLYPGALFSPSGVVNQYVNVQADHNITARAIARDAITLLKNDDNILPLKRNDSLKVFGTDAGPNPDGLNSCADMGCNKGVLTMGWGSGTSRLPYLVTPQEAIANISSNAAFFITDNFPSNVAVSSGDVAVVFISADSGENYITVEGNPGDRTSAGLNAWHNGDKLVKDAAAKFSKVVVVVHTVGPILMEEWIDLPSVKAVLVAHLPGQEAGWSLTDVLFGDYSPSGHLPYTIPRAESDYPSSVGLLSQPIVQIQDTHTEGLYIDYRHFLKSSITPRYPFGHGLSYTTFSFSQPTLSVRTALDSAYPPTRPPKGPTPTYPTTIPNPSEVAWPKNFDRIWRYLYPYLDDPAGAAKNSSKTYPYPAGYTTVPKPAPRAGGAEGGNPALFDVAFAVSVTVTNTGTRPGRAVAQLYVELPDSLGETPSRQLRQFAKTKTLAPGASETLTMEFTRKDISVWDVVVQDWKAPVRGEGVKIWLGESVLDMRAVCEVGGACRVI

SEQ ID NO: 24904 - protein, 930 aa, Neosartorya fischeri
  strain ATCC 1020 / DSM 3700 / FGSC A1164 / NRRL 181
MHVKAETVLALLTPGLPSVVGQHVVDLSGDGWTLSSTALDRTVPGHLPSQVHLDLFEAGVINITASMILTFVGLLMPIGRIPATRLKACDLENFESTWLVFDGLDTFTTITFCDQHVGSTDNQFRQYHFDVSQILKECKQDPVIRINFGSAPSIANAIAKSPDAEEWPPGVQITNEYPNRWYIRKEQSDFGWDWGPAFAPVGPWKPSYIVQNNHAELYVLNTDLDFYRQGQINYLPPDQSQPWIVNASIDILGPVPWKPSMSIEIKDAATGSVLSSGLLQNVTVSGNSITGTTTIDGDAPKLWWPSGMGEQNLYNVTVTVQNDKKKSLAKVTKRTGFRTIFLNQRNITDDQLAQGIAPGANWHFEINGHAFYAKGSNIIPPDAFWPRVTQARMARLFDAVTAGNQNMLRVWASGAYLHDFIYDLADEKGILLWSEFQFSDALYPVNDAFLENVAAEVVYNVRRVNHHPSLALWAGGNEIESLMLPMVKRADPTGYSKYVGEYEKLYISLILPLVYENTRSITYSPSSTTEGYLYVNLSAPVPMAERYSNTTPGSYYGDTDYYNYDTSVSFDYNHYPVGRFANEFGFHSMPSLQTWQQAVDPEDLHFNSSVVMLRNHHYTAGGLFTDNFKNSSKGMGEMTMGVEAYYPIPSKSDSVANFSAWCHATQLFQADMYKSQIQFYRRGSGMPERQLGSLYWQLEDIWQAPTWAGIEYDGRWKVLHYVARDIYQPIIVSPFWNYTTGRLEVYVTSDLWEPAQGTVNLTWVDLSGKTIANNAGTPETVNFTVGALNTTNIYTTNISELSLPDLKDSILILSLSGEGRLPNTSSKKAFVHQNHFTPVFPKDLSLKDPKLEISYSPESRKFTVQATGGVSLYTWLDYPAGAVGYFEENAFVLLPGVQKEVSFAAQEGNVTDDWVRRVTVQSLWDQKVRD

SEQ ID NO: 24905 - protein, 234 aa, Neosartorya fischeri
  strain ATCC 1020 / DSM 3700 / FGSC A1164 / NRRL 181
MANVALIGATGMVGSHILTSLLENPAVARVDTISRRTPSAAAAAPQTQLTTFVSDDTSRWAAQLSSLTPTPSIFISAFGTTRAAAGGFENQYKVEHGLNVEMARAARDAGTKVYVLISSGGANKASSFAYPRMKGEIEEDVKALGFERTVILRPGLISGQRQESRPAEAAFRFIAGIAGKVHSGLKDGWAQDADVIARAAVNAGLKALDGDVPPGSEKLWILGGSDIIKYGGKK

SEQ ID NO: 24906 - protein, 526 aa, Neosartorya fischeri
  strain ATCC 1020 / DSM 3700 / FGSC A1164 / NRRL 181
MTKLSLLPLLALASAVLAKQDAFQAKCASFGHRIKLPNVHVNFVEYVPGGTNLTLPDNHVTCGASSQIVSADMCRVAMAVDTSKSSQITLEAWFPRNYTGRFLSTGNGGLSGCIQYYDLAYTAGLGFATVGANNGHNGTSGKPFYQHPEVIEDFAYRSIHTGVVVGKQLIKMFYSEGFDKSYYLGCSTGGRQGFKSIQKYPNDFDGVVAGAPAFNFVNLISWSIHFYSITGSNTSDTYLSPASWKVVHDEIVRQCDGIDGAKDGIIEDTDLCHPILETIICKPGASSTTNCITGTQAKTVRNVLSPFYGVNGTLLYPRMQPGSELFASSIMYNGQPFSYSTDWYRYVVYNNPNWDATKWTVEDAAVALAQNPYNIQTWDADISSFQKAGGKVLTYHGIQDQLISSDNSKLYYARVAETMGLGPEELDDFYRFFPVSGMAHCSGGDGAYGIGNGLRTYNGAEPENNVLMAMVQWVEKGVAPEFIRGAKFSNGVGSPVEYTRKHCKYPRRNVYKGPGNYSDENAWECV

SEQ ID NO: 24907 - protein, 73 aa, Neosartorya fischeri
  strain ATCC 1020 / DSM 3700 / FGSC A1164 / NRRL 181
MKSFNLLSLSLLLAIASAAAVPDVEGTITNDAATPVNNLDDKRDHCGQVCLNKTGCGGKCPKCDMRSLTCKKA

SEQ ID NO: 24908 - protein, 335 aa, Neosartorya fischeri
  strain ATCC 1020 / DSM 3700 / FGSC A1164 / NRRL 181
MKLTSSILFSLASVTPLVSGHYVFSKLIVDGKPTQDFEYIRKNTNGYMPTLPSDILSNDFRCNKGSMQSAASTKVYTVAPGTELGFQLAYGAEMKHPGPLQIYMSKAPGDVKSYDGSGDWFKVHQEGLCADTSKGIVDEDWCTWGKDTASFKIPEDTPAGQYLVRVEHIGLHRGFLGESEFYFTCAQIEVTGSGSGSPSPVVKIPGVYKPEDPNIHFNIWYPTPTAYNLPGPSVWTGGSVGGASPTAPAVNNNAVPAAPTTMTTLSKSPAKPTAGAEAGAGAGAVCGGSVSSSAVAPGGTLQKWAQCGGLNWTGSGSCETGTTCHQYNPYYYQCI

SEQ ID NO: 24909 - protein, 412 aa, Neosartorya fischeri
  strain ATCC 1020 / DSM 3700 / FGSC A1164 / NRRL 181
MKASTIICALLPLALAVPNARRASGFVCMFPFLLFIAEADGEIGFGSNESGAEFGETKLPGVLGTDYIWPDASTIKTLHDAGMNIFRVAFRMERLIPDKMTGTPDATYMNDLKATVNAITSLGAYAVIDPHNYGRYYGNIISSTDDFAAFWKTVAAQFASNDHVIFDTNNEYHDMDQTLVLNLNQAAINAIRAAGATSQYIFVEGNSWSGAWTWTNVNDNLKALTDPQDKIVYEMHQYLDSDGSGTSATCVSSTIGQERVQSATQWLKTNGKKGIIGEFAGGPNSVCQSAVTGMLDYLSANSDVWMGAAWWAAGPWWADYMFSMEPPSGTGYQNYLSLLKPYFVGGSGGNPPTTTTTTTSKPTTTTTTAGNPGGTGVAQHWGQCGGIGWKGPTACATPYTCQKLNDYYSQCL

SEQ ID NO: 24910 - protein, 530 aa, Neosartorya fischeri
  strain ATCC 1020 / DSM 3700 / FGSC A1164 / NRRL 181
MLASTFSYRMYKTALILAALLGSGQAQQVGTSQAEVHPSMTWQSCTAGGSCTTNNGKVVIDANWRWVHKVGDYTNCYTGNTWDKTLCPDDATCASNCALEGANYQSTYGATTSGDSLRLNFVTTSQQKNIGSRLYMMKDDTTYEMFKLLNQEFTFDVDVSNLPCGLNGALYFVAMDADGGMSKYPTNKAGAKYGTGYCDSQCPRDLKFINGQANVEGWQPSSNDANAGTGNHGSCCAEMDIWEANSISTAFTPHPCDTPGQVMCTGDACGGTYSSDRYGGTCDPDGCDFNSFRQGNKTFYGPGMTVDTKSKFTVVTQFITDDGTASGTLKEIKRFYVQNGKVIPNSESTWSGVGGNSITNDYCTAQKSLFKDQNVFAKHGGMEGMGAALAQGMVLVMSLWDDHAANMLWLDSNYPTTASSSTPGVARGTCDISSGVPADVEANHPDASVVYSNIKVGPIGSTFNSGGSNPGGGTTTTAKPTTTTTTAGSPGGTGVAQHYGQCGGNGWQGPTTCASPYTCQKLNDFYSQCL

SEQ ID NO: 24911 - protein, 864 aa, Neosartorya fischeri
  strain ATCC 1020 / DSM 3700 / FGSC A1164 / NRRL 181
MGSLDTVDMGQRAIDQIISELSLNEKVSLLSGVDAWHTFAIPRLGIPSIRTTDGPNGARGTRYFNGVPSACLPCGTALGATFDKDLIFSLGQLLAAECKAKGAHVLLGPTINIQRGPLGGRGFESFSEDPVLSGLAAASYCSGVQDGGVVPTLKHLVCNDQEHERVAVSALVTPRALREIYLLPFQLAIRGARPGAVMTSYNKVNGLHASESPGLIRDILRGEWGYEGAVISDWFGTYSVADAVNAGLDLEMPGPTRFRGPALMHALTSNKVSEKTLNERVRKVLELVQLASRSRVPEYAPERKLNRPEDRALLRRAAGESVVLLKNDKNDNNNSPILPLDREKKTLVIGPNADIAAYCGGGSASLLAYYTVTPRQGIADKCGADQVVFSQGCYGHKELPLLGEHLRTIETGEPGYTFRVYTEPPAASGSFKGNGSRKPVDELHMTNSSAFLMDYSHPQISGDTYYATLEGTLEPPESGVYEFGLTVAGTGLLYIDGVLVVDNKTVQRAGTSFFGIGTVEERGERYLEAGKKHHVFVEFGTAPTSNLQHHGVVSFGPGGLRLGGCRKLDTDAAIQQAVQSAAQTDQVVVCVGLSGDWESEGFDRPHMDLPPGTDELVNAVLEVQPNAVIVVQSGTPVTMPWADKAKALLQAWYGGNEAGNGIADVLFGDVNPSAKLPLTFPRELSQNPSYLSYRSERGRVLYSEDIYVGYRYYDKARQPPLFRFGHGLSYTTFHLSDLAVRETAPYAANIKESSLRVSVTVSNTGARPGAEVVLVYVRPPPATCSVGRPVRELKGYEKVMLQPGETREVSIAIPVGYATSFWDEGCDAWLSEKGLYFVEAVGTGECNTLVAPLSVQVSRMWNGL

SEQ ID NO: 24912 - protein, 221 aa, Neosartorya fischeri
  strain ATCC 1020 / DSM 3700 / FGSC A1164 / NRRL 181
MVSFSSLVLALSTVAGVLAAPGSEQYVELAKRQLTSSQTGTNNGYFYSFWTDGGGKVTYNNGNGGQYQVDWTNCGNFVAGKGWNPGSERTVTYSGSWESSGNGYLSVYGWMTNPLVEYYIVESYGSYDPSTGATHLGTVESDGGTYNIYKTTRTNAPSIQGTATFDQYWSVRTSHRVSGTVTTKNHFDAWKKAGLKLGNFDYMIVATEGYQSSGSATLTVS

SEQ ID NO: 24913 - protein, 393 aa, Neosartorya fischeri
  strain ATCC 1020 / DSM 3700 / FGSC A1164 / NRRL 181
MVHLSSFAAALAALPLVYGAGLNTAAKAKGLKYFGSATDNPELTDSAYVAQLSNTDDFGQITPGNSMKWDATEPSQNSFSFANGDAVVNLANKNGQLMRCHTLVWHSQLPNWVSSGSWTNATLLAAMKNHITNVVTHYKGKCYAWDVVNEALNEDGTFRNSVFYQIIGPAYIPIAFATAAAADPDVKLYYNDYNIEYSGAKATAAQNIVKMIKAYGAKIDGVGLQAHFIVGSTPSQSDLTTVLKGYTALGVEVAYTELDIRMQMPSTAAKLAQQSTDFQGVAAACVSTTGCVGVTIWDWTDKYSWVPSVFQGYGAPLPWDENYVKKPAYNGLMAGLGATGSGTTTTTTTTGGAEPTGVAQKWGQCGGIGWNGPTTCVSGSICQKVNDWYSQCL

SEQ ID NO: 24914 - protein, 420 aa, Neosartorya fischeri
  strain ATCC 1020 / DSM 3700 / FGSC A1164 / NRRL 181
MKLSAPLLVSLAAFSQAVTALVAFPGAEGFGADAIGGRKGQVYVVTNLNDSGTGSLRDAVSATDRIVVFAVGGVIKISERIVVSKRVTILGQTAPGDGITVYGNGWSFSNADDAIVRYIRIRMGKGGSSGKDAMGIAEGNRMIFDHVSVSWGRDETFSINGDASNITVQNSIIAQGLETHSCGGLIQTDGGVSLFRNLYIDNKTRNPKVKGVNEFTNNVVYNWGGGGGYIAGDSDGQSYANIIGNYFISGPSTSVTAFTRGNANFHGYVDNNYYDPDKDGQLDGSELGVSSSNYGGMAIVSSKYNYPAVAYTMSPAEAVTYVTKYAGASKVRDSVDTQLIAQVQSWGTKGALISDEATMGGPGTLNGGTPAKDTDGDGIPDEAEKQLGTDPNTNDSMKLHSSGYTYLEVWANSLVPSTYH

SEQ ID NO: 24915 - protein, 829 aa, Neosartorya fischeri
  strain ATCC 1020 / DSM 3700 / FGSC A1164 / NRRL 181
MTAKFDVDYVLANITEDDKIALLSGSDFWHTHAIPKFNVPPIRTTDGPNGIRGTKFFAGVPAACLPCGTALGATWDRDLLHQAGVLLGKECLAKGAHCWLGPTINMQRSPLGGRGFESFAEDPHLSGIMAKSIILGCESTGVISTVKHYVGNDQEHERRAVDVLVTPRALREIYLRPFQIVARDAHPGALMTSYNKINGKHVVENPAMLDIVRKDWNWDPLIMSDWLGTYTTIDSMNAGLDLEMPGPTRYRGKYIESAMQARLIKQSTINKRARKVLEFVQRASRAPVSADETGRDFPEDRALNRTLCANSIVLLKNDGNLLPIPKTVKKIALIGSHVKTPAISGGGSASLEPYYAVSLYDAVVEALPDAKILYEAGAYAHKMLPVIDRMLSNAVIHFYNEPPEKERTLLATEPVVNTAFQLMDYNAPGLNRGLFWATLIGEFTPDVSGLWDFGLTVFGTATLFVDDEMVIDNTTRQTRGTAFFGKGTVQEVGQKQLTAGQTYKIRIEFGSANTSPMKAIGVVHFGGGAAHLGACLHMDPEQMVANAVKVAAEADYTIVCTGLNRDWESEGFDRPDMDLPPGIDALISSVLDLAADRTVIVNQSGTPVTLPWADRARGVVQAWYGGNETGHGIADVLFGDVNPCGKLPLSWPVDVKHNPAYLNNMSVGGRMLYGEDVYMGYRFYEKVGREVLFPFGHGLSYTTFSVSPEATVSPSVFSSDSPPTARVLVKNTGPVAGAQILQLYIAAPNSATPRPVKELHGFTKVFLQPGEERTVAIHIDKYATSFWDEIEDMWKSEEGVYQVLIGTSSQEIVSRGEFRVEQTRYWRGV

SEQ ID NO: 24916 - protein, 476 aa, Neosartorya fumigata
MTLLFGIFLARLAVAAAQSSCVSAWGQCGGISYTGSTCCQSGNTCAEINSYYYQCIPATATSTTTVTSPSSSGSSSANTSGYTTTTVLPSPTATQNPYPPANASSCGSWALVDNVCCPYYCLSDNESESCTSSCTGGCGSPDSSMCKSGTMWGEQHTVTSNEDWHYSRSTHFGLTSGGACGFGLYGLCTKNSVTASWTDPMLGSTCDAFCTAYPLLCKDPANVTLRGNFAAPNGDYYTQFWPSLAASGNPDNYLSCGECFEVIRTKPDGTDYAVGESGYTDPIVLEVVDSCPCNANSKWCCGSGADHCGEIDFKYGCPLPEGSHHMDLSDIAMGRLQGNGSLADGVIPIRYRRVPCPKPGNIYIWLHDGAGPYYFALSAVNTNGPGSVISIEVQAGGSGPWVALEHDPNYTSSRPQERYGSWVLPQGKGPITVPVSMRLTAPNGQQVVKEGAITSYTPPATAVEGFWYIDLGVQFT

SEQ ID NO: 24917 - protein, 397 aa, Neosartorya fumigata
MKASTIICALLPLAVAAPNAKRASGFVWFGSNESGAEFGETKLPGVLGTDYIWPDASTIKTLHDAGMNIFRVAFRMERLIPNQMTGTPDATYLNDLKATVNAITSLGAYAVIDPHNYGRYYGNIISSTDDFAAFWKTLAAQFASNDHVIFDTNNEYHDMDQTLVLNLNQAAINAIRAAGATSQYIFVEGNSWSGAWTWTTVNDNLKALTDPQDKIVYEMHQYLDSDGSGTSATCVSSTIGQERVQAATQWLKTNGKKGIIGEFAGGANSVCQSAVTGMLDYLSANSDVWMGAAWWAAGPWWADYIFNMEPPSGTAYQNYLSLLKPYFVGGSGGNPPTTTTTTTQPTTTTTTTTAGNPGGTGLAQHWGQCGGIGWTGPTACASPYTCQKLNDYYSQCL

SEQ ID NO: 24918 - protein, 477 aa, Neosartorya fumigata
MRISSLIMAASAAGLVSALPVREMTKKRSSGFTWVGINESGAEFGSNIPGKLGTDYTWPDTSKIQTLRDAGMNIFRVPFLMERLVPSSITGNLDATYLSDLKKTVEFITGSGAYAVLDPHNYGRYSGSIISSTSDFQEFWKTVASEFASNDKVIFDTNNEYHDMDQTLVLNLNQAAINGIRAAGATTQYIFVEGNHYSGAWTWADNNDNLKGLKDPEDKIVFEMHQYLDSDGSGTSESCVSSTIGQERVESATQWLKDNSLKGFLGEFAGGVNSQCETAVEGLLSYMSENSDVWLGAEWWSAGPMWGNYMYSLEPSTGPAYSSYLPILKNYFVSGTSSSSSSSSSITSSTTSVNNPTTSATTQAQVVNTSSSSPTPSPTSVPAAEAPAPTPTEAAKTSSAASTTPTTAAASTTASACRAPEPADETTLPSATPTTSASASGIAKHWYQCGGINWTGPTTCESGYTCVEQNPYYHQCV

SEQ ID NO: 24919 - protein, 365 aa, Neosartorya fumigata
MKVTILASAILALINGALALPANTPTLDVTLTQVDNTRIKATVKNTGNEKVTFVHLNFFQDAAPVKKVSLFRNGTEVEFTGIKRRLLTEGLSDDGLTTLAPGGTFEDEFDVASTGDLTEGGTVTIRTDGFVPITTDRKVSGYIPYQSNELEIEVDPAKAAAVPQAIKLLDRRTKVASCSGSRASALSTALRNAGSLANAAASAASSGSSTRFQEYFKTTSRRPENVGGRFRAVGREASSQSSGKTTYYCNDPYGYCDSNTLAYTLPSSNLIANCDIYYSYLPALTSSCHAQDQATTTLHEFTHAPAVYSPGTDDYAYGYRASTALSASQALLNADTYALFANGSPLLPLSNHSKCRNTMVWRTLL

SEQ ID NO: 24920 - protein, 388 aa, Neosartorya fumigata
MKVLTAIALSAIAFTGAVAAVITQEAFLNNPRIHHDQEKYLIELAPYRTRWVTEEEKWALKLDGVNFIDITEEHNTGFYPTLHSASYVKYPPKMQYAEEVAALNKNLSKENMKANLERFTSFHTRYYKSQTGIRSATWLFDQVQRVVSESGAAEYGATVERFSHPWGQFSIIARIPGRTNKTVVLGAHQDSINLFLPSILAAPGADDDGSGTVTILEALRGLLQSDAIAKGNASNTVEFHWYSAEEGGMLGSQAIFSNYKRNRREIKAMLQQDMTGYVQGALNAGVEEAIGIMVDYVDQGLTQFLKDVVTAYCSVGYLETKCGYACSDHTSASKYGYPAAMATEAEMENTNKKIHTTDDKIKYLSFDHMLEHAKLSLGFAFELAFAPF

SEQ ID NO: 24921 - protein, 164 aa, Neosartorya fumigata
MLTSLPNHSASSMTWNTTLESSAYELASRLQRPPMNDCACLLTHFSDIGGGGYGQNIGYGVSADEIGVMITNLMYNDEFGYYDGLYGQANPDMTYFEKWGHFSQIVWKSSVSVGCATVVCNSLGNVDSSQPSPFTVCNYYPPGNFAGEYADNVLAPLGHAFYSA

SEQ ID NO: 24922 - protein, 272 aa, Neosartorya fumigata
  strain ATCC MYA-4609 / Af293 / CBS 101355 / FGSC A1100
MVPTIIYSAILALSAFTPSVFAQTRSSGCGKQPSLANGVHNINGREYILKVPDNYDKNKAHHLVFGLHWRGGNMWNIVDGQSIQPWYGLETRAQGSAIFVAPNGKNAGWANYGGEDIAFIDAIIKQVESDLCVDQSSRFATGFSWGGGMSYSLACSRAKQFKAVSVLSGGVISGCDGGNDPIAYLGIHGINDGVLPFQGGVNLAQKFVRNNGCQQSNVGTPQPGSRGSVRTDFKGCSKPVSFIAYDGGHDAAPLGVGSSLAPDATWRFFMAA

SEQ ID NO: 24923 - protein, 648 aa, Neosartorya fumigata
  strain ATCC MYA-4609 / Af293 / CBS 101355 / FGSC A1100
MEFIVSLLLLSPALVAGSLHSRIDNGLARTPQMGWNSYNYYSCSPNEAIIRSNAKALVDLGLAELGYRYVTTDCGWSVADRLPNGTLTWNETLFPSGFPAMGEYLHELGLLFGVYGDSGTKLCGSPPDQVGSLYHEEQDAKTFAEWGADSLKYDNCYSDAATNYPNVNYEPSTSPRPRYEIMSSALARVGRPILFQICEWGIDFPALWAPALGNSWRIGNDIIPAWRSIFRTLNQAVPNTDFAGPGQWADLDMLYVGNGVFSLPEEQTHFSLWAILKSPLTIGAALKDDDTSISQASLEVLKQKDVIGFNQDALGVSASLKRRWSDEGYEVWSGPLSGNRTVVAVINWRNESRDLTLDLPDVGLQYAQVARNIWGKTVVRDVRTSYTAGVAGHGTILLELQGTLPSGLYPAKIFAKSTGQRSTFESIYAATTSANYELAITFSRPSTETVTITTSSGQTVSISGKSGRIALTAGSNTITIQHKTPIESIQITPPTGTYYANTVFNVTGSAKHTTCGSGCSPVGSKIGYLSPTSNAYTSISTTTAGSKYLAIDYINNEVAFSSSWGWGSNSRNLTVSVNDGAPVRLEVPLSGRHSELYSPGKGWWDTATLGVLTSGWKKGENKVVFGNEGGEDGFQTYAADFVGVRVLD

SEQ ID NO: 24924 - protein, 465 aa, Neosartorya fumigata
  strain ATCC MYA-4609 / Af293 / CBS 101355 / FGSC A1100
MVTLTFLLSAAYLLSGRVSAAPSSAGSKSCDTVDLGYQCSPATSHLWGQYSPFFSLEDELSVSSKLPKDCRITLVQVLSRHGARYPTSSKSKKYKKLVTAIQANATDFKGKFAFLKTYNYTLGADDLTPFGEQQLVNSGIKFYQRYKALARSVVPFIRASGSDRVIASGEKFIEGFQQAKLADPGATNRAAPAISVIIPESETFNNTLDHGVCTKFEASQLGDEVAANFTALFAPDIRARAEKHLPGVTLTDEDVVSLMDMCSFDTVARTSDASQLSPFCQLFTHNEWKKYNYLQSLGKYYGYGAGNPLGPAQGIGFTNELIARLTRSPVQDHTSTNSTLVSNPATFPLNATMYVDFSHDNSMVSIFFALGLYNGTEPLSRTSVESAKELDGYSASWVVPFGARAYFETMQCKSEKEPLVRALINDRVVPLHGCDVDKLGRCKLNDFVKGLSWARSGGNWGECFS

SEQ ID NO: 24925 - protein, 398 aa, Neosartorya fumigata
  strain ATCC MYA-4609 / Af293 / CBS 101355 / FGSC A1100
MKSTSLLTASVLLGSASAAVHKLKLNKVPLDEQLYTHNIDAHVRALGQKYMGIRPNVHQELLEENSLNDMSRHDVLVDNFLNAQYFSEISLGTPPQKFKVVLDTGSSNLWVPGSDCSSIACFLHNKYDSSASSTYKANGTEFAIKYGSGELSGFVSQDTLQIGDLKVVKQDFAEATNEPGLAFAFGRFDGILGLGYDTISVNKIVPPFYNMLDQGLLDEPVFAFYLGDTNKEGDNSEASFGGVDKNHYTGELTKIPLRRKAYWEVDFDAIALGDNVAELENTGIILDTGTSLIALPSTLADLLNKEIGAKKGFTGQYSIECDKRDSLPDLTFTLAGHNFTIGPYDYTLEVQGSCISSFMGMDFPEPVGPLAILGDAFLRKWYSVYDLGNNAVGLAKAK

SEQ ID NO: 24926 - protein, 152 aa, Neosartorya fumigata
  strain ATCC MYA-4609 / Af293 / CBS 101355 / FGSC A1100
MKFTTPISLISLFVSSALAAPTPENEARDAIPVSVSYDPRYDNAGTSMNDVSCSNGVNGLVTKWPTFGSVPGFARIGGAPTIPGWNSPNCGKCYKLQYEQNTIYVTAIDAAPGGFNIATSAMDQLTNGMAVELGRVQATYEEADPSHCASGV

SEQ ID NO: 24927 - protein, 322 aa, Neosartorya fumigata
  strain ATCC MYA-4609 / Af293 / CBS 101355 / FGSC A1100
MQLKNSMLLLTALAAGSSVARLHGHERRHLHHAGEKREVGDTVYATINGVLVSWINEWSGEAKTSDAPVSQATPVSNAVAAAAAASTPEPSSSHSDSSSSSGVSADWTNTPAEGEYCTDGFGGRTEPSGSGIFYKGNVGKPWGSNIIEVSPENAKKYKHVAQFVGSDTDPWTVVFWNKIGPDGGLTGWYGNSALTLHLEAGETKYVAFDENSQGAWGAAKGDELPKDQFGGYSCTWGEFDFDSKINQGWSGWDVSAIQAENAHHEVQGMKICNHAGELCSIISHGLSKVIDAYTADLAGVDGIGGKVVPGPTRLVVNLDYKE

SEQ ID NO: 24928 - protein, 721 aa, Neosartorya fumigata
  strain ATCC MYA-4609 / Af293 / CBS 101355 / FGSC A1100
MGAFRWLSIAAAASTALALTPEQLITAPRRSEAIPDPSGKVAVFSTSQYSFETHKRTSWWSLLDLKTGQTKVLTNDSSVSEIVWLSDDSILYVNSTNADIPGGVELWVTQASSFAKGYKAASLPASFSGLKTAKTKSGDIRFVAYGQSYPNGTAYNEELATAPLSSARIYDSIYVRHWDYWLSTTFNAVFSGTLKKGHGKNGYSLDGELKNLVSPVKNAESPYPPFGGASDYDLSPDGKWVAFKSKAPELPKANFTTSYIYLVPHDASETARPINGPDSPGTPKGIKGDSSSPVFSPNGDKLAYFQMRDETYESDRRVLYVYSLGSKKTIPSVAGDWDRSPDSVKWTPDGKTLIVGSEDLGRTRLFSLPANAKDDYKPKNFTDGGSASAYYFLPDSSLLVTGSALWTNWNVYTAKPEKGVIKKIASANEIDPELKGLGPSDISEFYFQGNFTDIHAWVIYPENFDKSKKYPLIFFIHGGPQGNWADGWSTRWNPKAWADQGYVVVAPNPTGSTGFGQALTDAIQNNWGGAPYDDLVKCWEYVHENLDYVDTDHGVAAGASYGGFMINWIQGSPLGRKFKALVSHDGTFVADAKVSTEELWFMQREFNGTFWDARDNYRRWDPSAPERILQFATPMLVIHSDKDYRLPVAEGLSLFNVLQERGVPSRFLNFPDENHWVVNPENSLVWHQQALGWINKYSGVEKSNPNAVSLEDTVVPVVNYN

SEQ ID NO: 24929 - protein, 403 aa, Neosartorya fumigata
  strain ATCC MYA-4609 / Af293 / CBS 101355 / FGSC A1100
MLSIKRTLLLLGAVLPAVFGAPVQETRRAAQKIPGKYIVTFKPGTDTATIESHTLWATDLHKRNLERRDTTSGEPPVGIEKSYKIKDFAAYAGSFDDATIEEIRKSADVAHVEEDQIWYLDALTTQKGAPWGLGSISHKGQASTDYIYDTSAGAGTYAYVVDSGINVNHVEFESRASLAYNAAGGSHVDSIGHGTHVAGTIGGKTYGVAKKTNLLSVKVFQGESSSTSIILDGFNWAVNDIVSKGRTKKAAINMSLGGGYSYAFNNAVENAFDEGVLSVVAAGNENSDASNTSPASAPNALTVAAINKSNARASFSNYGSVVDIFAPGQDILSAWIGSTTATNTISGTSMATPHIVGLSVYLMGLENLSGPAAVTARIKELATNGVVTNVKGSPNKLAYNGNA

SEQ ID NO: 24930 - protein, 159 aa, Neosartorya fumigata
  strain ATCC MYA-4609 / Af293 / CBS 101355 / FGSC A1100
MKFSLSAAVLAFAVSVAALPQHDVNAAGNGVGNKGNANVRFPVPDDITVKQATEKCGDQAQLSCCNKATYAGDVTDIDEGILAGTLKNLIGGGSGTEGLGLFNQCSKLDLQIPVIGIPIQALVNQKCKQNIACCQNSPSDASGSLIGLGLPCIALGSIL

SEQ ID NO: 24931 - protein, 395 aa, Neosartorya fumigata
  strain ATCC MYA-4609 / Af293 / CBS 101355 / FGSC A1100
MVVFSKVTAVVVGLSTIVSAVPVVQPRKGFTINQVARPVTNKKTVNLPAVYANALTKYGGTVPDSVKAAASSGSAVTTPEQYDSEYLTPVKVGGTTLNLDFDTGSADLWVFSSELSASQSSGHAIYKPSANAQKLNGYTWKIQYGDGSSASGDVYKDTVTVGGVTAQSQAVEAASHISSQFVQDKDNDGLLGLAFSSINTVSPRPQTTFFDTVKSQLDSPLFAVTLKYHAPGTYDFGYIDNSKFQGELTYTDVDSSQGFWMFTADGYGVGNGAPNSNSISGIADTGTTLLLLDDSVVADYYRQVSGAKNSNQYGGYVFPCSTKLPSFTTVIGGYNAVVPGEYINYAPVTDGSSTCYGGIQSNSGLGFSIFGDIFLKSQYVVFDSQGPRLGFAPQA

SEQ ID NO: 24932 - protein, 634 aa, Neosartorya fumigata
  strain ATCC MYA-4609 / Af293 / CBS 101355 / FGSC A1100
MRGLLLAGALALPASVFAHPAHQSYGLNRRTVDLNAFRLKSLAKYVNATETVIEAPSSFAPFKPQSYVEVATQHVKMIAPDATFRVVDDHYVGDNGVAHVHFRQTANGLDIDNADFNVNVGKDGKVFSYGNSFYTGQIPSSAALTKRDFSDPVTALKGTTNTLQLPITVDSASSESTEEKESYVFKGVSGTVSDPKAKLVYFVKDDGTLALAWRVETDIDSNWLLTYIDAKSGEEIHGVVDYVAEADYQVYAWGINDPTEGERTVIKDPWDSVASEFTWISDGSTNYTTSRGNNGIAQSNPSGGSSYLNNYRPSSSSLSFKYPYSVSSSPPSSYIDASIIQLFYTANIYHDLLYTLGFTEKAGNFEYNTNGQGGLGNDYVILNAQDGSGTNNANFATPPDGQPGRMRMYVWTESTPYRDGSFEAGIVIHEYTHGLSNRLTGGPANSNCLNALESGGMGEGWSDFMATAIRLKPGDKRSTDYTMGEWASNRAGGIRQYPYSTSLSTNPLTYTSVNSLNAVHAIGTVWASMLYEVLWNLIDKHGKNDAPKPTLRDGVPTDGKYLAMKLVMDGMALQPCNPNFVQARDAILDADTALTGGENQCEIWTAFAKRGLGAGAKYSSRNRVGSTEVPSGVC

SEQ ID NO: 24933 - protein, 176 aa, Neosartorya fumigata; identical to SEQ ID NO: 4898
  strain ATCC MYA-4609 / Af293 / CBS 101355 / FGSC A1100

SEQ ID NO: 24934 - protein, 310 aa, Neosartorya fumigata
  strain ATCC MYA-4609 / Af293 / CBS 101355 / FGSC A1100
MAALLRLAVLLPLAAPLVATLPTSPVPIAARATPHEPVFFSWDAGAVTSFPIHSSCNATQRRQIEAGLNEAVELARHAKAHILRWGNESEIYRKYFGNRPTMEAVGAYDVIVNGDKANVLFRCDNPDGNCALEGWGGHWRGANATSETVICDRSYTTRRWLVSMCSQGYTVAGSETNTFWASDLMHRLYHVPAVGQGWVDHFADGYDEVIALAKSNGTESTHDSEALQYFALEAYAFDIAAPGVGCAGESHGPDQGHDTGSASAPASTSTSSSSSGSGSGATTTPTDSPSATIDVPSNCHTHEGGQLHCT

SEQ ID NO: 24935 - protein, 325 aa, Neosartorya fumigata
  strain ATCC MYA-4609 / Af293 / CBS 101355 / FGSC A1100
MVVLSKLVSSILFVSLVSAGVIEERQAASINQAFTSHGKKYFGTASDQALLQKSQNEAIVRKDFGQLTPENSMKWDATEPSQGRFNFAGADFLVNYAKQNGKKVRGHTLVWHSQLPSWVSAISDKNTLTSVLKNHITTVMTRYKGQIYAWDVVNEIFNEDGSLRDSVFSRVLGEDFVRIAFETARSVDPSAKLYINDYNLDSASYGKTQGMVRYVKKWLAAGIPIDGIGTQTHLGAGASSSVKGALTALASSGVSEVAITELDIAGASSQDYVNVVKACLDVPKCVGITVWGVSDRDSWRSGSSPLLFDSNYQPKAAYNAIIAAL

SEQ ID NO: 24936 - protein, 528 aa, Neosartorya fumigata
  strain ATCC MYA-4609 / Af293 / CBS 101355 / FGSC A1100
MMWWFLLIGLASAAATASSASSASFESRCQHFHKEIHLQNVHVLSTTYVPIGSNIPMVYNPPICGGTASSSISTIQFCQVALNVTTSDKSQFFMEAWLPSNYTGRFLSTGNGGLNGCVSYADMVYATQYGFATIGTNNGHFGDTGQYFLNNPEVIEDFAYRALHTGTVVGKALTKLFYPQGYKNSYYLGCSTGGRQGWKSIQRFPDDFDGVVAGAPAINFVNLCSWGSRFLKITGPPGSETFVTSAQWSAVHNEILRQCDALDGAVDGIIEDTDLCQPVFETLLCNSTAVDKTSCLTGVQANTVNEVFSAMYGLDGKWLYPRMQPGSELAASFIYYSGNGFKYSDDWYKYVVYNDSNWGHSTWTLADAAAAAAQDPFQISSFDGNISGFQKAGGKVLHYHGLEDAIITSDSSKAYYKHVADTMGLSPSELDHFYRLFPISGMGHCSPGTGAASIGQGSSTYAGDDPQDNVLMAIVQWVEKGIAPEYVRGSKMSRDGTIDYRRKHCKYPKRNRYVGPGKYTDENAWKCV

SEQ ID NO: 24937 - protein, 321 aa, Neosartorya fumigata
  strain ATCC MYA-4609 / Af293 / CBS 101355 / FGSC A1100
MYLYTLILLFLASANVNAYANPGACSGNCWTHDPGLYQRKSDGKYFRFATGGGIHIASADSLEGPWTDDGYVLPSGSIIDLDGKTNLWAPDLHYHDGTYYLYYAVSSLGSQNSATGVATSKTMEAGSWTDHGTTGIESTPSSPYNTIDANWIAVGGTQYVNFGSYWNNLFQVEMENGLKVKSGATPHQIAYNASGIHRQEAAFMFERNNYFYLTFSGGIALGYNDTWPAPGEEYFIAVCRSTSATGGFVDKNGVSCLNSGGSLLLSSHDFVYGPGGQGILQDSSKGFVLYYHYADTRIGKAVEDYQFGWNQLKWENDWPSV

SEQ ID NO: 24938 - protein, 466 aa, Neosartorya fumigata
  strain ATCC MYA-4609 / Af293 / CBS 101355 / FGSC A1100
MPQRIQLDILASICEHHTCTFSSLYPLGSGSGPAHRPFDCNILSYGAVADNTTDISTSLESAFNWCVRPNPSSRLVVPEGQYLISRGVVLSNATNWAFQLDGLITVAYGGNWTIDRALILEGLAGTDVLNTTINGEGDQKFLLDVLVIVNAVDFEFYSSNGLGAFQGQGYLYRNLNNTDRPRLVRLISPINASVHDLILVDSPKFHIVLDFAINVEAYHLTIRGANLGSYDGIDVIGTNYHIHDNEVTNRDECVSVKSPSHHALIENLVCNQAGSGISIGSLNVSAEISNILAQNISIIQGNNIAFIKTYPGGSGYVTNVTFSNFRSKASLYGLNINQYWQNTFEPDTGSVTLSNLVFRNFSGSVANGVQRPPLYLIVNDLTYATNVTVEDFTVWTESGSSIVNKISNVFGHGDDSYGPNNGLVSLGAAEQPHTYTSTNIITASPTGWVPPKSPTWAAPSTGYGSK

SEQ ID NO: 24939 - protein, 388 aa, Neosartorya fumigata; identical to SEQ ID NO: 24920
  strain ATCC MYA-4609 / Af293 / CBS 101355 / FGSC A1100

SEQ ID NO: 24940 - protein, 528 aa, Neosartorya fumigata
  strain ATCC MYA-4609 / Af293 / CBS 101355 / FGSC A1100
MLSKATLLLFLPSWARVTYAAFGITTTSSSYVIDANSPNPLKFTVNRSNCDITSINFYGAELQYQGTGSHIGSGLGSASVSATQSGDYIKVTCSTSTLTHYFVVHNGDPIIHMATYITAEPSIGELRFIARLNNELLPNEEPFGEVSNTSGGTAIEGSDVFLVNGQTRSKFYSSERFIDDHRHCVSGSAHRVCMILNQYESSSGGPFHRDINTNNGGQYNALYWYMNSGHVQTEANRMGLHGPYSMYFSRSGTPGTNIDTSFFANLDIQGYVPDSARGKVSGKASGADSTFKWVVHWYNDEAQYWTYTASDGSFTSPAMKPGTYTMVYYQGEYKVASTSVSVSAGSTTTKNISGSVTTGKTIFKIGEWDGQPTGFRNAANQLRMHPSDSRMSSWGPLTYTVGSSSLSDFPMAIFKSVNSPVTIKFTASSSQTGAATLRIGTTLSFAGGRPQVTVNSWTGPIPSAPKDLNSRGVTRGAYRGLGEVYDVAIPAGTIVAGTNTITISVVSGSSGDAFLSPNFIFDCVELFQ

SEQ ID NO: 24941 - protein, 454 aa, Neosartorya fumigata
  strain ATCC MYA-4609 / Af293 / CBS 101355 / FGSC A1100
MRGVWRYMPVYYYKCMLIPLLTFTKISIISKPQESRISLIICRTMPTVATFLGLAISGAAMASGAALGAYNVDPNSISVSGLSSGGFMSAQLGVAYSDTFKVGFGVFAGGPYDCARGQSYTTCMYNQNPSITTPVANMKSWSGNKINPVSNLQSRKIYMWTGTADTTVGPNVMSQLKTQLANFASAANVSYITTSGAAHTFPTDFDAAGDNSCSSSVSPYISNCQCDGAGAVLQWMYGPLNARNPGTLSGSIVSFSQTGEYGASGMDTTGYLYVPRACQPGSSTVCKLHVALHGCKQSYSMIGSKFVSNTGYNMWADTNDIIILYPQAVADNTMHTIWTGMPLPNPNGCWDWVGWYGANADQVGGVQMAAIVNQVARVVSGYGAGSSSSTTAATPTTTTGSITTTTTTTATVTTTAVAPLYGQCGGIGWTGPTACATGVCTAYSPYYAQCLLIV

SEQ ID NO: 24942 - protein, 217 aa, Neosartorya fumigata
  strain ATCC MYA-4609 / Af293 / CBS 101355 / FGSC A1100
MSLRSLFVAGLATLALAVPAPQIQARQGMSSNELESGPCRDVTFIFARGSTEQGNMGLIVGPGVCSSLKKDLGSDKVACQGVGGAYTAQLAPNFLSQNTNQASINAATDMFDLANTKCPNTKIVAGGYSQGSAVIDNTIQALGSDLKAKVKGVVLFGFTRNVADKGQIPGYPKDQTKIYCAVGDMVCVNTLIITPAHLTYGADAGDAAKFLASKVQE

SEQ ID NO: 24943 - protein, 450 aa, Neosartorya fumigata
  strain ATCC MYA-4609 / Af293 / CBS 101355 / FGSC A1100
MKITALASAILAVAQGALALPARAPALDITLSQVNNTRIKAVVKNSGTEKITFVHLNFFNDPSPVKKVSLYRNATEVEFTGIKQRLRSDGLSNDALTTLAPGATYEDEFDIASTANLTQGGPVTVRTQGFVPIAMNNKIAGYIPYSSNELELEVDAEKAVAVPASIKPLDRRTKITSSCTGNRATVLNTALRNAASIASKAADAASSGSSALFTEYFKSTSGNIRSAVAARLKAVASEASMNGGGSTTYYCSDPYGYCDSNVLAYTLPSTNEVVNCELFYTLQEVTNDCHGQDQATTIIHEFTHAPGVYPPGTEDLGYGYSAATALSTSNALNNADSYALFANAVYLNCQGQTGGQTTWDGYSQPGQTEPGTQTMWDGYSQPGQTEPGTQTMWDGYSQPGQTEPGTQTTWDGYSQPGQIEPCTQTMWDGGSEPGQTEPDAQTMWDNFYQA

SEQ ID NO: 24944 - protein, 767 aa, Neosartorya fumigata
  strain ATCC MYA-4609 / Af293 / CBS 101355 / FGSC A1100
MGEICPRREDFDIDYILKNASLLEKVSLLAGYDFWHTAPLPRFNVPSVRVSDGPNGVRGTKFFDGVRAACLPCGTGLAATWDQSLLYDAGVLIGQECLAKGAHCWLVPTVCIQRSPLGGRGFESFAEDPYATGKLAAAYIRGAQSTGVISTIKHFAANDQEHERISVNAVMSERALREVHLLPFQIAIADSAPGAVMTCYNKVNGQHLSESKEMLDGLLRREWGWKGLIMSDWFGTYSTAEALNAGLGLEMPGTTRLRGPLLELAISSRKVSRATLDERARTVLEFVQRARKAEVSAVESTRDFPEDRRLNRKLAADSIVLLKNESGLLPLNPQTLTSVALIGPNMKTAAFCGGGSASLQPYYSTSPYQGITSQLPPGVEVLYETGATSYAFIPELEASEVRTPEGQPGLRMRFYRDPPSVQERRVLMGFSNPELDRLFYADIEAELIAPATGPFQFGLAVYGSASLFLNDQLIIDNTTVQRGGTFFFGKGTLEETATVDLVQGQSYQIKVQFASGPSSKLVKPGVVNFGGGAGRLGMVQVVDPERAIARAVEAAKRADITILGVGLTRDHESEGFDRSHMDLPPAVASLVTAVLDVAPDAILLTQSGTPFSMLPWADLVKTHLHAWFGGNELGNGIADVLFGVVNPSGKLPLSFPRRIEDTPTYLNFGSERGQVTYGEGIYVGYKLLRKSPTSCALSIRARFVVHLLCVLRFDGRHRVRYTECSKLGRRGRSGSSPAVYRGRSNNVVNRTSHQGAQRISKGGFAAR

SEQ ID NO: 24945 - protein, 88 aa, Neosartorya fumigata
  strain ATCC MYA-4609 / Af293 / CBS 101355 / FGSC A1100
MHFIYQALSALAASLLFSSATAGIAHCKVGEAWPDSSDCHNFYECASEGAPVLKTCGPGTAYCPTTGVCVHEENVPSCFHRGHHSEDE

SEQ ID NO: 24946 - protein, 845 aa, Neosartorya fumigata
  strain ATCC MYA-4609 / Af293 / CBS 101355 / FGSC A1100
MSKLQQFPLSKGWSFRDNEATSEDAWMPVPVVPSVVHQDLQANNKLKDPYIGFNELEARWVNEKSWTYKTVFQKPAAPAGSCIVLAFDGLDTFAKVKLDGNVILENDNMFLARRVDVTKALEAEGDHVLEIDFDCAFLRAKELRKQDPRHNWASFNGDPSRLSVRKAQYHWGWDWGPVLMTAGIWREVRLEVYSARVADLWTEVQLASDHQSAQVTAFVEVESVHSGSHRACFTLSLHGQEITREEIGVTENGTAKATFDVKEPSLWWPHGYGDATLYEVSVSLVKEQEELHRVSKKFGIRTAEVIQRPDKHGKSFFFRVNGVDIFCGGSCWIPADNLLPSITAERYRKWIELMVHGRQVMIRVWGGGIYEDNSFYDACDELGVLVWQDFMFGCGNYPTWPNLLESIRKESVYNVRRLRHHPSIVIWVGNNEDYQVQEQAGLTYNYEDKDPENWLKTDFPARYIYEKLLPEVVQEYSPGTFYHPGSPWGDGKTTSDPTVGDMHQWNVWHGTQEKYQIFDTLGGRFNSEFGMEAFPHMSTIDYFVENEADKYPQSHVLDFHNKADGHERRIATYLVENLRTATDLETHIYLTQVVQAETMMFGYRGWRRQWGDERHCGGALLWQLNDCWPTISWAIVDYFLRPKPAFYAVARVLNPIAVGVRREHHDWSVTHAQPPKTSKFELWVASSRQQEIQGTVELRFLSVNTGLEVRERIVHENVSIVPNGTTNLIVDGLIDHTVHSEPHVLAARIWVDGQLVARDVDWPQPFKYLDLSDRGLEVKKISESEDEQTLLISTKKPVKCLVFEEREGVRISDSAMDIVPGDDQRVTIKGLKPGDAPLKYKFLGQ

SEQ ID NO: 24947 - protein, 407 aa, Neosartorya fumigata
  strain ATCC MYA-4609 / Af293 / CBS 101355 / FGSC A1100
MAQTLAAASLVLVPLVTAQQIGSIAENHPELKTYRCGSQAGCVAQSTSVVLDINAHWIHQMGAQTSCTTSSGLDPSLCPDKVTCSQNCVVEGITDYSSFGVQNSGDAITLRQYQVQNGQIKTLRPRVYLLAEDGINYSKLQLLNQEFTFDVDASKLPCGMNGALYLSEMDASGGRSALNPAGATYGTGYCDAQCFNPGPWINGEANTLGAGACCQEMDLWEANSRSTIFSPHPCTTAGLYACTGAECYSICDGYGCTYNPYELGAKDYYGYGLTVDTAKPITVVTQFVTADNTATGTLAEIRRLYVQEGMVIGNSAVAMTEAFCSSSRTFEALGGLQRMGEALGRGMVPVFSIWDDPSLWMHWLDSDGAGPCGSTEGDPAFIQANYPNTAVTFSKVRWGDIDSTYSV

SEQ ID NO: 24948 - protein, 364 aa, Neosartorya fumigata
  strain ATCC MYA-4609 / Af293 / CBS 101355 / FGSC A1100
MHFFQSSLVAATMGAALVAAAPAADLETRGSCTFTSTSALKSGKASCSTITLQNIAVPAGETLDLTGLKTGTTVVFDGTTTFGYKEWEGPLISASGTSITIKQNPGAKIDCDGARWWDGKGGNGGKKKPKFFSAHKLNKSNITGLKVYNTPVHGFSIQSDHLTIKDVLLDNSAGTKLGHNTDAFDVGSSTYITIDGATVYNQDDCLAVNSGEHITFTNGYCNGGHGLSIGSVGGRSNNVVNDVTISNSQVINSQNGARIKTVYGATGSVTGVKFQDISLKGITKYGIVVQQDYENGKPTGKPTNGVKVSDITFEKVTGTVTSSATDIYILCGSGSCTNWTWSGNSVTGGKKSSSCKNVPAGASC

SEQ ID NO: 24949 - protein, 453 aa, Neosartorya fumigata
  strain ATCC MYA-4609 / Af293 / CBS 101355 / FGSC A1100
MKFFALAALFASTVNSIAVDGLIPGARVIPANDVVALKKAGAYHQKHHHRRTVIIRSSSSDEDDVSADFLWGIKRANHGGRLLLQNGKKYVIGKKLDLTFLKDIEVQLDGELKFTNDVPYWQANNFYYDFQKSISFWRWGGEDIKIFGSGVLNGNGQRWYNEFAGQEILDPNNKYYRPILFVTENATRVSVEGITQLNSPCWTNFFVRTKDISFDNVFIHAYSTNASALPKNTDGFDTLNVDGLTVTNTRVDIGDDCLSPKPNTTNVFVKNLWCNGTHGASMGSIGQYPGVLDIIENVWIENVTLLNGENGARLKAWAGPDVGYGRINNVTYKNIHVENTDNPIVLDQCYFNINATQCAAYPSRVNFTNIVFEDIYGTSSGKRGKVVADLTCSPNAVCSGIRLKNIHLTSPAGSPPVIVCDGIQGDIGVECQSSSNSTTRRSVDLARSLKYRA

SEQ ID NO: 24950 - protein, 438 aa, Neosartorya fumigata
  strain ATCC MYA-4609 / Af293 / CBS 101355 / FGSC A1100
MHPLPSVALLSAIGAVAAQVGPWGQCGGRSYTGETSCVSGWSCVLFNEWYSQCQPATTTSTSSVSATAAPSSTSSSKESVPSATTSKKPVPTGSSSFVKADGLKFNIDGETKYFAGTNAYWLPFLTNDADVDSVMDNLQKAGLKILRTWGFNDVNSKPSSGTVYFQLHDPSTGTTTINTGADGLQRLDYVVSAAEKRGIKLLIPLVNNWDDYGGMNAYVKAYGGSKTEWYTNSKIQSVYQAYIKAVVSRYRDSPAIMAWELSNEARCQGCSTDVIYNWTAKTSAYIKSLDPNHMVATGDEGMGVTVDSDGSYPYSTYEGSDFAKNLAAPDIDFGVFHLYTEDWGIKDNSWGNGWVTSHAKVCKAAGKPCLFEEYGLKDDHCSASLTWQKTSVSSGMAADLFWQYGQTLSTGPSPNDHFTIYYGTSDWQCGVADHLSTL

SEQ ID NO: 24951 - protein, 406 aa, Neosartorya fumigata
  strain ATCC MYA-4609 / Af293 / CBS 101355 / FGSC A1100
MLYPRNLALFSLLSLSSAAPSQVERSPDAVLKPRAVCTPTAGGSPSIDDVPAIRKAIASCGNGGTIVFPAGSTYYLNSVLDLAGCSNCDIQVEGVLKFSGSTEYWGGKTAMLNIDMINGLRLRSLTGSGVIDGNGQNAYDRFASDKNYKRPTLLYITGGSNIEVSGLRQKNPPNVFNSVKGDTQHVTFKNLRMDATSNSQNPPKNTDGFDIGASTHVTISSVSVTNDDDCVAFKPGSNYVTVEDVTCTGSHGISVGSLGKSGPDVVQNILAHRITMIESTKAAGIKTYPSGNGHGLSTVKNVTFSDFNVRGCDYAFQIESCYGESESYCESNPGNAILQGIVVKGFSGTTSGKYDPVVANLNCGARGTCDVSMSAFSVKAPSGKATVLCDNTPSSLGVSCTSGASG

SEQ ID NO: 24952 - protein, 324 aa, Neosartorya fumigata
  strain ATCC MYA-4609 / Af293 / CBS 101355 / FGSC A1100
MYLPSLVLGLLGFGLTASTSPIEERSNRSKAPAGCLTVGSSGTYATIGAALSALGSSTSDACIFIGAGTYQEQITIDYKGKLTMYGETTDTSSYKQNLVTITHSISSPEAGSLDKSATVNVRSDGFKMYNINVINGYGKGAQAVTLVANADKLGFYGCSFVGYQDTLYAKAGRQYYSNCYIEGAVDYIFGDASAWFGECDLVSVGPGYITAMSRTTADETTWYAIDHCNIYGKPGVDLTSAVYLGRPWRVLARVIFQNSQLSNIINPKGWSPMATGATPLYYEYNNKGAGADTSKREYESPISGAVSIATVLGGGWNSWVDTTY

SEQ ID NO: 24953 - protein, 349 aa, Neosartorya fumigata
  strain ATCC MYA-4609 / Af293 / CBS 101355 / FGSC A1100
MKSTFGLLALAAAAKLVSAHATVHAVWINDVDQGAGNSADGYIRSPPNNSPITDVTSTDMTCNVNGKNPVAKTLSVKAGDKVTFEWHHDTRSDSDDIIASSHMGPVMVYMAPTEKGTAGNGWVKIAEEGYSNGKWAVANLIANRGKHSITVPDVPAGEYLLRPEIIALHEGNRQGGAQFYMECVQVKVTSAGTKTLPAGVSIPGAYKATDPGVLFDMYNSFTSYPIPGPAVWDGSSSGSSGSSGSSPATTTAPAVSVTAAPTKEAPVDTSATPTTFVTATKPATTAAPAAPSASSGSNSGSDSCNSGSASGSVKIYGQCGGQNYSGPTSCEAGLICKEWNPYYHQCVSA

SEQ ID NO: 24954 - protein, 371 aa, Neosartorya fumigata
  strain ATCC MYA-4609 / Af293 / CBS 101355 / FGSC A1100
MRALSVFVALFSFLALSSASPGQDVAKRVTSGSLQQVTNFGSNPSGTLMYIYVPNNLATKPGIVVAIHYCTGTAQAYYTGSPYAQLAEKYGFIVIYPQSPYSGTCWDVSSQSALTHNGGGDSNSIANMVTWTISQYNADTSKVFVTGSSSGAMMTNVMAATYPELFAAATVYSGVPAGCFYSSSNQVNGWNSSCAQGNVISTPEVWGGIAKAMYPGYTGPRPRMQIYHGSVDTTLYPQNYYETCKQWAGVFGYNYNSPQSTQSNTPQANYQTTIWGPNLQGIFATGVGHTVPIHGEQDMEWFGFTGGSSSTTTTATTPPTTSTTTSSGGSSTSTGVAEHWGQCGGNGWTGPTACASGYTCTVINEWYSQCL

SEQ ID NO: 24955 - protein, 254 aa, Neosartorya fumigata
  strain ATCC MYA-4609 / Af293 / CBS 101355 / FGSC A1100
MYQPLLLLPLLLTSAFATPHDPTTHQALEKRASFPIPSSKGSVTYSSPKTISGTFDGGLKTYGRGVKCTGQKEGGEKDAVFVLEDGATLKNAIIGADQIEGVYCKGSCTIQNVWWTDVCEDALSLKGTGSGTHRIIGGGARNADDKVIQHNSGGKVIIQDFTVQNFGKLYRACGNCSKQFKRTVEISGVKASSGKALVGINSNYGDTATISGCASSVKEICVEYEGTDNNKKEPAKKSSGPSNACKYKEPLASC

SEQ ID NO: 24956 - protein, 565 aa, Neosartorya fumigata
  strain ATCC MYA-4609 / Af293 / CBS 101355 / FGSC A1100
MRGAILATAAALAGTAMADVAHMRRHGHDSFHQRRSPLAEADATCGCTTEVVTVWGPPTLIPVASPTPSTVTSEAVTTLHSTSTTTVTVIASASTPAASPSPATDKVPLPTPAITNFPSTGVYTIPATTVTVFDTTTVCGATTTELPAGTHTYGGVTTVVETATTVVCPYATVEPSGTTVTSVIKTTTYVCPSAGTYTIAPTTTTVPTSTVIVYPTPAVITPGTYTQPEQTVTVTRTDYTYVCPFTGQDEPTSAPAAPSTTAVPATTTAAPETTTAAPDTTTAVPSTSSAAPSSSSTAPASTGAVSGQMGMTYTPYTKGGDCKDKSSVLSEVAALKSKGFTHVRVYSTDCNSLEYIGEAARTSGLQMIIGVFISSTGVSGAQDQVTAISKWAQWDLVSLIVVGNEAIQNGYCDASTLAGFISSAKSAFQAAGYTGKVTTTEPINVWQAHGSTLCGVCDIVGANIHPFFNADVSADQAGKFVAQEIKVLESICPGKDVLNLETGWPHAGNANGKAVPGTSEQAIAIKSIADEVGSKSVFFSYFDDLWKEPGQFGVERYWGCFDTFN

SEQ ID NO: 24957 - protein, 460 aa, Neosartorya fumigata
  strain ATCC MYA-4609 / Af293 / CBS 101355 / FGSC A1100
MDSKRGVVAAVLALLPLVSAQQPAASSAGNPKLTTYKCTTAGGCVAQDTSVVLDWGYHWIHTVDGYTSCTTSSGVDSTLCPDAATCAKNCVIEPANYTSAGVTTSGDSLTMYQYVQSNGVYTNASPRLYLLGPDKNYVMLKLLGQELTFDVDLSTLPCGENGALYLSEMSATGGRNEYNTGGAEYGSGYCDAQCPVIAWKNGTLNTSGASYCCNEMDILEANSRANSYTPHPCSATDCDKGGCGFNPYALGQKSYWGPGGTVDTSKPFTITTQFITNDGTTTGTLSEIRRQYMQNGKVIANAVSSTGVNSITEDWCTSVDGSAATFGGLTTMGKALGRGMVLIFSIWNDASGFMNWLDSGNAGPCSSTEGNPDLIKAQNPTTHVVFSNIRWGDIGSTFKGSDGSVTTTTSTTSTKTTTSTAPGPTQTHYGQCGGQGWTGPTACASPYTCQVLNPWYSQCL

SEQ ID NO: 24958 - protein, 432 aa, Neosartorya fumigata
  strain ATCC MYA-4609 / Af293 / CBS 101355 / FGSC A1100
MKFSYSFVQVVTLLLSLSPSVEGFTRSRNDACKPNHPFRPLPPSQPRTKTCHVVSNGHGKDDSKNIMKALHKCNNGGKVVFDANKVYTVGTALDMTFLKHIDLEVLGKIQFTNDTDYWQANSFKHGFQNATTFFQLGGEDVNVYGGGTLDGNGQVWYDLYAEDALILRPILFGVIGLKGGTIGPLKLRYSPQWYQLVANSSDVIFDGIDISGYSSSKNEAKNTDGWDTYRSDNIVIQNSVINNGDDCVSFKPNSTNILVQNLHCNGSHGISVGSLGQYKGEVDIVQNVLVYNISMYNASDGARIKVWPGVSSAMSEDLQGGGGLGSVKNVTYNQMYIENVDWAIEVTQCYGQKNLTLCNEYPSNLTISDIHFKNFRGTTSGKRDPNVGTIVCSSPNVCSDIYAENIDVKSPKGTDNFVCTNVDKSLLDVNCA

SEQ ID NO: 24959 - protein, 500 aa, Neosartorya fumigata
  strain ATCC MYA-4609 / Af293 / CBS 101355 / FGSC A1100
MTLLFGIFLARLAVAAAQSSCVSAWGQCGGISYTGSTCCQSGNTCAEINSYYYQCIPATAVSTSTTTVTSPSSSGSSSANTSGYTTTTVLPSPTATQNPYPPANASSCGSWALVDNVCCPYYCLSDNESESCTSSCTGGCGSPDSSMCKSGTMWGEQHTVTSNEDWHYSRSTHFGLTSGGACGFGLYGLCTKNSVTASWTDPMLGSTCDAFCTAYPLLCKDPANVTLRGNFAAPNGDYYTQFWPSLAASGNPDNYLSCGECFEVIRTKPDGTDYAVGESGYTDPIVLEVVDSCPCNANSKWCCKRPPPPPFFSPPSNGQNLTRPGGSGADHCGEIDFKYGCPLPEGSHHMDLSDIAMGRLQGNGSLADGVIPIRYRRVPCPKPGNIYIWLHDGAGPYYFALSAVNTNGPGSVISIEVQAGGSGPWVALEHDPNYTSSRPQERYGSWVLPQGKGPITVPVSMRLTAPNGQQVVKEGAITSYTPPATAVEGFWYIDLGVQFT

SEQ ID NO: 24960 - protein, 447 aa, Neosartorya fumigata
  strain ATCC MYA-4609 / Af293 / CBS 101355 / FGSC A1100
MTTFFSLTTAAAVLTLARGSNALVRPGNVGKLPALGWNTWNAFGCDIDATKIMTAANEVVNLGLKDLGYEYINIDDCWSVKSGRDASTQRIIPDPDKFPDGISGVADQIHDLGLKIGIYSSAGLTTCAGYPASLGYEDIDAQTFAEWGIDYLKYDNCGVPSNWTDTYTYCVPDPGSKATNGTCPDNKNPAPAGYDWRTSLTAERYRRMRDALVSVDRTILYSLCEWGQANVNDWGNETGNSWRTTGDITPSWPRIAAIANENSFLMNHVDFWGYPDPDMLEVGNGNLTLAENRAHFALWAAMKSPLIIGTALDSISQDHLAILSNKILLKFHQDPVIGRPAQPYKWGYNPDWTFDPAHPAEYWSGASSVLGGTLVLMLNSEDTTQRRTAVWKEVPELKDVLGRQGKRRIGFRVTDVWTGKDLGCVRDHYSVELESHDVAALVVGRAC

SEQ ID NO: 24961 - protein, 342 aa, Neosartorya fumigata
  strain ATCC MYA-4609 / Af293 / CBS 101355 / FGSC A1100
MRHVQSTQLLAALLLTTRVTAHGHVTNIVINGVSYRGWNIDSDPYNPDPPVVVAWQTPNTANGFISPDAYGTNDIICHLNATNARGHAVVAAGDKISIQWTAWPDSHHGPVIDYLARCGSSCETVDKTTLEFFKIDGVGLVDGSNPPGVWGDDQLIADNNSWLVEIPPTIAPGYYVLRHELIALHGAGSQNGAQNYPQCFNLQITGSGTAQPSGVKGTELYSPTDPGILVNIYNALSTYIVPGPTLIPGAVSVVQSSSTITASGTPVTGSGSAPTTSATTTLSTTTRATTTTTTTTAGSSTSVQSVYGQCGGSGWSGPTACVTGATCTSYNSYYSQCIPTAS

SEQ ID NO: 24962 - protein, 771 aa, Neosartorya fumigata
  strain ATCC MYA-4609 / Af293 / CBS 101355 / FGSC A1100
MAHITSWHYGNAIALLVSLAPGALSLNTFPDCSSGPLSKLAVCDTSLDVTTRAQSLVNAMTFEEKVNNTQYNSPGVPRLGLPAYNWWSEALHGVAGSPGVEFADSGPFSYATSFPQPILLGATFDDDLIKQVATVVSTEGRAFGNAGRSGLDFWTPNINPFRDARWGRGQETPGEDPLHVSRYVYHLVDGLQNGIGPANPKVVATCKHFAAYDLEDWNGVVRHSFNAEVSTQDLSEFYLPPFKSCARDARVDAVMCSYNALNGVPACADSYLLQTILREHWKWDEPGRWITSDCGAIDDIYNGHNFTTTPAEAAATALNAGTDLDCGTVFPKYLGQAADEGLYSNQTLDRALVRLYSSLVKLGYFDPAEDQPYRSIGWTDVDTPAAEALAHKAAGEGIVLLKNDKTLPLKAKGTLALIGPYANATKQMQGNYEGPAKYIRTLLWAATQAGYDVKYAAGTAINTNSTAGFDAALSAAKQADVVVYAGGIDNTIEAEGRDRTTIAWPGNQVNLIDQLSKIGKPLVVVQFGGGQVDDSSLLSNPRVNALLWAGYPSQEGGSAIFDILTGKTAPAGRLPVTQYPADYVNQVPMTDMALRPGSNTPGRTYRWYDKAVLPFGFGLHYTTFKISWPRRALGPYNTAALVSRSPKNVPIDRAAFDTFHIQVTNTGKTTSDYVALLFLKTTDAGPKPYPLKTLVGYTRAKQIKPGEKRSVDIEVSLGSLARTAENGDLVLYPGRYTLEVDVGESQYPTASFTVTGKETILDSFPQPPKTR

SEQ ID NO: 24963 - protein, 454 aa, Neosartorya fumigata
  strain ATCC MYA-4609 / Af293 / CBS 101355 / FGSC A1100
MKHLASSIALTLLLPAVQAQQTVWGQCGGQGWSGPTSCVAGAACSTLNPYYAQCIPGATATSTTLTTTTAATTTSQTTTKPTTTGPTTSAPTVTASGNPFSGYQLYANPYYSSEVHTLAMPSLPSSLQPKASAVAEVPSFVWLDVAAKVPTMGTYLADIQAKNKAGANPPIAGIFVVYDLPDRDCAALASNGEYSIANNGVANYKAYIDAIRAQLVKYSDVHTILVIEPDSLANLVTNLNVAKCANAQSAYLECVDYALKQLNLPNVAMYLDAGHAGWLGWPANLGPAATLFAKVYTDAGSPAAVRGLATNVANYNAWSLSTCPSYTQGDPNCDEKKYINAMAPLLKEAGFDAHFIMDTSRNGVQPTKQNAWGDWCNVIGTGFGVRPSTNTGDPLQDAFVWIKPGGESDGTSNSTSPRYDAHCGYSDALQPAPEAGTWFQAYFEQLLTNANPSF

SEQ ID NO: 24964 - protein, 439 aa, Neosartorya fumigata
  strain ATCC MYA-4609 / Af293 / CBS 101355 / FGSC A1100
MHFSIGSLFLYLIASASCTAASPQYIQRSRRTPFTTSTSKPSAFTNPSTDTATTPYVLELTKINNKGNARSAVELNSQVRSGSANLVSFAEGVGFATSINIGNQTFEVVIDTGSSDLWVVRDGFICIDPVSRKEVAQSECRFGPAYAPNTTFHEVVGEFVDIKYADGEILSGVIGTENVTLAGITVNQTIGVMDYAGWYGDGVTSGLMGLAYSSLASAYTTNNRQPRLYNPIFATMYEQGLIDPIFSMVMNRNASNGTAAGYLTLGGLPPVDINGNFSTTPILITNIKGYPKDYDFYAVNIDGVALGNRSLPEAAGGIQYIIDSGTTLNYYPTPVADSVNAAFIPPAVYNDYDGAYVVDCNATASVHGVMIGGSTFYINPTDMILPGGMDNSGNKTCISGINAGGDVGQGIFVLGGTFLRNVVAVFDVGAAEMRFAASA

SEQ ID NO: 24965 - protein, 501 aa, Neosartorya fumigata
  strain ATCC MYA-4609 / Af293 / CBS 101355 / FGSC A1100
MVTMKLLYLTSFASLAVANGPGWDWKPRVHPKVLPQMIHLWDLLQGAQQLEDFAYAYPERNRVFGGRAHEDTVNYLYRELKKTGYYDVYKQPQVHQWTRADQALTVDGQSYDATTMTYSPSVNATAPLAVVNNLGCVEADYPADLTGKIALISRGECTFATKSVLSAKAGAAAALVYNNIEGSMAGTLGGATSELGAYAPIAGISLADGQALIQMIQAGTVTANLWIDSQVENRTTYNVIAQTKGGDPNNVVALGGHTDSVEAGPGINDDGSGIISNLVVAKALTRFSVKNAVRFCFWTAEEFGLLGSNYYVNSLNATEQAKIRLYLNFDMIASPNYALMIYDGDGSAFNLTGPAGSAQIERLFEDYYTSIRKPFVPTEFNGRSDYQAFILNGIPAGGLFTGAEAIKTEEQAQLFGGQAGVALDANYHAKGDNMTNLNREAFLINSRATAFAVATYANSLDSIPPRNMTTVVKRSQLEQAMKRTPHTHTGGTGCYKDRVEQ

SEQ ID NO: 24966 - protein, 292 aa, Neosartorya fumigata
  strain ATCC MYA-4609 / Af293 / CBS 101355 / FGSC A1100
MLFTAVTLALLGQALAGPVELEERQSSCPNIHVFGARETTAPTGYGSSSTAVNLILNAYPGSTSEAINYPACGGQSSCGGVSYANSVVAGINAVVSAVNSFNQRCPNTQLVLVGYSQGGQIMDNALCGGGDPNQGYTNTAVPLSSSAVNMIKAAIFMGDPRYVAGLPYNVGTCKAGGFDPRPPGFSCPSASKIQSYCDAADPYCCNGNDANTHQGYGTEYGQAALTFVKSKLSSSGSGGGSGGGSGGSGGSGGSGGTVAHYGQCGGQGWTGATSCQSPYTCTVISQWYSQCL

SEQ ID NO: 24967 - protein, 1011 aa, Neosartorya fumigata
  strain ATCC MYA-4609 / Af293 / CBS 101355 / FGSC A1100
MKSLLKRLIALAAAYSVAAAPSFSHHSSQDAANKRELLQDLVTWDQHSLFVRGERLMIFSGEFHPFRLPVPGLWFDVFQKIKSLGFNAVSFYTDWGLMEGNPGHVVTDGIWSLDEFFTAAREAGLYLIARPGPYINAETSAGGIPGWVLRRKGIIRSNSEDYLRATDTYMATLGKIIAKAQITNGGPVILVQPENEYTTWPNVSESEFPTTMNQEVMAYAEKQLRDAGVVVPTVVNDNKNLGYFAPGTGLGETDLYGIDAYPMRYDCGNPYVWPTYRFPRDWQHEHRNHSPTTPFAIMEFQGGSGDGWGGVTEDGCAILVNNEAVRVVYKNNYGFGVRVFNIYMTYGGTNWGNLGYYGGYTSYDYGAAITEDRQIWREKYSEEKLQANFLKVSPAYLTSTPGNGVNGSYTGNKDITVTPLFGNGTTTNLYLVRHADFTSTGSAQYNLSISTSVGNVTIPQLGGSLSLNGRDSKFHITDYDVGGFNLIYSSAEVFTWAKGDNKKRVLVLYGGAGELHEFALPKHLPRPTVVEGSYVKIAKQGSAWVVQWEVAAQRRVLRAGKLEIHLLWRNDAYQHWVLELPAKQPIANYSSPSKETVIVKGGYLLRSAWITDNDLHLTGDVNVTTPLEVISAPKRFDGIVFNGQSLKSTRSKIGNLAATVHYQPPAISLPDLKRLDWKYIDSLPEISTEYNDEGWTPLTNTYTNNTREFTGPTCLYADDYGYHGGSLIYRGHFTANGDESWVFLNTSGGVGFANSVWLNQTFLGSWTGSGRNMTYPRNISLPHELSPGEPYVFTVVIDHMGQDEEAPGTDAIKFPRGILDYALSGHELSDLRWKMTGNLGGEQYQDLTRGPLNEGAMYAERQGYHLPSPPTSSWKSSNPIKEGLTGAGIGFYATSFSLDLPEGYDIPLSFRFNNSASAARSGTSYRCQLFVNGYQFGKYVNDLGPQTKFPVPEGILNYNGVNYVAVSLWALESQGALIGGLDLVASTPILSGYRKPAPAPQPGWKPRRGAY

SEQ ID NO: 24968 - protein, 228 aa, Neosartorya fumigata
  strain ATCC MYA-4609 / Af293 / CBS 101355 / FGSC A1100
MVSFSYLLLACSAIGALAAPVEPETTSFNETALHEFAERAGTPSSTGWNNGYYYSFWTDGGGDVTYTNGAGGSYSVNWRNVGNFVGGKGWNPGSARTINYGGSFNPSGNGYLAVYGWTTNPLIEYYVVESYGTYNPGSGGTFRGTVNTDGGTYNIYTAVRYNAPSIEGTKTFTQYWSVRTSKRTGGTVTMANHFNAWSRLGMNLGTHNYQIVATEGYQSSGSASITVY

SEQ ID NO: 24969 - protein, 446 aa, Neosartorya fumigata
  strain ATCC MYA-4609 / Af293 / CBS 101355 / FGSC A1100
MQFTHLVALALALATSEAAHQGFNYGNTKSDGSAKSQADFQAEFSTAKNLVGTSGFTSARLYTMIQGGTANTPISAIPAAITEQTSLLLGLWASGGNFANEIAALKAAIAQYGDDLAKLVVGISVGSEDLYRNSVDGVKANAGIGTNPDEIVSYINEVRSTIAGTKLSGAPIGHVDTWTAWVNGSNSAVIDACDWLGFDGYPYFQNTMANSISDAKALFDESVAKTQAVAKGKEVWITETGWPVSGKTENLAVANLANAKTYWDEVGCPLFGKTNTWWYILQDADPVTPNPSFGIVGSTLSTTPLFDLSCSASSSSSAAAAASSTAGPSASSVIGGKASGFTTAAANSAKPTFTVGKGPGGSYNGTGFWNSTSSARPSSSAISGSSSGSAAGSSGAGASGASGQSSSSTGSSSAPSTSNILSNAASGLSGSIFGAVVAVCLALAAL

SEQ ID NO: 24970 - protein, 739 aa, Neosartorya fumigata
  strain ATCC MYA-4609 / Af293 / CBS 101355 / FGSC A1100
MQTLFLSLLAAAVTVHAYGSGGSNWDQAYSRAKDALQKLNQTEKVGLVTGVKWMGGPCVGNTYKPESIDYPSLCLQDSPLGIRFANPVTAFPAGINAGATWDTQLLYARGAAMGAEAKGLGIHVQLGPVAGPLGKNPNGGRNWEGFSVDPYLSGVAMEKTIRGMQDSGVQACAKHWLGNEQEHYRDTISSNIGDRAAHELYVWPFMDAVKAGVASVMCSYNKVNGTWACESDALNNKLMKEELGFPGYIMSDWNAQHSTVNSAVSGLDMTMPGSDFSNPPGSIFWGSNLEAAVADGSVPQSRLDDMVTRILAAWYLVGQDQGYPPVAFSSWNGGKANVDVTADHGTVARAVARDSIVLLKNGHGTLPLRKPKSLAIVGSDAIVNPAGPNACSDRGCNNGTLAMGWGSGTAEFPYLVGPLDAIQKRAAADGTKIVPSATDDPTAGASAAAAAETAIVFINSDSGEGYITVEGNLGDRNNLDPWHNGNELVKAVAAASKNVIVVIHSVGPIILETILAQPSVKAIVWAGLPGQESGNALVDVIYGDTTPSGKLPYTIAKQAADYGASWINAETDDFPEGLYVDYRHFDAKGIAPRYEFGYGLSYTTFKYSGLWVNMDASAGAANGQVVPGGPADLFEVVGQVSVSVRNNGRVAGAEVAQLYLGLPDSAPATPPKQLRGFQKLMLQPGQTGRATFKLTRRDLSYWDVQQQKWVVPSGTFKVYVGSSSRDIREEGSFRVRRGW

SEQ ID NO: 24971 - protein, 580 aa, Neosartorya fumigata
  strain ATCC MYA-4609 / Af293 / CBS 101355 / FGSC A1100
MYPLDGSARPHPPGTTRLNSVEPDKQIGFTVLVRPQTGAPRLPDLAQWQAIPIAERQFLSTAGFERTYGSSEDDIVSVASFLEKAGMTIRSRHAGAGTVEVQAKTCQIHSVFAVQLLYYRGQLRPAARKRRDDKQPAEETYIGFEGCISLPAALHDKVIHIFGLDTRTFGASGGYSGDPPRAQRLIVAELAALYGFPAGVDASQQTIGIFSGEGNDDKGQSLSNYRPADVAAYFNNQTVGYNRAPTVVPVSLTVADQTYRNDPDHPTQELSQDIMTAATIAQGCTVNVYFSDLTEQGWLAFLTRVLFPQGEEKRPTIVSISWTMYDEQTYRDRLSFLFQRLAVVGTSVFAIAGDWGANNNIIDGQPHVGWPGSDPWVTCVGGTVVGNVRSSGAFTEHAWSDRDNPDSQFTIDGHLGVTGGGMSRVFATPPYQLSSGISAVTDCNGERWTGGRFIPDITGMVGFRGFIVNGKRNYFIGTSCSTPLYAGLFAALASALGGGGEGGVLFGPLNTVLYQIDRGVYRDITFGHNDSGDMPACAYFAAGEGYDTVSGLGSVDGRRTLEELRRIYWPKTKGFGCFRN

SEQ ID NO: 24972 - protein, 242 aa, Neosartorya fumigata
  strain ATCC MYA-4609 / Af293 / CBS 101355 / FGSC A1100
MYQKSLLFSLLASSALAAQFPIPDSKGSVTFDEPYEIAAGETYDGGYKTYGRGVSCTGQSEGGQDDTVFIVQEGGTLKNAIIGSDQIEGVYCLGACTIENVWWEAVCEDALSLKGGSGPYNIIGGGAQGADDKVIQHNSGGQVNIDGFTVYDFGKLYRSCGNCDEQYARTVTIKNVVANSGKTLVGINSNLGDTASIDSSTCATDVKKICVEYKGNDTGAEPEEISEGPSDACQYSEPLSSC

SEQ ID NO: 24973 - protein, 237 aa, Neosartorya fumigata
  strain ATCC MYA-4609 / Af293 / CBS 101355 / FGSC A1100
MLYFTLLHSMTDQRGSDTMTDRKELVAVEHRLLGISNGVYTAAGSQALFDTAGASWCGAGCGKCYNLTSTGSAPCTGCGTGGAAGESIIVMVTNLCPYNGNQQWCPQVGATNNYGYSYHFDIMAQSEVFGDNVVVNFEPVACPGQATSDWETCVCYGQTETDETPVGMTPGGSNPSPLTSTTTTKTTTTETTITTTTSGATQTLYGQCGGSGWTGPTACASGATCKVLNPYYSQCLS

SEQ ID NO: 24974 - protein, 129 aa, Neosartorya fumigata
  strain ATCC MYA-4609 / Af293 / CBS 101355 / FGSC A1100
MRLFHRLLMATPSTMGSKSSLSEALALLPPLQLYRRILRVHRRKLDPEMRILGDSYVKSEFRAHRNVENPLHIIGFLTEWQLYAQKLEGDAWVGEKLDKSKLDKMSDQQIGQLYELMQAIKNPEGEGKE

SEQ ID NO: 24975 - protein, 396 aa, Neosartorya fumigata
  strain ATCC MYA-4609 / Af293 / CBS 101355 / FGSC A1100
MKAIGATLLGLALIVQAQQPLYAQCGGNGWTGSTQCIAGACCSSINDWYYQCLSGNCMPSTTMTTTTATHTTSTSTSGATGSLPTSFRWGSTNALVGPKNDGRNLAGIKDPSIIEVDGTYHVFASTAQASGYNLVYFNFTDFNQAGNAPFFYLDQSGIGTGYRAAPQVFYFQPHQLWYLIFQNGNAAYSTNKDISNPAGWSAPKNFFSSVPSIITENIGKGYWVDMWVICDSSNCYLFSSDDNGHLYRSQTTLSNFPNGMGNTVIALSDSNPNNLFEASNVYRVGNEYLLLVEAIGSDGNRYFRSWTAPSLTGTWTGLANTEANPFARSNNVVFSGTAWTKSISHGEMVRSQVDQTMTISPCKLRYLYQGLSPTATGDYNSLPWRLALLTQTNSAC

SEQ ID NO: 24976 - protein, 378 aa, Neosartorya fumigata
  strain ATCC MYA-4609 / Af293 / CBS 101355 / FGSC A1100
MKYQDLLAIAGCIANAGAVSVSGAAEGFAKGVTGGGSATAVYPSTTAELVSYLGDSEARVIVLTKTFDFTGTEGTTTATGCAPWGTASACQLAINQNNWCTNYEPNAPSVSVTYDNAGILGITVKSNKSLIGSGSSGVIKGKGLRIVSGASNIIIQNIAITDINPKYVWGGDAITIDNADMVWIDHVTTARIGRQHLVLGTSASNRVTISNNYFNGVSSYSATCDGYHYWGIYLDGSNDLVTMKGNYIYHFSGRSPKVQGNTLLHAVNNYWYDSSGHAFEIGSGGYVLAEGNVFQNIDTIVQSPVDGQLFTSPDSNTNKVCSTYLGHVCQVNGFGSSGTFSQADTGFLSNFAGKNIASASAYTAVQSTVPSSAGQGKI

SEQ ID NO: 24977 - protein, 321 aa, Neosartorya fumigata
  strain ATCC MYA-4609 / Af293 / CBS 101355 / FGSC A1100
MKFVATLIACGLSGLALAAPTATVNSLGKRAADDAAFGYASLNGGTTGGAGGTTTTVSSYAAFTAAVSSDAKKVVYVSGPIKQSAKQVKVGSNTSIIGKDSTAVLEGFGLLVKEKSNVIIRNLGVKKVLAENGDAIGIQYSNNVWVDHVDVSSDRDHDKDYYDGLIDVTHAADYVTISNSYIHDHWKASLVGHSDNNGDEDKGHLRVTYANNYWSNINSRAPSLRFGTGHIYNSYFENVSDGINTRDGAQVLVESNQFVGSSKALYSTDDGYAVERDNDFGGAKNTALQGTLTTVPYSYSLLGSSKVKSAVVGVAGQTLKF

SEQ ID NO: 24978 - protein, 385 aa, Neosartorya fumigata
  strain ATCC MYA-4609 / Af293 / CBS 101355 / FGSC A1100
MLHISIVAVTASLALVLSANAQAALYAQCGGEGYSGPTSCVAGAVCTVWNPWYSLRSMRPWNKHCTRHCAKYDNNDNNDNNDNNHNNHNNEHRYTHRAKVLHHFVSYPKLPIERSWAHPASGDSYSQTGFDISSTKPSASNPLGNPTLPGWTTSGGLNWVGFLVSKYNTSLTLSYNFAYGGATTNASLVAPYTSTVLSFIDQVTEFTNSIASKPSYAPWTSGNTLVGVWMGVNDVGNSYWLSNIDELLLKIMDSYFGQLQILYDAGVRNYVLLGVPPINRSPLMLAQGTDVTTAEAAVIAKYNNLIATYLAQFKSKNSGVTATVVDTQAPFNQALDNPTAYGAPDATCYNSDGTSCLWFNDYHPGIAIQDLTAQAVASALKELFF

SEQ ID NO: 24979 - protein, 322 aa, Neosartorya fumigata
  strain ATCC MYA-4609 / Af293 / CBS 101355 / FGSC A1100
MLPFNSCVYVLLIISLMSNCRALCRATALQGRSLCATGGPDAAFRAEHERLSAFESRPSSGSYDMRRALEPIEIETWFHIVSGETDADLVTDEMVILQLHYLQKAYEKASISYRLKGVTRHINETWARNGDDSAMKKALRRGGYSTLNVYFQTNLQPPSTTDFARWTSDGDNRHAYNSDLAPLSVLGFCTLPDPSINSSSPRSSYSKDGCNVLAKTMPGGPMTHYNRGGTAIHEIGHWNGLLHTFEGESCSEDNAGDYIADTPQQSVPTDGCPSQKDSCPDSPGLDDIHNFMDYSSDDCYASFTSNQLKRMRDMWFSMRKGK

SEQ ID NO: 24980 - protein, 257 aa, Neosartorya fumigata
  strain ATCC MYA-4609 / Af293 / CBS 101355 / FGSC A1100
MAPITEEVVHGLKDMIEKLENRVQELEARLGGESKPKSIAEQMRIVLMGPPGAGKGTQAPRLKEKYCVCHLATGDMLRSQVAKKTELGKEAKKIMDQGGLVSDEIMVNMIKNELDTNSECKNGFILDGFPRTVAQAERLDDMLEARNQKLQHAIELQIDDALLVARITGRLVHPASGRSYHKIFNPPKNDMKDDVTGEPLIQRSDDNAETLKKRLSTYHAQTAPVVEYYKKTGIWRGIDASQEPGQVWKSLLGVFQK

SEQ ID NO: 24981 - protein, 356 aa, Neosartorya fumigata
  strain ATCC MYA-4609 / Af293 / CBS 101355 / FGSC A1100
MLGKTVLLPLLVLLCHSLASASLVYRGADISSLLIEEKAGIEYKNVNGQTQPLENILKANGVNSVRQRVWVNPSDGSYNLDYNVKLAKRVKAAGMSVYLDLHFSDTWADPSHQTTPRGWSTNDIGTLTWQVYNYTMEVCNTFASNGIDVSIVAIGNEIRNGLLWPLGKPDNYANIANILHSAAFGVKDSTLSPKPKIMIHLDNGWDWSAQKFFYNRVLSSGANLVKSDFDLIGVSYYPFYNPSATLSALTTSLKNLRSTYGKDVLVVETDWPVSCPNPAYAFPSDLKDIPFSVAGQTTFVQRVANIVAQTPGGIGLYYWEPAWVQNAALGSSCADNLMVDWSTRQARTSLSVFATI

SEQ ID NO: 24982 - protein, 873 aa, Neosartorya fumigata
  strain ATCC MYA-4609 / Af293 / CBS 101355 / FGSC A1100
MRFGWLEVAALTAASVANAQVFDNSHGNNQELAFSPPFYPSPWADGQGEWADAHRRAVEIVSQMTLAEKVNLTTGTGWEMDRCVGQTGSVPRLGINWGLCGQDSPLGIRFSDLNSAFPAGTNVAATWDKTLAYLRGKAMGEEFNDKGVDILLGPAAGPLGKYPDGGRIWEGFSPDPALTGVLFAETIKGIQDAGVIATAKHYILNEQEHFRQVGEAQGYGYNITETISSNVDDKTMHELYLWPFADAVRAGVGAVMCSYNQINNSYGCQNSQTLNKLLKAELGFQGFVMSDWSAHHSGVGAALAGLDMSMPGDISFDDGLSFWGTNLTVSVLNGTVPAWRVDDMAVRIMTAYYKVGRDRLRIPPNFSSWTRDEYGWEHSAVSEGAWTKVNDFVNVQRSHSQIIREIGAASTVLLKNTGALPLTGKEVKVGVLGEDAGSNPWGANGCPDRGCDNGTLAMAWGSGTANFPYLVTPEQAIQREVISNGGNVFAVTDNGALSQMADVASQSSVSLVFVNADSGEGFISVDGNEGDRKNLTLWKNGEAVIDTVVSHCNNTIVVIHSVGPVLIDRWYDNPNVTAIIWAGLPGQESGNSLVDVLYGRVNPSAKTPFTWGKTRESYGAPLLTEPNNGNGAPQDDFNEGVFIDYRHFDKRNETPIYEFGHGLSYTTFGYSHLRVQALNSSSSAYVPTSGETKPAPTYGEIGSAADYLYPEGLKRITKFIYPWLNSTDLEDSSDDPNYGWQDSEYIPEGARDGSPQPLLKAGGAPGGNPTLYQDLVRVSATITNTGNVAGYEVPQLYVSLGGPNEPRVVLRKFDRIFLAPGEQKVWTTTLNRRDLANWDVEAQDWVITKYPKKVHVGSSSRKLPLRAPLPRVY

SEQ ID NO: 24983 - protein, 238 aa, Neosartorya fumigata
  strain ATCC MYA-4609 / Af293 / CBS 101355 / FGSC A1100
MKLSLSVALSLAASTAQAATQFCDQWGSVTEGNYILYNNLWGQAQATSGSQCTTFESLSGNTIVWNTKWSWSGGQGQVKSFANAALQFTPKKLSSVKSIDSTWKWNYSGSNIVADVAYDMFLSTSPGGDHNYEIMVWLGALGGAGPISSTGSPIATPTVAGIKFNLYLGPNGSMQVYSFVAQSTTNSFSGDMRDFFTYLESNQGLSSDLYLVDVQAGTEPFSGSNAVFTVSDYSVSVA

SEQ ID NO: 24984 - protein, 323 aa, Neosartorya fumigata
  strain ATCC MYA-4609 / Af293 / CBS 101355 / FGSC A1100
MFARQSLRVAQPLKQGFRKYSTEAPSKGKSSLAPIYLGVGLIGLGVGLYRYNSASAEAPPAERPKVFTGGDQGWVDLKLAQIENLSPNTKRLRFEFPDKEAVSGLHVASALLTKFKPQGAEKPVIRPYTPVSDEEQPGYLDLVVKVYPNGPMSEHLHSMNVDQRLEFKGPIPKYPWEANKHKHICLIAGGTGITPMYQLARKIFKDPEDQTKVTLVFGNVREEDILLKKELEELENTYPRRFRAFYLLDHPPKEWTGGKGYITKELLKTVLPEPKEENIKIFVCGPPGMYKSISGPKVSPTDQGELTGILAELGYSKDQVFKF

SEQ ID NO: 24985 - protein, 416 aa, Neosartorya fumigata
  strain ATCC MYA-4609 / Af293 / CBS 101355 / FGSC A1100
MIFKFSQKALVALYLVVGLAEAVPSKSRVVSRASTFDYNGIVRGVNIGGWLVLEPWITPSIFDNAGDAAVDEWTLTATLGQDQAKAVLSQHWSTFITQDDFQQIAQAGMNHVRIPIGYWAVSSLPDEPYVDGQLEYLDNAISWAREAGLKVVIDLHGAPGSQNGFDNSGRKGPIAWQQGDTVSQTVDAFRALAERYLPQSDVVTAIEALNEPNIPGGVSEAGLRDYYNQIADVVRQIDPGTSVFLSDGFLSTESWNGFKTGEDVVMDTHHYEMFDNYLISLDIDGHVKSACDFGKQIEGSDKPVVVGEWSGAVTDCTKHLNGKGVSTRYQGEYANNVKYGDCANTTQGSVADLSDQERTDTRRFIEAQLDAYEGKNGWLFWTWKTEGAPGWDMQDLLANGVFPSPLTDRQFPNQCA

SEQ ID NO: 24986 - protein, 262 aa, Neosartorya fumigata
  strain ATCC MYA-4609 / Af293 / CBS 101355 / FGSC A1100
MIPTTYLLLAVSIFLWLQLLPSIHASNTAGTTVIVTVTPTIPHPASYTSLEIFKDTVLSTSNAYRREHNASHLTWNETLTKYAKRWAEGCKWKHSGGPYGENLAFGYQDPAAAVAAWGDEGQKYDYKLPTGFSEETGHFTQLVWRATREVGCAAFNCGYQNGNDAKNKEGRYTRAQGWYVVCEYSPAGNVVGNQNAFFRVNVQPTSTYSGPETAGSATGTSASASGSATATATSGVEELYDGRLRDQYQNAFVGLIVFINLV

SEQ ID NO: 24987 - protein, 234 aa, Neosartorya fumigata
  strain ATCC MYA-4609 / Af293 / CBS 101355 / FGSC A1100
MWSSIAAFPVLVPVALACLGYEGGVPTPTAHHSNSAVIEVAAGQVFDAGWAKYDRGSGACKGQSEGDWKDAVFYLHSGATLKNVIIGANQAEGVHCDGPCTLQFVWFEDVCEDAITIKNDKAGQETWIIGGGAYHASDKIVQHNGCGTVNIINFYAEDYGKVPRSCGNCDKQCKRNVYVEGTTARNGGEVVGINLNYGDTATLKNVCADSAHPCVFYDGCAGDCEPKKVGYCSG

SEQ ID NO: 24988 - protein, 506 aa, Neosartorya fumigata
  strain ATCC MYA-4609 / Af293 / CBS 101355 / FGSC A1100
MLPQLSIERASVFALGLIATGSLVVAGPCDIYSAGGTPCVAAHSTTRALYSSYSGPLYQVKRGSDGATADIAPLSAGGVANAAAQDSFCDGTTCLITIIYDQSGRGNHLTQAPPGGFSGPESNGYDNLASAIGAPVTLNGQKAYGVFISPGTGYRNNAASGTATGDAPEGMYAVLDGTHYNDACCFDYGNAETSSRDTGNGHMEAIYFGDNTIWGTGSGSGPWIMADLENGLFSGSSPDNNSGDPSISYRFLTAVVKGKQNQWAIRGANAASGSLSTFYNGARPSVSGYNPMSKEGAIILGIGGDNSNGAQGTFYEGVMTSGYPSDATENSVQANIVAAKYATASLTSGPKLTVGSSISLQATTPGYTTRYIAHSGSTVNTQVVSSSSSTTLKQQASWTVRTGLANSDCFSFESRDTPGSFLRHYNFVLQLSANDGTKQFHEDATFCPQAGLNGQGNSIRSWNYPTRYFRHYNNVLYAASNGGVHTFDATSSFNNDVSWVISTGFA

SEQ ID NO: 24989 - protein, 829 aa, Neosartorya fumigata
  strain ATCC MYA-4609 / Af293 / CBS 101355 / FGSC A1100
MTPKFDIDYVLANITEDDKIALLSGSDFWHTHAIPKFNVPPIRTTDGPNGIRGTKFFAGVPAACLPCGTALGATWDRDLLHQAGVLLGKECLAKGAHCWLGPTINMQRSPLGGRGFESFAEDPHLSGIMAKSIILGCESTGVISTVKHYVGNDQEHERRAVDVLVTPRALREIYLRPFQIVARDAHPGALMTSYNKINGKHVVENPAMLDIVRKDWHWDPLIMSDWLGTYTTIDSLNAGLDLEMPGPTRYRGKYIESAMQARLIKQSTISKRARKVLEFVERASRAPVSADETGRDFPEDRALNRTLCANSIVLLKNDGNLLPIPKTVKKIALIGSHVKTPAISGGGSASLEPYYAVSLYDAVVEALPDAEILYEAGAYAHRMLPVIDRMLSNAVIHFYNEPPEKERTLLATEPVVNTAFQLMDYNAPGLNRALFWATLIGEFTPDVSGLWDFGLTVFGTATLFIDDEMVIDNATRQTRGTAFFGKGTVQEVGQKQLTAGQTYKIRIEFGSANTSPMKAIGVVHFGGGAAHLGACLHMDPEQMVANAVRVAAEADYTIVCTGLNRDWESEGFDRPDMDLPPGIDALISSVLDVAADRTVIVNQSGTPVTMPWAHRARGIVQAWYGGNETGHGIADVLFGDVNPSGKLPLSWPADVRHNPTYLNNMSVGGRMLYGEDVYIGYRFYEKVGREVLFPFGHGLSYTTFHVSPEATVSPIVFSSDSPPTATVLVKNTGPMAGAQTLQLYIAAPNSATPRPVKELHGFTKVFLQSGEERSVSIHIDRYATSFWDEIEDMWKSEEGVYQVLIGTSSQEIVSRGEFRVEQTRYWRGV

SEQ ID NO: 24990 - protein, 420 aa, Neosartorya fumigata
  strain ATCC MYA-4609 / Af293 / CBS 101355 / FGSC A1100
MKLSEPLLVSLAAFSQAVTALVAFPGAEGFGANAIGGRNGQVYVVTNLNDSGTGSLRDAVSATDRIVVFAVGGVIKISDRIVVSKRVTILGQTAPGDGITVYGNGWSFSNADDAIVRYIRIRMGKGGSSGKDALGIAEGNRMIFDHVSVSWGRDETFSINGDASNITVQNSIIAQGLETHSCGGLMQTDGGVSLFRNLYIDNKTRNPKVKGVNEFTNNVVYNWGGGGGYIAGDSAGQSYANIIGNYFISGPSTSVTAFTRGNANFHGYVQNNYYDPDKDGQLDGFELGVSSSNYGGMAIMSSKYNYPAVAYTMSPAEAVTYVTKYAGASKVRDSVDTQLIAQVQSWGTEGGLISDEATMGGPGTLNGGTPAKDTDGDGIPDEAEKQLGTDPNTNDSMKLHSSGYTYLEVWANSLVPSTYH

SEQ ID NO: 24991 - protein, 397 aa, Neosartorya fumigata
  strain ATCC MYA-4609 / Af293 / CBS 101355 / FGSC A1100
MVHLSSLAAALAALPLVYGAGLNTAAKAKGLKYFGSATDNPELTDSAYVAQLSNTDDFGQITPGNSMKWDATEPSQNSFSFANGDAVVNLANKNGQLMRCHTLVWHSQLPNWVSSGSWTNATLLAAMKNHITNVVTHYKGKCYAWDVVNEALNEDGTFRNSVFYQIIGPAYIPIAFATAAAADPDVKLYYNDYNIEYSGAKATAAQNIVKMIKAYGAKIDGVGLQAHFIVGSTPSQSDLTTVLKGYTALGVEVAYTELDIRMQLPSTAAKLAQQSTDFQGVAAACVSTTGCVGVTIWDWTDKYSWVPSVFQGYGAPLPWDENYVKKPAYDGLMAGLGASGSGTTTTTTTTSTTTGGTDPTGVAQKWGQCGGIGWTGPTTCVSGTTCQKLNDWYSQCL

SEQ ID NO: 24992 - protein, 221 aa, Neosartorya fumigata
  strain ATCC MYA-4609 / Af293 / CBS 101355 / FGSC A1100
MVSFSSLVLAASTVAGVLATPGSEQYVELAKRQLTSSQTGTNNGYYYSFWTDGGGQVTYTNGNGGQYQVDWNNCGNFVAGKGWNPASEKAVTYSGSWQTSGNGYLSVYGWTTSPLVEFYIVESYGSYDPSTGATHLGTVESDGATYNLYKTTRTNAPSIQGTATFDQYWSVRTSHRQSGTVTTKNHFDAWRNAGLQLGNFDYMIVATEGYQSSGSATITVS

SEQ ID NO: 24993 - protein, 865 aa, Neosartorya fumigata
  strain ATCC MYA-4609 / Af293 / CBS 101355 / FGSC A1100
MGSIDTVGMGQRAIDQIISELSLNEKVALLSGVDAWHTFAIPRLGIPSIRTTDGPNGARGTRYFNGVPSACLPCGTALGATFDRDLIFSLGQLLAAECRAKGAHVLLGPTINIQRGPLGGRGFESFSEDPVLSGLAAASYCSGVQDGGVVPTLKHLVCNDQEHERVAVSALVTPRALREIYLLPFQLAIQGARPGAVMTSYNKVNGLHASENPGLIRDILRGEWGYEGAVISDWFGTYSVADAVNAGLDLEMPGPTRFRGPALMHALTSNKVSEKTLNERVRKVLELVQLASRAGVPEYAPERKLNRPEDRALLRRAAGESVVLLKNDKNDSTNSPILPLDREKTTLVIGPNADLAAYCGGGSASLLAYYTVTPRQGIADKCGAEQVVFSQGCYGHKELPLLGEHLRTIETGQPGYTFRVYTEPPPASGSFKGSDSRTPVDELHMTNSSAFLMDYSHPQISGDTYYATLEGTFEPPESGVYEFGLTVAGTGLLYIDGVLVVDNKTVQRAGTSFFGIGTVEERGERYLEAGKKHHVFVEFGTAPTSNLQHHHGVVSFGPGGLRLGGCRKLDTDTAIQQAVQSAAQADQVVVCVGLSGDWESEGFDRPHMDLPPGTDELVNAVLAVQPNAVIVVQSGTPVTMPWADKAKALLQAWYGGNEAGNGIADVLFGDVNPSAKLPLTFPRELAQNPSYLSYRSERGRVLYSEDIYVGYRYYDTTGQPPLFRFGHGLSYSTFHLRDLTVRETAPYAANIKESSLRVSVTVSNTSARPGAEVVLVYVRPPAAACSVGRPVRELKGYEKVMLQPGETREVSITIPLGLATSFWDEGCDAWLSEKGLYFVEAVGTGEGNTLVAPLTVQVSRVWNGL

SEQ ID NO: 24994 - protein, 532 aa, Neosartorya fumigata
  strain ATCC MYA-4609 / Af293 / CBS 101355 / FGSC A1100
MLASTFSYRMYKTALILAALLGSGQAQQVGTSQAEVHPSMTWQSCTAGGSCTTNNGKVVIDANWRWVHKVGDYTNCYTGNTWDTTICPDDATCASNCALEGANYESTYGVTASGNSLRLNFVTTSQQKNIGSRLYMMKDDSTYEMFKLLNQEFTFDVDVSNLPCGLNGALYFVAMDADGGMSKYPTNKAGAKYGTGYCDSQCPRDLKFINGQANVEGWQPSSNDANAGTGNHGSCCAEMDIWEANSISTAFTPHPCDTPGQVMCTGDACGGTYSSDRYGGTCDPDGCDFNSFRQGNKTFYGPGMTVDTKSKFTVVTQFITDDGTSSGTLKEIKRFYVQNGKVIPNSESTWTGVSGNSITTEYCTAQKSLFQDQNVFEKHGGLEGMGAALAQGMVLVMSLWDDHSANMLWLDSNYPTTASSTTPGVARGTCDISSGVPADVEANHPDAYVVYSNIKVGPIGSTFNSGGSNPGGGTTTTTTTQPTTTTTTAGNPGGTGVAQHYGQCGGIGWTGPTTCASPYTCQKLNDYYSQCL

SEQ ID NO: 24995 - protein, 397 aa, Neosartorya fumigata; identical to SEQ ID NO: 24917
  strain ATCC MYA-4609 / Af293 / CBS 101355 / FGSC A1100

SEQ ID NO: 24996 - protein, 330 aa, Neosartorya fumigata
  strain ATCC MYA-4609 / Af293 / CBS 101355 / FGSC A1100
MKLTASILFSLASVTPLVSGHYVFSKLIVDGKPTQDFEYIRRNTNNYMPTLPSEILSNDFRCNKGSMQSAANTKVYKVAPGTELGFQLAYGAEMKHPGPLQIYMSKAPGDVRSYDGSGDWFKVHQEGLCADTSKGIKDEDWCTWGKDTASFKIPQDTPAGQYLVRVEHIGLHRGFLGEAEFYFTCAQIEVTGSGSGSPSPTVKIPGVYKPDDPNVHFNIWYPTPTAYSLPGPSVWTGGSAGGASPTAPAVNNNAVQAAPTTMTTVSSPANPTAGAEAEADCGSSESSSAVAPEGTLKKWEQCGGLNWTGSGSCEARTTCHQYNPYYYQCI

SEQ ID NO: 24997 - protein, 526 aa, Neosartorya fumigata
  strain ATCC MYA-4609 / Af293 / CBS 101355 / FGSC A1100
MTKLSLLPLLTLASAVLAKQDAFQAKCASFGRKIKLPNVHVNFVEYVPGGTNLTLPDNDVTCGASSQVVSADMCRVAMAVDTSKSSQITLEAWFPREYTGRFLSTGNGGLSGCIQYYDLAYTAGLGFATVGANNGHNGTSGKPFYQHPEVIEDFAYRSIHTGVVVGKQLTKMFYKEGFDKSYYLGCSTGGRQGFKSIQKYPNDFDGVVAGAPAFNFVNLISWSIHFYSITGSNTSDTYLSPESWKVVHDEIVRQCDEIDGAKDGIIEDTDLCQPVIETIICKPGASDKTNCITGAQAKTVRNVLSPFYGVNGNLLYPRMQPGSELFASSVVYNGQPFRYSTDWYRYVVYNNPDWDATKWTVEDAAVALAQNPYNIQTWDADISSFQKAGGKVLTYHGMQDQLISSDNSKLYYARVAEEMGLGPEELDDFYRFFPVSGMAHCTGGDGAYGIGNGLRTYNGAEPENNVLMAMVQWVEKGIAPEFIRGAKFSNGVGSSVEYTRKHCRYPRRNVYKGPGNYSDENAWECV

SEQ ID NO: 24998 - protein, 234 aa, Neosartorya fumigata
  strain ATCC MYA-4609 / Af293 / CBS 101355 / FGSC A1100
MANVALIGATGMVGSHILTSLLENPAIARVDTISRRTPSAAAAAPQTKLTTFVSDDTSRWAAQLSSLTPTPSIFISAFGTTRAAAGGFENQYKVEHGLNVEMARAARDAGTKVYVLISSGGANKASSFAYPRMKGEIEEDVKALGFERTVILRPGLISGQRQESRPAEAALRFIAGIAGKVHSGLKDGWAQDADVIARAAVNAGLKALDGDVPPGSEKLWILGGSDIIKYGGKK

SEQ ID NO: 24999 - protein, 926 aa, Neosartorya fumigata
  strain ATCC MYA-4609 / Af293 / CBS 101355 / FGSC A1100
MHVKAETVLALLTPAPPSVVGQHVVDLSGDGWTLSSTALNRTVPGHLPSQVHLDLFEAGVIDIMASMILTFVGLRMPIGRIPATRLKAYFESTWLVFDGLDTFATITFCDQHVGSTDNQFRQHHFDVSQILKECKQDPVLRINFGSAPNIANTIAKSPDAEEWPPGVQITNEYPNRWYIRKEQSDFGWDWGPAFAPVGPWKPSYIVQNGHAELYVLNTDIDIYRQGQINYLPPDQSQPWIVNASIDFLGPVPCKPSMSIEIKDAATGSVLSSGLLQNVTVSGKSITGTTTIDGDAPKLWWPSGMGKQNLYNVTITVQNDMKKSLAKVTKRTGFRTIFLNQRNITDDQLAQGIAPGANWHFEINGYEFYTKGSNIIPPDAFWPRVTQARMARLFDAVTAGNQNMLRVWASGAYLHDFIYDLADEKGILLWSEFQFSDALYPVNDAFLENVAAEVVYNVRRVNHHPSLALWAGGNEIESLMLPMARRADPTGYSKYIGEYEKLYISLILPLVYENTRSITYSPSSTTEGYLYVNLSAPVPMAERYSNTTPGSYYGDTDYYNYDTSVSFDYNHYPVGRFANEFGFHSMPSLQTWQQAVDPEDLQFNSSVVVLRNHHYTAGGLFTDNFKNSSKGMGEMTMGVEAYYPIPSKSDSVANFSAWCHATQLFQADLYKSQIQFYRRGSGMPERQLGSLYWQLEDIWQAPTWAGIEYDGRWKVLHYVARDIYQPIIVSPFWNYTTGRLEVYVTSDLWEPAQGTVNLTWVDLSGKSIANNAGTPETVSFTVGALNTTNIYTTNISELSLPDLKDSILILSLSGEGRLPNASSKKAFVHQNHFTPVFPKDLSLKDPKLEVSYSPESRKFTVQATGGVSLYTWLDYPAGAVGYFEANAFVLLPGVPKEVSFVAQEGNVTDDWLQRVTVQSLWDQKVRD

SEQ ID NO: 25000 - protein, 869 aa, Neosartorya fumigata
  strain ATCC MYA-4609 / Af293 / CBS 101355 / FGSC A1100
MRVLSAIALVASLASSALSAPASESRVSTQLRSRDAEGYSSPPYYPAPNGGWLSSWADAYEKAQRVVRDMTLAEKVNLTTGTGIFMGPCVGQTGSALRFGIPNLCLQDSPLGVRNSDHNTAFPAGITVGATFDKDLMYARGVELGKEFRGKGINVLLGPSVGPIGRKPRGGRNWEGFGADPSLQAIGGAQTIKGIQSQGVIATIKHYIGNEQEMYRMSNVGQRAYSSNIDDRTLHEVYLWPFAEGIRAGVGAVMTAYNEVNSSACSQNSKLLNEILKDELGFQGFVMTDWLGQYGGVSSALAGLDMAMPGDGAIPLLGTAYWGSELSRSILNGSVPVSRLNDMVTRIVAAWYKMGQDGEFPLPNFSSNTQDATGPLYPGALFSPSGVVNQYVNVQADHNITARAIARDAITLLKNDDNILPLKKDDALKVFGTDAGPNPDGLNSCADMGCNKGVLTMGWGSGTSRLPYLVTPQEAIANISSNAAFFITDNFPSNVAVSSGDVAVVFISADSGENYITVEGNPGDRTSAGLNAWHNGDKLVKDAAAKFSKVVVVVHTVGPILMEEWIDLPSVKAVLVAHLPGQEAGWSLTDVLFGDYSPSGHLPYTIPRAESDYPSSVGLLSQPIVQIQDTYTEGLYIDYRLFLKANITPRYPFGHGLSYTTFSFSQPTLSVRTALDSTYPPTRPPKGPTPTYPTAIPDPSEVAWPKNFGRIWRYLYPYLDDPASAAKNSSKTYPYPAGYTTVPKPAPRAGGAEGGNPALFDVAFAVSVTVTNTGSRPGRAVAQLYVELPDSLGETPSRQLRQFAKTKTLAPGTSETLTMEITRKDISVWDVVVQDWKAPVRGEGVKIWLGESVLDMRAVCEVGGACRVI

SEQ ID NO: 25001 - protein, 632 aa, Neosartorya fumigata
  strain ATCC MYA-4609 / Af293 / CBS 101355 / FGSC A1100
MATVRICVCGDEGTGKSSLITSLVKGVFVTNKIQPVLPQITIPPTIGTPENVTTTTVVDTSALPQERSNLAREIRKSNVILLVYSDHYSYERVALFWLPYFRSLGVNVPVVLCANKSDLAADHTEAQVIEEEMLPVMAEFKEIDSCIRTSAREHRNVNEAFFLCQKAVTHPIAPLFDSKESALKPAAVAALQRIFYLSDKDRDGYLSDKEIEDFQMRCFDKPLSKEDLVHIKETIQKTHPDSVTPFGIDCRGFIHLNKMYAEKGRHETVWIILRAFQYTDNLSLQESFLHPRFEVPPFASAELSPEGYRFFVNLFLLSDKDNDGGLNDAELASLFAPTPGLPASWADGSFPSSTVRNEAGHVTLQGWLAQWSMTTFQSPKTTLEYLAYLGFESSDRSNPSTTAALKVTRPRKKRKRPGRVGRNVVLGHVLGAPGSGKSALLDAFLARGFSHTYRPTIQPRTAVNTVELPGGKQCYLILDELGELEPAILENQAKLLDQCDVIVYTYDSSDPDSFAYIPQLRSKYPHLEELPSVFIALKADLDRTTQRAEHQPHEYTAMLNMPSPPLHVSATWSSIQEVFVHIAEAAMEPSTAFPRSEEDVEGKWMAWGIALGAVVCAGAAAVMIWRRVSGSG

SEQ ID NO: 25002 - protein, 452 aa, Neosartorya fumigata
  strain ATCC MYA-4609 / Af293 / CBS 101355 / FGSC A1100
MHQRALLFSALAVAANAQQVGTQTPETHPPLTWQKCTAAGSCSQQSGSVVIDANWRWLHSTKDTTNCYTGNTWNTELCPDNESCAQNCALDGADYAGTYGVTTSGSELKLSFVTGANVGSRLYLMQDDETYQHFNLLNHEFTFDVDVSNLPCGLNGALYFVAMDADGGMSKYPSNKAGAKYGTGYCDSQCPRDLKFINGMANVEGWEPSSSDKNAGVGGHGSCCPEMDIWEANSISTAVTPHPCDDVSQTMCSGDACGGTYSESRYAGTCDPDGCDFNPFRMGNESFYGPGKIVDTKSKMTVVTQFITADGTDSGALSEIKRLYVQNGKVIANSVSNVAGVSGNSITSDFCTAQKKAFGDEDIFAKHGGLSGMGKALSEMVLIMSIWDDHHSSMMWLDSTYPTDADPSKPGVARGTCEHGAGDPENVESQHPDASVTFSNIKFGPIGSTYEG

SEQ ID NO: 25003 - protein, 440 aa, Neosartorya fumigata
  strain ATCC MYA-4609 / Af293 / CBS 101355 / FGSC A1100
MKPLTSLLLSAALSAAAPHPASPQAPLADIPSIVGETRTEFSQNSLDDVVNASPLLSFHRDLVSIESISGNEGAAGAFVADFLASHNFTVIKQPVTTESDARFNIFAIPESQYHSLDESHSSHSPQILLTSHIDTVPPFIPYSLHRDANDTDDRNILIAGRGTVDAKGSVAAQIFAALDILAAQPSAPLGLLFVVGEETGGDGMKAFSQSTHLNPSPSRFHTVIFGEPTELALVAGHKGMLGFEVAAHGHAAHSGYPWLGESAISAILPALARVDQLGDIPVEEGGLPASDKYGRTTVNIGRMEGGVATNVVPSKARAGVAVRLAAGTHDEAREVVLKAVRDVTGGDDRVVVNFSLEGYGPQDLDTDVPGFNITTVNYGTDVPNLQLHPRPDGKVRRYLYGPGTIHVAHGDNEALTVAQLEEAVRGYKKLIQAALDRSAS

SEQ ID NO: 25004 - protein, 983 aa, Neosartorya fumigata
  strain ATCC MYA-4609 / Af293 / CBS 101355 / FGSC A1100
MRIFSFLFLLLLGILTGQGLVSGTDNGKTTDVTWDKYSLSVKGQRLFVFSGEFHYQRLPVPELWLDVFQKLRANGFNAISVYFFWSFHSASEGEFDFENGAHDIQRLFDYAKEAGLYVIARAGPYCNAETSAGGFALWAANGQMGNERTSDEAYYEKWRPWILEVGKIIAKNQITNGGPVILNQHENELVETTYDPNHTLVVYMKQIAQVFEEAGIVVPSSHNEKGMRGVSWSTDYHNVGGAVNIYGLDSYPGGLSCTNPNSGFNLVRTYHQWFQNYSFTQPSYLPEFEGGWFQPWGGSFYDTCATELSPEFPDVYYKNNIGSRVTLHSIYMTYGGTNWGHSAAPVVYTSYDYAAPLRETREIRDKLKQTKLIGLFTRVSKDLLKTYMEGNGTGYTSDSSIYTWSLRNPDTNAGFYVLAHSTSSTRDVTTFTLNVTTSAGAISIPDIELNGRQSKIIVTDYNFGTNSTLLFSSAEVLTYANLDVNVLVFYLNVGQKGTFVFKDEPKLAFQTYGNSNLTTSESSYGTQYSYTQGKGVTAVKFSNGVLAYFLDKESAWNFFAPPTTSSPQVAPNEHILVQGPYLVRGASVNHGTVEITGDNANTTSIEVYTGNSQVKKIKWNGKTIETRKTAYGSLIGTAPGAEDVKIQLPSLDSWKAQDTLPEIQPDYDDSKWTVCNKTTSVNAIAPLSLPVLYSGDYGYHAGTKVYRGRFDGRNVTGANVTVQNGAAAGWAAWVNGQYAGGSAGSPNLAATSAVLTFNSSSLKDQDNVLTVVTDYTGHDQNSVRPKGTQNPRGILGATLIGGGNFTSWRIQGNAGGEKNIDPVRGPMNEGGLYGERMGWHLPGYKVPKSASKSSPLDGVSGAEGRFYTTTFKLKLDKDLDVPIGLQLGAPEGTKAVVQVFMNGYQFGHYLPHTGPQSLFPFPPGVINNRGENTLAISMWALTDAGAKLDKVELVAYGKYRSGFDFNQDWGYLQPGWKDRSQYA

SEQ ID NO: 25005 - protein, 765 aa, Neosartorya fumigata
  strain ATCC MYA-4609 / Af293 / CBS 101355 / FGSC A1100
MKWSILLLVGCAAAIDVPRQPYAPTGSGKKRLTFNETVVKRAISPSAISVEWISTSEDGDYVYQDQDGSLKIQSIVTNHTQTLVPADKVPEDAYSYWIHPNLSSVLWATNYTKQYRHSYFADYFIQDVQSMKLRPLAPDQSGDIQYAQWTPTGDAIAFVRDNNVFVWTNASTSQITNDGGPDLFNGVPDWIYEEEILGDRFALWFSPDGAYLAFLRFNETGVPTFTVPYYMDNEEIAPPYPRELELRYPKVSQTNPTVELNLLELRTGERTPVPIDAFDAKELIIGEVAWLTGKHDVVAVKAFNRVQDRQKVVAVDVASLRSKTISERDGTDGWLDNLLSMAYIGPIGESKEEYYIDISDQSGWAHLWLFPVAGGEPIALTKGEWEVTNILSIDKPRQLVYFLSTKHHSTERHLYSVSWKTKEITPLVDDTVPAVWSASFSSQGGYYILSYRGPDVPYQDLYAINSTAPLRTITSNAAVLNALKEYTLPNITYFELALPSGETLNVMQRLPVKFSPKKKYPVLFTPYGGPGAQEVSKAWQALDFKAYIASDPELEYITWTVDNRGTGYKGRAFRCQVASRLGELEAADQVFAAQQAAKLPYVDAQHIAIWGWSYGGYLTGKVIETDSGAFSLGVQTAPVSDWRFYDSMYTERYMKTLESNAAGYNASAIRKVAGYKNVRGGVLIQHGTGDDNVHFQNAAALVDTLVGAGVTPEKLQVQWFTDSDHGIRYHGGNVFLYRQLSKRLYEEKKRKEKGEAHQWSKKSVL

SEQ ID NO: 25006 - protein, 572 aa, Neosartorya fumigata
  strain ATCC MYA-4609 / Af293 / CBS 101355 / FGSC A1100
MAFNFNWSPLMADASFYTRAQDLLTAALNKSPKPPIIVDDIIVTELNLGSIPPELEILEIGDLAEDRFRGIFKMSYSGDAFLTLKTRVQANPLNTYLLTRPSFATPRPLAAATPLTIPLQITLSDFKLSGFVILVFSKQKGITVVFRNDPLESLKVSSTFDSIPFVRDFLQKEIEAQLRILFMDELPAIIHRLSLRLWVPEYRAGEELQTQTASANGEGPGQDPLASPPQDPVDALGNALNESEIESLSLDSSVETHSLFSQKNLLRLAALTDSQRTLSLFTPSIREVVYRAWTSPSDQTDASGSVTSPFFPVLSRTQSQVGSMSSFPDSASMVSSQSRSSTPFHTFSGYGLSLGAGRHSKAHARKRKKRVVDLRRPKTTDDAPSVSDESSFTESTSAPSICSAPLPVLDEQTDDPVTPPLSPDNDLHLPAIPERHRMSISRPALRRENASEMIRDTAECKPSSNAVGQAIQEEDLSATPRAAVRAHGASVLEKGKQDPDSSAGSSRQLSSTILPFINDNPTGGVVDQALVERLAGEIARRMRDEKFMASNACGPFWDRHSQEESPPPAYGH

SEQ ID NO: 25007 - protein, 370 aa, Neosartorya fumigata
  strain ATCC MYA-4609 / Af293 / CBS 101355 / FGSC A1100
MKVTILASAILALINGALALPANTPTLDVTLTQVDNTRIKATVKNTGNEKVTFVHLNFFQDAAPVKKVSLFRNATEVEFTGIKRRLLTEGLSDDALTTLAPGATFEDEFDVASTADLTEGGTVTIRTDGFVPITTDRKVSGYIPYQSNELEIEVDAAKAAAVPQAIKLLDRRTKVASCSGSRASALSTALRNAASLANAAASAASSGSSTRFQEYFKTTSSSTRNTVAARFRAVASEASSQSSGKTTYYCTDPYGYCDSNTLAYTLPSSNLIANCDIYYSYLPALTSSCHAQDQATTTLHEFTHAPAVYSPGTDDYAYGYRASTALSASQALLNADTYALFANGTPPPPPSPLHIHFQMLDTNNGYSREP

SEQ ID NO: 25008 - protein, 368 aa, Neosartorya fumigata
  strain ATCC MYA-4609 / Af293 / CBS 101355 / FGSC A1100
MRSVKLFGLAALGSLGAAAPAPSRVSDLTKRSSTCTFTAASQATESASGCSEIVLDNIEVPAGETLDLSDVDDGTTIVFEGTTTFGYKEWSGPLIRFGGKDITIKQNSGAVIDGEGSRWWDGEGTNGGKTKPKFMYAHSLEDSTITGLSIKNTPVQAISVQATNLYLIDITIDNSDGDDNGGHNTDGFDISESTGVYIRGATVKNQDDCIAINSGENIEFSGGTCSGGHGLSIGSVGGRDDNTVKNVTITDSTVTDSANGVRIKTVYDATGSVSQVTYSNIKLSGITDYGIVIEQDYENGSPTGTPTTGVPITDLTIDGVTGTVESDAVEVYILCGDGSCSDWTWEGVDITGGEKSSKCENVPSGASC

SEQ ID NO: 25009 - protein, 594 aa, Neosartorya fumigata
  strain ATCC MYA-4609 / Af293 / CBS 101355 / FGSC A1100
MLSSTLYAGWLLSLAAPALCVVQEKLSAVPSGWTLIEDASESDTITLSIALARQNLDQLESKLTTLATPGNPEYGKWLDQSDIESLFPTASDDAVLQWLKAAGITQVSRQGSLVNFATTVGTANKLFDTKFSYYRNGASQKLRTTQYSIPDHLTESIDLIAPTVFFGKEQNSALSSHAVKLPALPRRAATNSSCANLITPDCLVEMYNLGDYKPDASSGSRVGFGSFLNESANYADLAAYEQLFNIPPQNFSVELINRGVNDQNWATASLGEANLDVELIVAVSHPLPVVEFITGGSPPFVPNADEPTAADNQNEPYLQYYEYLLSKPNSHLPQVISNSYGDDEQTVPEYYARRVCNLIGLMGLRGITVLESSGDTGIGSACMSNDGTNKPQFTPTFPGTCPFITAVGGTQSYAPEVAWDGSSGGFSNYFSRPWYQSFAVDNYLNNHITKDTKKYYSQYTNFKGRGFPDVSAHSLTPYYEVVLTGKHYKSGGTSAASPVFAGIVGLLNDARLRAGKSTLGFLNPLLYSILAEGFTDITAGSSIGCNGINPQTGKPVPGGGIIPYAHWNATAGWDPVTGLGVPDFMKLKELVLSL

SEQ ID NO: 25010 - protein, 214 aa, Neosartorya fumigata [sequence omitted]

SEQ ID NO: 25011 - protein, 769 aa, Neosartorya fumigata
  strain ATCC MYA-4609 / Af293 / CBS 101355 / FGSC A1100
MHSNVGLAGLAGLLATASVCLSAPADQNITSDTYFYGQSPPVYPSPEGTGTGSWAAAYAKAKKFVAQLTPEEKVNLTAGTDANNGCSGNIAAIPRLNFPGLCVSDAGNGLRGTDYVSSWPSGLHVGASWNKALARQRAVQMATEFRKKGVNVLLGPVVGPLGRVAEAGRNWEGFSNDPYLSGALVYETVDGAQSVGVATCTKHYILNEQETNRNPGMEDGVEVAAVSSNIDDKTMHELYLWPFQDAVLAGSASIMCSYNRVNNSYGCQNSKTLNGLLKTELGFQGYVMTDWGAQHAGIAGANAGLDMVMPSTETWGANLTTAISNGTMDASRLDDMATRIIASWYQMNQDSDFPSPGAGMPSDMYAPHQRVIGRDASSKQTLLRGAIEGHVLVKNNHSALPLKSPQLLSVFGYDAKGPNALKQNFNWLSYSPAIQENHTLWVGGGSGANNAAYIDAPIDAIQRQAYEDGTSVLYDISSEDPEVDPTTDACLVFINSYATEGWDRPGLADNSSDTLVKNVARKCANTIVTIHNAGIRVVGEWIDHENVTAVIFAHLPGQDSGRALVELLYGRANPSGKLPYTVAKKVEDYGSLLHPSLPETPYGLFPQSDFDEGVYIDYRAFDRANITAQFEFGFGLSYTSFDYSGLQISNPKQSPQYPPSAAIQQGGNPHLWDNIVTVSAEIKNTGRVAGAEVAQLYIGIPNGPVRQLRGFEKVDVSAGETTQVQFALNRRDLSTWDVEAQQWSLQRGTYRVYVGRSSRDLPLTGSFTL

SEQ ID NO: 25012 - protein, 658 aa, Neosartorya fumigata
  strain ATCC MYA-4609 / Af293 / CBS 101355 / FGSC A1100
MRFAIPLGAACAWAGVALAALQIAEDFSSITLNNDRFKAVWSKSKGSVVDMFLDGQDLLGPQSGSTGIGPYLDCYCVPSGFYTAGATNPRMQYVEGTDSTGTKYAGVILNDTYTPTGQQFQQYWFLRDGETGLHMFSRLAYYNETTPFLRNLQEFRTLFRPNTQLWTHLTSSELQTAPLPSKNAVSKQVVVQDATWRFNNTPDDAYYTQFSEYFTKYTFSNQWRDNDVHGLYGDGTNSNGSTYGAWLVMNTKGPLHSDLTVDGIVYNYIVSNHHGEGTPNITNGFDRTFGPQFYLFNGGKGSTSSLQDLRSEAAKLADPSWNAEFYDSIAKHVVGYVPSSKRGSVDGRIKLPKGASNPIAILTVDGQYFQDNSVVPSSYQYWTDIDTSGRFRIDRVVEGKYRLTVYADGIFGDFVRDGVTVRAGKTTTVKEKWDAESAGKEIWRLGTPDKSSGEFRHGVARDPTHPLHPPEYLIYWGAYDWQSDFPKGIDYTIGSSDPATDFNTVHWSVFGPTPDNPNVEYNTTHDWKINFSLTKKQLRNSKKATLTIQLAGAKTASGNTDEYKASEPYINLIHESYINDQKEPLSFVIGFNQSSSCIVRSAVSCYQVRSRMEFPADWLKVGENTLTLHLPYNATDTETAILPATVYVQYDALRLELD

SEQ ID NO: 25013 - protein, 378 aa, Neosartorya fumigata
  strain ATCC MYA-4609 / Af293 / CBS 101355 / FGSC A1100
MLKLMGSLVLLASAAEVIASPAAEPVAPSTTLEKRAPCTFSGSNGAAAAMASQKACSTIVLSNVAVPAGTTLDLSDLADGTTVTFEGETTWGYQEWSGPLLKISGKNIKVKGASGATLNPDGARWWDGQGGNGGKTKPKFFAAHDLTSSSSITDLHILNTPVQAVSINGCDGLTITDITIDNSAGDTQGGHNTDAFDIGSSSNIIISGAKVYNQDDCVAVNSGTDITFTGGLCSGGHGLSIGSVGGRSDNTVENVSFTNSQVTNSDNGLRIKATKGKTGTIKGVTYSGITLSSIRKYGILIEQNYDGGDLKGDPTSGIPITDLTMQNISGKGAVASSGYNIAIVCGSGACSNWTWKSVEVTGGKTYGSCKNVPSVAQC

SEQ ID NO: 25014 - protein, 792 aa, Neosartorya fumigata
  strain ATCC MYA-4609 / Af293 / CBS 101355 / FGSC A1100
MSVAKSIAAVLVALLPGALAQANTSYVDYNVEANPDLTPQSVATIDLSFPDCENGPLSKTLVCDTSARPHDRAAALVSMFTFEELVNNTGNTSPGVPRLGLPPYQVWSEALHGLDRANFTDEGEYSWATSFPMPILTMSALNRTLINQIATIIATQGRAFNNVGRYGLDVYAPNINAFRSAMWGRGQETPGEDAYCLASAYAYEYITGIQGGVDPEHLKLVATAKHYAGYDLENWDGHSRLGNDMNITQQELSEYYTPQFLVAARDAKVHSVMCSYNAVNGVPSCANSFFLQTLLRDTFGFVEDGYVSSDCDSAYNVWNPHEFAANITGAAADSIRAGTDIDCGTTYQYYFGEAFDEQEVTRAEIERGVIRLYSNLVRLGYFDGNGSVYRDLTWNDVVTTDAWNISYEAAVEGIVLLKNDGTLPLAKSVRSVALIGPWMNVTTQLQGNYFGPAPYLISPLNAFQNSDFDVNYAFGTNISSHSTDGFSEALSAAKKSDVIIFAGGIDNTLEAEAMDRMNITWPGNQLQLIDQLSQLGKPLIVLQMGGGQVDSSSLKSNKNVNSLIWGGYPGQSGGQALLDIITGKRAPAGRLVVTQYPAEYATQFPATDMSLRPHGNNPGQTYMWYTGTPVYEFGHGLFYTTFHASLPGTGKDKTSFNIQDLLTQPHPGFANVEQMPLLNFTVTITNTGKVASDYTAMLFANTTAGPAPYPNKWLVGFDRLASLEPHRSQTMTIPVTIDSVARTDEAGNRVLYPGKYELALNNERSVVLQFVLTGREAVVFKWPVEQQQISSA

SEQ ID NO: 25015 - protein, 1015 aa, Neosartorya fumigata
  strain ATCC MYA-4609 / Af293 / CBS 101355 / FGSC A1100
MAHIYRLLLLLLSNLWFSTAAQNQSETEWPLHDNGLSKVVQWDHYSFQVNGQRIFIFSGEFHYWRIPVPELWRDILEKVKATGFTAFAFYSSWAYHAPNNSTVDFSTGARDITPIFELAKELGMYMIVRPGPYVNAEASAGGFPLWLMTGEYGSLRNDDPRYTAAWTPYFANMSQITSKYQVTDGHNTLVYQIENEYGQQWIGDPKNRNPNKTAVAYMELLEASARENGITVPLTSNDPNMNSKSWGSDWSNAGGNVDVAGLDSYPSCWTCDVSQCTSTNGEYVPYKVIDYYDYFQEVQPTLPSFMPEFQGGSYNPWAGPEGGCPQDTSAEFANLFYRWNIGQRVTAMSLYMLYGGTNWGAIAAPVTATSYDYSAPISEDRSIGAKYSETKLLALFTRTAKDLTMTEAIGNGTQYTTNTAVRAFELRNPQTNAGFYVTFHTDTTVGGNQAFKLHVNTSVGALTVPKNEGLIQLNGHQSKIIVTDFTLGKRTLLYSTAEVLTYAVFENRPTLVLWVPTGESGEFAIKGAKSGKVENGDGCSGIKFKREKDYLVVNFSQAKGLSVLRLDNGVRVVLLDKAAAYRFWAPALTDDPNVQETETVLVHGPYLVRSASISKTTLALRGDSVEKTTLEIFAPHSVRKITWNGKEVQTSHTPYGSLKATLAAPPDIKLPALTSWRSNDSLPERLPSYDDSGPAWIEANHMTTSNPSPPATFPVLYADEYGFHNGVRLWRGYFNGSASGVFLNIQGGSAFGWSAWLNGHFLDSHLGTATTSQANKTLTFPSSILNPTENVLLIVHDDTGHDQTTGALNPRGILEARLLSNDTSSPPPEFTHWRLAGTAGGESNLDPIRGVFNEDGLFAERMGWHLPGFDDSAWTSENSATSASSALSFTGATVRFFRSVVPLNIPAGLDVSISFVLSTPTAAPKGYRAQLFVNGYQYGRYNPHIGNQVVFPVPPGILDYQGDNTIGLAVWAQTEEGAGIQVDWKVNYVADSSLSVAGFGKGLRPGWTEERLKFA

SEQ ID NO: 25016 - protein, 881 aa, Neosartorya fumigata
  strain ATCC MYA-4609 / Af293 / CBS 101355 / FGSC A1100
MLRSLLLLAPLVGAAVIGARDHSQECPGYKATNIREGRDSLTADLTLAGKPCNTYGTDLKNLKLLVEYQTDKRLHVKIYDADEEVYQVPESVLPRVDGKGGSSKKSALKFDYQANPFSFKVKRGGEVLFDTSGSNLIFQSQYLSLRTWLPEDPNLYGLGEHTDSLRLETTNYTRTLWNRDAYAIPEKTNLYGTHPVYYDHRGQHGTHGVFLLNSNGMDIKIDKTKDGKQYLEYNTLGGVFDFYFFTGATPKDASIEYAKVVGLPAMQSYWTFGFHQCRYGYRDVFEVAEVVYNYSQAKIPLETMWTDIDYMDRRRVFTLDPERFPLEKMRELVSYLHNHNQHYIVMVDPAVSVSDNVGYNDGMEQGIFLQTQNGSLYKGAVWPGVTAYPDWFHPDIQKYWNDQFAKFFDPKTGVDIDGLWIDMNEAANFCPYPCSDPEGYARDNDLPPAAPPVRPSNPRPLPGFPGDFQPSSSSKRSTKGSKVGLPNRDLINPPYMIRNEAGSLSNKTINTDIIHAGEGYAEYDTHNLYGTMMSSASRNAMQHRRPGVRPLVITRSTYAGAGAHVGHWLGDNISEWSKYRISISQMLAFASMFQVPMIGSDVCGFGGNTTEELCARWARLGAFYTFFRNHNEITGIPQEFYRWPTVAESARKAIDIRYRLLDYIYTAFHRQTQTGEPFLQPMFYLYPKDKNTFSNQLQFFYGDAILVSPVTDGSQTSVDAYFPDDIFYDWHTGAALRGRGANVTLSNIDVTEIPIHIRGGSIIPVRSESAMTTTELRKKGFELIIAPGLDGTASGSLYLDDGDSIEPRATLELEFTYRKGHLQVKGKFGFRTEVKINAVTLLGQSAPASKSADVASLDSGRQAVTIKTSLDLTGPSEIDLS

SEQ ID NO: 25017 - protein, 439 aa, Neosartorya fumigata
  strain ATCC MYA-4609 / Af293 / CBS 101355 / FGSC A1100
MSIDVNWRFATSGPDGEALAERIRSFIHDRFQQVALPRFIRSVQVHAFDFGTIPPELEIKDFCEPFADFYEEDDDDHTSDASEERGEEHSSRWNSTHPELNEPSYREDTAVNHSLRDPFPDGFPTSPLRSPLGEHLNPHFLPRASTPGIPGGTSTLGYHLMSLGGLSGTQTPLAAVAGGNPFASGWSDSGMGPGNRGRSETHAGMQHPRAEPEIDTSNSTSRPSTANTLPSHPSGSSKNSGQAATGRNDHPSLHAGEHLEDSVTQGQLPLPPRMRERRPEDFQVLCHVKYAGDVRLSLTAEILLDYPMPSFVGLPLKLNVTGITFDGVAVIAYIRKRVHFCFLSAEDADALIGPEQQQQRESAGDDHRPQSRPDSSASASQKRHGGLLQEIRVESEIGRKEDGKQVLKNVGKVERFVLAQVRRIFEEELVYPSFWTFLI

SEQ ID NO: 25018 - protein, 1006 aa, Neosartorya fumigata
  strain ATCC MYA-4609 / Af293 / CBS 101355 / FGSC A1100
MKLLSVCAIALLAAQAAGASIKHMLNGFTLMEHSDPAKRELLQKYVTWDEKSLFVNGERIMIFSGEVHPFRLPVPSLWLDVFQKIKALGFNCVSFYVDWALLEGKPGEYRAEGNFALEPFFDVAKQAGIYLLARPGPYINAEASGGGFPGWLQRVNGTLRTSDPAYLKATDNYIAHVAATIAKGQITNGGPVILYQPENEYSGACCDATFPDGDYMQYVIDQARNAGIVVPLINNDAWTGGHNAPGTGKGEVDIYGHDSYPLGFDCGHPSVWPKGNLPTTFRTDHLKQSPTTPYSLIEFQAGSFDPWGGPGFAACAALVNHEFERVFYKNDLSFGAAILNLYMTFGGTNWGNLGHPGGYTSYDYGSPLTESRNVTREKYSELKLIGNFVKASPSYLLATPGNLTTSGYADTADLTVTPLLGNGTGSYFVVRHTDYTSQASTPYKLSLPTSAGRLTVPQLGGTLTLNGRDSKIHVVDYNVAGTNIIYSTAEVFTWKNFGDSKVLILYGGPGEHHELAVSLKSDVQVVEGSNSEFKSKKVGDVVVVAWDVSPSRRIVQIGDLKIFLLDRNSVYNYWVPQLDKDDSSTGYSSEKTTASSIIVKAGYLVRTAYTKGSGLYLTADFNATTPVEVIGAPSNVRNLYINGEKTQFKTDKNGIWSTEVKYSAPKIKLPSMKDLDWKYLDTLQEVQSTYDDSAWPAADLDTTPNTLRPLTTPKSLYSSDYGFHTGYLIYRGHFVADGSETTFDVRTQGGSAFGSSVWLNESFLGSWTGLNANADYNSTYKLPQVEQGKNYVLTILIDTMGLNENWVVGTDEMKNPRGILSYKLSGRDASAITWKLTGNLGGEDYQDKIRGPLNEGGLYAERQGFHQPQPPSQKWKSASPLDGLSKPGIGFYTAQFDLDIPSGWDVPLYFNFGNSTKSAYRVQLYVNGYQYGKFVSNIGPQTSFPVPQGILNYQGTNWVALTLWALESDGAKLDDFELVNTTPVMTALSKIRPSKQPNYRQRKGAY

SEQ ID NO: 25019 - protein, 320 aa, Neosartorya fumigata
  strain ATCC MYA-4609 / Af293 / CBS 101355 / FGSC A1100
MRYSWLIGAVCAAGALAKPVDKRSYVTDWTIVTVTETITLPYQPPPTSTPAYSPIQAVQLTQTVTTVDPAPAPAPVEPETSSASPIPTTEAVNTAPVGVVEELPGAAAWASAWTSAWTSAWTSAWTSSAPEAAQPTTLATSTSTTAPASVPTAAGSNAYQSAVLYNHNIHRSNHSASSMTWNTTLESSAYELASRCVYQHDTDIGGGGYGQNIGYGVSADEIGVMITNLMYNDEFGYYDGLYGQANPDMTYFEKWGHFSQIVWKSSVSVGCATVVCNSLGNVDSSQPSPFTVCNYYPPGNFAGEYADNVLAPLGHAFYSA

SEQ ID NO: 25020 - protein, 725 aa, Neosartorya fumigata
  strain ATCC MYA-4609 / Af293 / CBS 101355 / FGSC A1100
MFRVGSWLYGKKPAANASTQSLDSLVELRDLEDAMRAATLILNDDVDGAEAGLAEGTSAFHNLGRGVVAFIRATLGFEQDIMRQASERLNEAETSASVDQHRAQHNSYAPNTYHSPMYLPGTEFALCQAIAQLMSAIVGVLNESLTESIKAFYRLRKAYITLDAILKMEQKYMEESRAATLVESTTSGSVPSSLRHSSSNLHSSSSSISSAKGKEAAADTLAAPSNDTDVQERLADLNLSGEPAVAEDPGQTPTPINTDILDHDPDSDIFQNQIDVFVHSGSNFCFGVLLLLISMVPPSFSKLLSIIGFHGDKERGLKMLWQASKFHNLIGGIAAFAILGYYNGFVRYCDIMPDSIPGKDGDVQGYPQKRLELLLAKMRERFPKSQLWLLEESRMSGANKNLDRALELLCGEERSPLKQVEALRVFERSLNAMYLHKYELCADSFLECVDLNSWSRSLYYYIAGSCHLSLYRDAKETDSAKAAKHAELAEKYFRMAPTVAGKKRFMARQLPFDVFVARKFAKWEARAKEWKVSLVDAVGVDPIEEMIFFWNGHSRMTDEQLQESLQKLAWSESSANTTWSREGPEEKAILKLLRAAVHRSLRKHTQAKEMLEDILGQDRTLFKGHLKDDWICPVAHFEMAANLWMERPTYIATHGGAKQDSNKESARPASVNDALQYEREKVRKCKEYLEKAAKWESYELDARIGLKVTAAMEAVQKWESTHPTL

SEQ ID NO: 25021 - protein, 505 aa, Neosartorya fumigata
  strain ATCC MYA-4609 / Af293 / CBS 101355 / FGSC A1100
MTTFTKLSEQETPSISVHASRRISKINPNIYAGFTEHMGRCIYGGIYDPGNPLSDENGFRKDVLEALKELNIPVIRYPGGNFTATYHWIDGVGPKDQRPARPELAWLGTETNHFGTDEFMKWCELLGTEPYFCLNFGTGTLDEALAWVEYCNGTKDTYYANLRRKNGREEPYNIKYWALGNEVWGPWQVAQMTKEEYAHKAYQWAKALKLLDPSLKLILCGQDGTASWDYYTLKQCLLPAHSPLSTSTVPLIDMHSIHMYTCGSTHLPNVTAPLAAERAIEITSSLIDLAMIENGIPPDQPRPTICFDEWNVWDPLRAEGSKGAEESYTLSDALAVAIWLNVFVRKSKDVGMACIAQSVNVISPLMTTKDGIIKQTIWWPLYLFSKYMRGWTINAHVSCGAYEGETSPKWIRAVKDTPWLDVSATLGEDGYANVAVVNISDEKDMECKFEGATGDVTVFTVTGDSVSACNMKGKEEVGLTESTWDGKGAYKFPRHSLTLLRWKAE

SEQ ID NO: 25022 - protein, 838 aa, Neosartorya fumigata
  strain ATCC MYA-4609 / Af293 / CBS 101355 / FGSC A1100
MVQLDVEKTIEELTLGEKVALTAGIDFWHTAAVPRLNIPSLRMSDGPNGVRGTRFFNGVPAACFPCATALGATWDTKLLYEVGRLMGEESIAKGAHVVLGPTINTQRSPLGGRGFESFAEDGVLSGILAGHYCKGLQETGVAATLKHFVCNDQEHERLAVDSIVTMRAMREIYLLPFQLAMRICKTACVMTAYNKVNGTHVSENKQIITDILRKEWGWDGLVMSDWFGTYSTCDAINAGLDLEMPGPTRWRGTALAHAVSSNKAFEFVMDERVRNILNLHNFVEPLGIPENAPEKALNRPEDQALLRRAAAESVVLIKNQDNILPLKKEKPILVIGPNAKTAAYCGGGSASLDAYYTVTPFEGVAAQSQGEVTFSQGVYSYKELPLLGPLLKTDDGKKGFKFRVYNEPPSEPNRQLIDELHLESSSGFLMDYKHPKIKTFTFYVDMEGYFTPEEDGIYDFGVTVVGTGKLFVDDELVVDNSKNQRQGTAMFGNATVEEKGSKELKAGQTYKVVLQFGTAPTSDLDMRGVVIFGPGGFRFGAARRVSQEELISKAAELASQTSQVVIFAGLTSEWETEGYDRDHMDLPPGSDEMISRVLDANPDTVVVIQSGTPVTMPWAHKAKALLQAWFGGNECGNGIADVLYGNVNPAAKLPLSFPVRLQDNPSYLNFRSERGRVLYGEDIYVGYRYYEKVDLAPLFPFGHGLSYTTFSRSDLSLATTPEKPQLEDGEPITVTVSVTNTGSVAGAEIVQLWVAPPPTGVNRPVRELKGFTKVFLQPGETKKVEIVVEKKLATSWWDEQREKWASEKGTYEVLVTGTGDEVLKSSFEVEKTRYWLGL

SEQ ID NO: 25023 - protein, 380 aa, Neosartorya fumigata
  strain ATCC MYA-4609 / Af293 / CBS 101355 / FGSC A1100
MRYTSLFTAVTAALASTAAAVGVSGAAEGFAKGVTGGGNASPVYPKTNDELVSYLGDSQARVIVLTKTFDFRGTEGTTSGTGCAPWGTNAKCQLAINQNSWCDNYQPNAPKVSVSYDNAGVLGITVNSNKSLIGQGSAGVIKGKGLRIVSGAKNVIIQNIAITDINPKYVWGGDAITINNADLVWIDHVTTARIGRQHIVLGTQADNRITISNCYIDGVTDYSATCNGYHYWGIYLDGSNDMVTMKGNYIYHTSGRSPKVQGNTLLHAVNNYWYDNAGHAFEIGSGAYVVAEGNVFQNVKAVAESPISGKLFSSPDASTNKVCSSYLGHTCQINGFGSSGAFSQADTDILSKFKGKNIASAAAYNTVVSSVTANAGNGKL

SEQ ID NO: 25024 - protein, 521 aa, Neosartorya fumigata
  strain ATCC MYA-4609 / Af293 / CBS 101355 / FGSC A1100
MRLHAFTLLSLLGLVPSFAAASLSGSVGPLTSASAKAAKKTCNVLDYGAKADKKTDLGPPLAAAFAACKSGGLVYIPAGDYAMSTWVKLANGKAWALQIDGVIYRTGTDGGNMIMIEHTSDFELYSSTSSGAMQGLGYEFHASNNWSGPRLLRLWDVSDFSVHDLILVDSPSFHFSIDTCSNGEVYNMAIRGGNHGGLDGVDVWSTNIWIHDLEVTNKDECVTVKSPAKNILVENIYCNLSGGCAMGSLGADTDISDITYKNIYTWNSNQMMMIKSNGGSGTVSNVVFENFIGHGNAYSLDIDSFWSSMSAVSGDGVTLNNITIKNWKGTEANGAQRGPIKIICPDKVPCYNILIEDFAMWTETGSKQWYSCQSAYGSGFCLKSGSHHTSYAVTTTTVSSAPSGYSAAKMASDLSTDSGSTKSIPIPTIPTSFYPGATPYSALMSKQSTKAAKARAVDMSVETPAAASRSEQVVQGAPQETGQSAPESAGPVPSGNPGPVPTGGSRPSRHRHGHHHFGSAI

SEQ ID NO: 25025 - protein, 658 aa, Neosartorya fumigata
  strain ATCC MYA-4609 / Af293 / CBS 101355 / FGSC A1100
MATQRRDESPSGLSDIVEPDGLLGIGLTSRHIEAFGRKVTSTAGHLMGPITDSSNGSHYHTAMADIHRELRRPTTQRKVFSLTQTSPTDLVRSKLSTSEIQSRALSSVPDELLANIPEDSSSYSLFEGFKATQDDHEFRKAHRRRSSKGKKLLKDGEAAGALPSAPTDLKKERDLLSRRLDLMGVRKNMCSSEIHEIDNKIANLHNIRKIVLDRLAGLEMEEAELEHQLTEIDNKLEDIQEEAPKTPLTAATPKSSSVNDDSVVSEDAALDASFMSESIYQKLPSHSPRSLKQRSIRKRSMPILHEHFAPGSQIKEMQAHTDMVTAIDFDYPFGTMVSAALDDTVRVWDLNTGRCTGFLEGHNASVRCLQVEDNIVATGSMDASVKLWDLSRARTVTRDNRLNKPSEGEGEDDNASDAFSLFSATTLEDCYVFSLDAHVDEVTALHFRGNTLISGSADKTLRQWDLVKGRCVQTLDVLWAAAQASTLAADTQWRPSGRLPDASADFVGALQCFDAALACGTADGMVRLWDLRSGQVHRSLVGHTGPITCLQFDEVHLVTGSQDRSIRIWDLRMGSIFDAYAYDKPITSMMFDTKRIVAAAGENVVKVYDKADGHHWDCGAGVGADESGPAPATVERVRLKDGYLLEGRKDGTVAAWTC

SEQ ID NO: 25026 - protein, 471 aa, Neosartorya fumigata
  strain ATCC MYA-4609 / Af293 / CBS 101355 / FGSC A1100
MLDFMDYIQLAFAEATNWNCDNSYSSLTATAQSLLDFSTPERLRVHLSSLATPHFATSYTLGTVGLIDGSVSYLYSTVPLNNTPSRSALIPLRKLARGYRQVQPPVAPVEDCGWQSCLGGLGSSESKPSGNDDSQPSPGRKATLLNATLHLPPPTILNALFLRRMSPTMQLSLAVCSTRGAPLSNSAPQASLLGQLSHDTGKYSNEYLFSTDNSLFGWRGLWNFGPDPRHPKENSSPQLSLLSAGAEAYYSPVSSLIGMSTGLRFSTLPAATEMPSSSSSASSTTTTSNHDTPISTFPYTLTLVLTPLTGSLSTTYSLRASPNLAFSSRFGFNVYSWESEMVAGCELWRKRRKPSPPPVDDDGLEWARRKMRMADTPAFAPVEPPTTHNRDEENESVLKIRVDQSWNVRLLWEGRVKELLVSAGVGLGPSSFSSPSRAANSTPAGGGQSVGGGISGRSYWHGVGVSISYSS

SEQ ID NO: 25027 - protein, 532 aa, Neosartorya fumigata
  strain ATCC MYA-4609 / Af293 / CBS 101355 / FGSC A1100
MDTTKSLLSTLIAIMIPLSLGSVSSPNLLPTPPMGFNNWARFMCDLNETLFLETASAMISTGLLEAGYNRVNLDDCWMAYDRAADSSLQWNTTKFPHGIPWLARHLKAQGFHVGIYEDAGNLTCGGYPGSFGHEALDAQTFAAWGIDYLKLDGCNVFPEHSRTLEEEYKARYAHWHSILKQMHHPLIFSESAPAYFADPANLTSWYEVMDWVPAFGELARHSTDILVYVGEGSAWDSIMVNYRYNTLLARYQRPGYINDPDFLIPDHPGLTLEEKRSQFALWASFSAPLIVSAYIPGLSSEELAILRNEELIRVDQDVLGLQATLASRGLEVDVLTRSLEGGDRLLTVLNRGDGVAVVSVPVEWMGLQRGCPYVVKNLWDGEVQVLEEEIVIRLNSHATQVYRIALPDECSTVIPTGIVFNTASGNCLTDENGERVGFEACRGSETQIWQVSELGYLRPLSRTSHCLTGGSQASVQLCTEQKNQQWAYAITGILKNEHTEMCLTEGTGISQCGFERDSQVFGLPSGVDIKPS

SEQ ID NO: 25028 - protein, 840 aa, Neosartorya fumigata
  strain ATCC MYA-4609 / Af293 / CBS 101355 / FGSC A1100
MWSGIPIFALLSSIGIAAAETGLDGWLRYASVPCNGNCQRALPSHIVTLNSTRSSPVYVAGQELQDGLHQILGKHASVKSTGCSTDSSIIVGTVEAYRQVCNAGRQVPQFDVDGFWLSIREKSVLIVGQSERGALYGAYEYLSMLAQGNFSQVSYATSPHAPIRWVNQWDNMDGSIERGYGGPSIFFKDGVIRQDLSRVQQYARLLASVRINGIIVNNVNANASLLMPSNMDGLARIADIFRPYGIRVGISLNFASPSTLGNLSTYDPFDSSVIAWWGNVTDQLYARIPDMAGYLVKANSEGQPGPTTYNRTLADGANMFARALKPYGGVVMFRAFVYDHHISEDNWYNDRANAAVDFFKPLDGKFDDNVVVQIKYGPIDFQVREPASPLFANLYKTNTAIELQVTQEYLGQQSHLVYLPPLWQTILGFDLRVDQKPSLVRDIISGQRFDRPLGGWAAVVNVGTNSTWLGSHLAMSNLYAYGRLAWEPTLDSEDIVQDWIRLTFGLDRRIVDTLTQMSMESWPAYENYSGNLGIQTLTDILYTHYGPNPASQDGNGWGQWTRADHLSIGMDRTVKNGTKFSGQYPAEVAAMYENIETTPDNLLLWFHHVNYTQRLHSGKTVIQHFYDAHYTGAETAQTFVSQWESLRERIDAERYQHVLTRLIYQAGHSIVWRDAINNFYHNLSGIADEKQRVGHHPWRVEAEDMQLDGYVPYAVSPFETASNYTAIVTASNGTTGTASATLDFKTGTYDLGINYYDMYGGKSHWTVYLNDRVVGQWQGNSEDVLSHTPSIYLDGHSATRITFRDVKIHKGDRLKIVGKPDGVEPAPLDYVVVLPPGIVD

SEQ ID NO: 25029 - protein, 143 aa, Neosartorya fumigata
  strain ATCC MYA-4609 / Af293 / CBS 101355 / FGSC A1100
MVLIIEIIKIGQIGPIGQRGQSGQRGQSGQRGQSGQIGQSGQSGQSGQIGQIGQIGQIGQIGQIGQIGQIGQIGQIGQIGQIGQIGQIGQIGQIGQARRTGRTGRTVHRRMLQASSSFNISPDISICRRATRNMGEEERPLGC

SEQ ID NO: 25030 - protein, 440 aa, Neosartorya fumigata
  strain ATCC MYA-4609 / Af293 / CBS 101355 / FGSC A1100
MLITNPALLGILASLVPLALGAPNQPIQARSRKCVIPSSYASSHGTADDSPAVASAFAQCAENSVIVFQEGVDYNIFHPIKATNLSNVEIRVLGNLHLPQDITAVQNIVKSGQSTWFTFQGPRVDWTGADDIKNGWINSYGQAWWDANPANSSSFPNRPHLMSYKTSQASIKNFRSRKPIAWNVKLQGDDITVSHAIVDATSTGGFPFNTDGFDVEGTNISITDSVMFNGDDAIAVNTPSHNIVFARNTIGYQSHGMSIGSLGKDPTDFANITNLRFEDVTVIDALYAARFKSWSGGRGLVKNVVWKNIRTFNVTFPIFVTQSYSDQSASRSGTIDPFSSVMMEDFTWSDFSGTINTYHPGDGSCVTDPCWYNVGLPNLKHTEAIVLECNTESSCKNFRTEGIRLHPQSKDSPSVICMKATAELNPKLGFECKNGTFVPH

SEQ ID NO: 25031 - protein, 321 aa, Neosartorya fumigata
  strain ATCC MYA-4609 / Af293 / CBS 101355 / FGSC A1100
MSASVFVVVASCLAALAHGYANPGSCLGACNVHDPALIRRESDGKYFRFSTGNKISYASSSSIEGPWTVLGSVLPSGSSIDLPGNDDLWAPDVSLVNGVYHVYYSVSTFGSQSSAIGLATSSTMDLNSWTDHGSTGIQSSSSKPYNAIDGNLFKDGGTYYMNFGSFWHDIYQAPMNSAATSVASSSYNIAYNPSGTHAVEGAFMYKYGNYYYLFFSAGICCGYDTSRPASGEEYKIKVCRSTSATGNFVDANGVACTNGGGTVVLESHGNVYGPGGQGVFTDPSLGPILYYHYVDTTIGYADSQKLFGWNKIDFSSGWPVV

SEQ ID NO: 25032 - protein, 87 aa, Neosartorya fumigata
  strain ATCC MYA-4609 / Af293 / CBS 101355 / FGSC A1100
MKFSLACLLALAGLQAALADPATCEKEAQFVKQELIGQPYTDAVANALQSNPIRVLHPGDMITMEYIASRLNIQVNENNEIISAHCA

SEQ ID NO: 25033 - protein, 428 aa, Neosartorya fumigata
  strain ATCC MYA-4609 / Af293 / CBS 101355 / FGSC A1100
MHSLQSFLFLLLLGYGVFAAPTSPQAQSQGRSFKVERIKRGNSIHGPTALRRAYRKFGIVPTTFGVDLSDFVPFNTTSISGTAANLVTDVQEPEQTGAVSAQSVQNDAAFVSPVTIGGQKIVMNFDTGSADFWVMNTELPASAQVGHTVFDPSKSSTFKKMEGATFEIKYGDSSFANGGVGTDTVDIGGATVTGQAIGIPTSVSNSFVEDTYSNGLVGLGFSSLNTVQPQQQKTFFDNIADSLDKPVMTAHLKSDGVGEYEFGIIDQTKYQGDMINVTVDSSGGFWQFQSAHYKVGDGPIQTIQNNAVAIADTGTSLMLLDDTVVNAYYAQVKGAQYASSAGGYIYPCNTELPNLAVAVGAKHLATVPGTFLDFAEVGINKTTGQTVCFGGIQSNQGTSMQILGDVFLKAFFVVFDLRGPSIGLASPK

SEQ ID NO: 25034 - protein, 375 aa, Neosartorya fumigata
  strain ATCC MYA-4609 / Af293 / CBS 101355 / FGSC A1100
MKISATAVVLLAGLAAGAPTKTIQSKFEKRQFGTGTDGLGALASLFPTLGGGGSSTSSGLGALASLIPGLGGSSSGSGFSLPGFTLPTSIPGLGSLGSLGSSGSSGASGLSGLSGLSGLSGLSGLGGLSGLNGLGSSTTGSSAEASTSGTAATSSNSNSGGALFGLLGGEFPLFPRQPSRLLRYSDHVAKRGLLGSMTENGVKNKDACQPLTFIFARGTSELGNMGSVVGPPVATKLRSLLNNKVVVQGVDYPASVEGNALLGAAGGPTMASMVKQALSQCPDTKVVVGGYSQGAMVVHNAANSLSQGQIAAAVLFGDPFKSQAVGKVDKANVKEYCAAGDPVCLNGANVIAHLSYGSDAAEAAQFLVTASGVKA

SEQ ID NO: 25035 - protein, 372 aa, Neosartorya fumigata
  strain ATCC MYA-4609 / Af293 / CBS 101355 / FGSC A1100
MTVLVALFCLVTWTLCTRIPQYSTQGTQQPQQPEKTPHPHPQPEDAFPPTHATDLKIHDPSIIHVDGTYYSYSVGRHIRIHQAPSLDGPWERTGAVLNADSVIPKGDRKAPWAPQTVHHNDTYYCFYAVSNSGCRDSAIGVATSKSPGPGGWTDHGLLVQSGTGKGSDEHPFTSSNTIDPSVFVGEDGHGYLTFGSFWSGIWQVPLDESLLSVAGDTSSEARQLVYMEKAPLPASKHPNPLCREPSGARPIEGSFLSYHEPWYYLWFSYGKCCKFDTKNLPPPGREYSIRVGRSKSPRGPFVDKQGRDLANGGGEIVYASNRDVYAPGGQGVLTEKSGDILYYHYCRYPVIQEIEVDADLTVNKSTSYDFWV

SEQ ID NO: 25036 - protein, 309 aa, Neosartorya fumigata
  strain ATCC MYA-4609 / Af293 / CBS 101355 / FGSC A1100
MSALSSENINGVYIPSALLLFGTFIVKKEFVPYAVAVTAILAGLKLFTGGNKPRKVLNPTEFQEFVLKEKIDVSHNVCIYRFALPRPTDILGLPIGQHISLAATIEGQPKEVVRSYTPISSDNEAGYFDLLVKAYPQGNISKYLTTLKIGDTMKVRGPKGAMVYTPNMCRHIGMIAGGTGITPMLQIIKAVIRNRPRNGGNDTTKLDLIFANVNPDDILLKEELDMLAAEDPDFNIYYVLNNPPQGWTGGVGFVTPEMIKEHLPAPASDVKILLCGPPPMISAMKKATESLGYTKARPVSKLEDQVFCF

SEQ ID NO: 25037 - protein, 151 aa, Neosartorya fumigata
  strain ATCC MYA-4609 / Af293 / CBS 101355 / FGSC A1100
MPTLNYPDSSPLKPAELQVLRAQYEKEGDYVGIQTKFNYAWGLIKSNARTDQQEGVRLLSEIFRAAPERRRECLYYLALGNYKLGNYGEARRYNDLLLEKEPGNLQAASLGSLIDDKVSKEGLMGIAIVGGLALAAGIVGGLVFKGAAKRR

SEQ ID NO: 25038 - protein, 477 aa, Neosartorya fumigata; identical to SEQ ID NO: 24918
  strain ATCC MYA-4609 / Af293 / CBS 101355 / FGSC A1100

SEQ ID NO: 25039 - protein, 211 aa, Neosartorya fumigata
  strain ATCC MYA-4609 / Af293 / CBS 101355 / FGSC A1100
MKFALLSLAAMAVASPVAIDVRQTAITGDELRTGPCEPITFIFARGSTEPGLLGITTGPGVCNALKLSRPGQVACQGVGPAYIADLASNFLPQGTSQVAIDEAAGLFKLAASKCPDTKIVAGGYSQGAAVMHGAIRNLPSNVQNMIKGVVLFGDTRNKQDGGRIPNFPTDRTKIYCAFGDLVCDGTLIITPAHLSYGDDVPSATSFLLSKV

SEQ ID NO: 25040 - protein, 396 aa, Neosartorya fumigata
  strain ATCC MYA-4609 / Af293 / CBS 101355 / FGSC A1100
MIRRLAAFSALSGLATAWLPEVNKKITSTNGTNLFTSSNGKIRGVNLGSQFVFEPWIAEKAWSDMGCGGQKSEFDCVSRLGQANANSAFASHWGSWITQDDIAEMVSYGLNTIRVPVGYWMREDLVYSDSEHFPQGGLQYLENLCEWASDAGLYIIIDLHGAPGAQTPQNPFTGQYAPIAGFYQDYQFEGALKFLEWMTTNIHQNDKFRNVGMLEVVNEPVQDAGKVGSMRSSYYPNAFKRIRAAEQSLNIDRNNYLHIQMMDRLWGSGDPNESLTDTYYAAYDDHRYLKWASVAVSKDSYISTSCSDQLNSNTPTIVGEWSLSVPDNVQWNSDWSPDSNKDFYKKWFAAQVTAYERQQGWIFWTWKAQLGDYRWSYQGGLLLTRPGIGDQQVLTL

SEQ ID NO: 25041 - protein, 259 aa, Neosartorya fumigata
  strain ATCC MYA-4609 / Af293 / CBS 101355 / FGSC A1100
MNILQCLFTLLLLPCTLADVDFTVPTIGTNFKGGDVVTVHWCESGQPPRISELSQYDLSLYAGGDKADTQYEVAVLIKNGLFTRGNSVSIRIDPGVGGNEANAYFLKMVASGPEAFAINFSNRFTLSNMTGSFPPHLVDDIRSLSNSDGYAVKEELRKRGVGAAYAAYTVPYPLQSGPTKYAPMAKEPGSTIPVKTKAPAPQFTASVYTIATTRLPPATVQATLSASATYSIVSVENTASPAPHPHDAAMKRLMERWKD

SEQ ID NO: 25042 - protein, 644 aa, Neosartorya fumigata
  strain ATCC MYA-4609 / Af293 / CBS 101355 / FGSC A1100
MRLSHVLLGTAAAAGVLASPTPNDYVVHERRAVLPRSWTEEKRLDKASILPMRIGLTQSNLDRGHDLLMEISDPRSSRYGQHLSVEEVHSLFAPSQETVDRVRAWLESEGIAGDRISQSSNEQFLQFDASAAEVERLLGTEYYLYTHQGSGKSHIACREYHVPHSLQRHIDYITPGIKLLEVEGVKKARSIEKRSFRSPLPPILERLTLPLSELLGNTLLCDVAITPLCISALYNITRGSKATKGNELGIFEDLGDVYSQEDLNLFFSTFAQQIPQGTHPILKAVDGAQAPTSVTNAGPESDLDFQISYPIIWPQNSILFQTDDPNYTANYNFSGFLNTFLDAIDGSYCSEISPLDPPYPNPADGGYKGQLQCGVYQPPKVLSISYGGAEADLPIAYQRRQCAEWMKLGLQGVSVVVASGDSGVEGRNGDPTPTECLGTEGKVFAPDFPATCPYLTTVGGTYLPLGADPRKDEEVAVTSFPSGGGFSNIYERADYQQQAVEDYFSRADPGYPFYESVDNSSFAENGGIYNRIGRAYPDVAAIADNVVIFNKGMPTLIGGTSAAAPVFAAILTRINEERLAVGKSTVGFVNPVLYAHPEVFNDITQGSNPGCGMQGFSAATGWDPVTGLGTPNYPALLDLFMSLP

SEQ ID NO: 25043 - protein, 596 aa, Neosartorya fumigata
  strain ATCC MYA-4609 / Af293 / CBS 101355 / FGSC A1100
MAPFTFLVGILSLCICCIVLGAAAEPSYAVVEQLRNVPDGWIKHDAAPASELIRFRLAMNQERAAEFERRVIDMSTPGHSSYGQHMKRDDVREFLRPPEEVSDKVLSWLRSENVPAGSIESHGNWVTFTVPVSQAERMLRTRFYAFQHVETSTTQVRTLAYSVPHDVHRYIQMIQPTTRFGQPARHERQPLFHGTVATKEELAANCSTTITPNCLRELYGIYDTRAEPDPRNRLGVSGFLDQYARYDDFENFMRLYATSRTDVNFTVVSINDGLNLQDSSLSSTEASLDVQYAYSLAYKALGTYYTTGGRGPVVPEEGQDTNVSTNEPYLDQLHYLLDLPDEELPAVLSTSYGEDEQSVPESYSNATCNLFAQLGARGVSIIFSSGDSGVGSTCITNDGTKTTRFLPVFPASCPFVTAVGGTHDIQPEKAISFSSGGFSDHFPRPSYQDSSVQGYLEQLGSRWNGLYNPSGRGFPDVAAQATNFVVIDHGQTLRVGGTSASAPVFAAIVSRLNAARLEDGLLKLGFLNPWLYSLNQTGFTDIIDGGSSGCYVGTSNEQLVPNASWNATPGWDPVTGLGTPIYNTLVKLATSVSSTP

SEQ ID NO: 25044 - protein, 602 aa, Neosartorya fumigata
  strain ATCC MYA-4609 / Af293 / CBS 101355 / FGSC A1100
MFSSLLNRGALLAVVSLLSSSVAAEVFEKLSAVPQGWKYSHTPSDRDPIRLQIALKQHDVEGFETALLEMSDPYHPNYGKHFQTHEEMKRMLLPTQEAVESVRGWLESAGISDIEEDADWIKFRTTVGVANDLLDADFKWYVNEVGHVERLRTLAYSLPQSVASHVNMVQPTTRFGQIKPNRATMRGRPVQVDADILSAAVQAGDTSTCDQVITPQCLKDLYNIGDYKADPNGGSKVAFASFLEEYARYDDLAKFEEKLAPYAIGQNFSVIQYNGGLNDQNSASDSGEANLDLQYIVGVSSPIPVTEFSTGGRGLLIPDLSQPDPNDNSNEPYLEFLQNVLKMDQDKLPQVISTSYGEDEQTIPEKYARSVCNLYAQLGSRGVSVIFSSGDSGVGAACLTNDGTNRTHFPPQFPAACPWVTSVGGTTKTQPEEAVYFSSGGFSDLWERPSWQDSAVKRYLKKLGPRYKGLYNPKGRAFPDVAAQAENYAVFDKGVLHQFDGTSCSAPAFSAIVALLNDARLRAHKPVMGFLNPWLYSKASKGFNDIVKGGSKGCDGRNRFGGTPNGSPVVPYASWNATDGWDPATGLGTPDFGKLLSLAMRR

SEQ ID NO: 25045 - protein, 395 aa, Neosartorya fumigata
  strain ATCC MYA-4609 / Af293 / CBS 101355 / FGSC A1100
MYFKYTAAALAAVLPLCSAQTWSKCNPLEKTCPPNKGLAASTYTADFTSASALDQWEVTAGKVPVGPQGAEFTVAKQGDAPTIDTDFYFFFGKAEVVMKAAPGTGVVSSIVLESDDLDEVDWEVLGGDTTQVQTNYFGKGDTTTYDRGTYVPVATPQETFHTYTIDWTKDAVTWSIDGAVVRTLTYNDAKGGTRFPQTPMRLRLGSWAGGDPSNPKGTIEWAGGLTDYSAGPYTMYVKSVRIENANPAESYTYSDNSGSWQSIKFDGSVDISSSSSVTSSTTSTASSASSTSSKTPSTSTLATSTKATPTPSGTSSGSNSSSSAEPTTTGGTGSSNTGSGSGSGSGSGSSSSTGSSTSAGASATPELSQGAAGSIKGSVTACALVFGAVAAVLAF

SEQ ID NO: 25046 - protein, 728 aa, Neosartorya fumigata
  strain ATCC MYA-4609 / Af293 / CBS 101355 / FGSC A1100
MRLTFIPSLIGVANAVCPYMTGELNRRDEISDGDAAAATEEFLSQYYLNDNDAFMTSDVGGPIEDQNSLSAGERGPTLLEDFIFRQKIQRFDHERVPERAVHARGAGAHGVFTSYGDFSNITAASFLAKEGKQTPVFVRFSTVAGSRGSSDLARDVHGFATRFYTDEGNFDIVGNNIPVFFIQDAILFPDLIHAVKPRGDNEIPQAATAHDSAWDFFSQQPSTMHTLLWAMSGHGIPRSFRHVDGFGVHTFRFVTDDGASKLVKFHWKSLQGKASMVWEEAQQTSGKNPDFMRQDLHDAIEAGRYPEWELGVQIMDEEDQLRFGFDLLDPTKIVPEEFVPITKLGKMQLNRNPRNYFAETEQVMFQPGHIVRGVDFTEDPLLQGRLFSYLDTQLNRHGGPNFEQLPINQPRVPVHNNNRDGAGQMFIPLNPHAYSPKTSVNGSPKQANQTVGDGFFTAPGRTTSGKLVRAVSSSFEDVWSQPRLFYNSLVPAEKQFVIDAIRFENANVKSPVVKNNVIIQLNRIDNDLARRVARAIGVAEPEPDPTFYHNNKTADVGTFGTKLKKLDGLKVGVLGSVQHPGSVEGASTLRDRLKDDGVDVVLVAERLADGVDQTYSTSDAIQFDAVVVAAGAESLFAASSFTGGSANSASGASSLYPTGRPLQILIDGFRFGKTVGALGSGTAALRNAGIATSRDGVYVAQSVTDDFANDLKEGLRTFKFLDRFPVDH

SEQ ID NO: 25047 - protein, 397 aa, Neosartorya fumigata; identical to SEQ ID NO: 24991
  strain CEA10 / CBS 144.89 / FGSC A1163

SEQ ID NO: 25048 - protein, 829 aa, Neosartorya fumigata
  strain CEA10 / CBS 144.89 / FGSC A1163
MTPKFDIDYVLANITEDDKIALLSGSDFWHTHAIPKFNVPPIRTTDGPNGIRGTKFFAGVPAACLPCGTALGATWDRDLLHQAGVLLGKECLAKGAHCWLGPTINMQRSPLGGRGFESFAEDPHLSGIMAKSIILGCESTGVISTVKHYVGNDQEHERRAVDVLVTPRALREIYLRPFQIVARDAHPGALMTSYNKINGKHVVENPAMLDIVRKDWHWDPLIMSDWLGTYTTIDSLNAGLDLEMPGPTRYRGKYIESAMQARLIKQSTISKRARKVLEFVERASRAPVSADETGRDFPEDRALNRTLCANSIVLLKNDGNLLPIPKTVKKIALIGSHVKTPAISGGGSASLEPYYAVSLYDAVVEALPDAEILYEAGAYAHRMLPVIDRMLSNAVIHFYNEPPEKERTLLATEPVVNTAFQLMDYNAPGLNRALFWATLIGEFTPDVSGLWDFGLTVFGTATLFIDDEMVIDNATRQTRGTAFFGKGTVQEVGQKQLTAGQTYKIRIEFGSANTSPMKAIGVVHFGGGAAHLGACLHMDPEQMVANAVRVAAEADYTIVCTGLNRDWESEGFDRPDMDLPPGIDALISSVLDVAADRTVIVNQSGTPVTMPWAHRARGIVQAWYGGNETGHGIADVLFGDVNPSGKLPLSWPADVRHNPTYLNNMSVGGRMLYGEDVYIGYRFYEKVGREVLFPFGHGLSYTTFHVSPEATVSPIVFSSDSPPTATVLVKNTGPMAGAQTLQLYIAAPNSTTPRPVKELHGFTKVFLQSGEERSVSIHIDRYATSFWDEIEDMWKSEEGVYQVLIGTSSQEIVSRGEFRVEQTRYWRGV

SEQ ID NO: 25049 - protein, 420 aa, Neosartorya fumigata
  strain CEA10 / CBS 144.89 / FGSC A1163
MKLSAPLLVSLAAFSQAVTALVAFPGAEGFGANAIGGRNGQVYVVTNLNDSGTGSLRDAVSATDRIVVFAVGGVIKISDRIVVSKRVTILGQTAPGDGITVYGNGWSFSNADDAIVRYIRIRMGKGGSSGKDALGIAEGNRMIFDHVSVSWGRDETFSINGDASNITVQNSIIAQGLETHSCGGLMQTDGGVSLFRNLYIDNKTRNPKVKGVNEFTNNVVYNWGGGGGYIAGDSAGQSYANIIGNYFISGPSTSVTAFTRGNANFHGYVQNNYYDPDKDGQLDGFELGVSSSNYGGVAIMSSKYNYPAVAYTMSPAEAVTYVTKYAGASKVRDSVDTQLIAQVQSWGTEGGLISDEATMGGPGTLNGGTPAKDTDGDGIPDEAEKQLGTDPNTNDSMKLHSSGYTYLEVWANSLVPSTYH

SEQ ID NO: 25050 - protein, 1006 aa, Neosartorya fumigata
  strain CEA10 / CBS 144.89 / FGSC A1163
MKLLSVCAIALLAAQAAGASIKHMLNGFTLMEHSDPAKRELLQKYVTWDEKSLFVNGERIMIFSGEVHPFRLPVPSLWLDVFQKIKALGFNCVSFYVDWALLEGKPGEYRAEGNFALEPFFDVAKQAGIYLLARPGPYINAEASGGGFPGWLQRVNGTLRTSDPAYLKATDNYIAHVAATIAKGQITNGGPVILYQPENEYSGACCDATFPDGDYMQYVIDQARNAGIVVPLINNDAWTGGHNAPGTGKGEVDIYGHDSYPLGFDCGHPSVWPKGNLPTTFRTDHLKQSPTTPYSLIEFQAGSFDPWGGPGFAACAALVNHEFERVFYKNDLSFGAAILNLYMTFGGTNWGNLGHPGGYTSYDYGSPLTESRNVTREKYSELKLIGNFVKASPSYLLATPGNLTTSGYADTADLTVTPLLGNGTGSYFVVRHTDYTSQASTPYKLSLPTSAGRLTVPQLGGTLTLNGRDSKIHVVDYNVAGTNIIYSTAEVFTWKNFGDSKVLILYGGPGEHHELAVSFKSDVQVVEGSNSEFKSKKVGDVAVVAWDVSPSRRIVQIGDLKIFLLDRNSVYNYWVPQLDKDDSSTGYSSEKTTASSIIVKAGYLVRTAYTKGSGLYLTADFNATTPVEVIGAPSNVRNLYINGEKTQFKTDKNGIWSTEVKYSAPKIKLPSMKDLDWKYLDTLQEVQSTYDDSAWPAADLDTTPNTLRPLTTPKSLYSSDYGFHTGYLIYRGHFVADGSETTFDVRTQGGSAFGSSVWLNESFLGSWTGLNANADYNSTYKLPQVEQGKNYVLTILIDTMGLNENWVVGTDEMKNPRGILSYKLSGRDASAITWKLTGNLGGEDYQDKIRGPLNEGGLYAERQGFHQPQPPSQKWKSASPLDGLSKPGIGFYTAQFDLDIPSGWDVPLYFNFGNSTKSAYRVQLYVNGYQYGKFVSNIGPQTSFPVPQGILNYQGTNWVALTLWALESDGAKLDDFELVNTTPVMTALSKIRPSKQPNYRQRKGAY

SEQ ID NO: 25051 - protein, 416 aa, Neosartorya fumigata
  strain CEA10 / CBS 144.89 / FGSC A1163
MIFKFSQKALVALYLVVGLAEAVPSKSRVVSRASTFDYNGIVRGVNIGGWLVLEPWITPSIFDNAGDAAVDEWTLTATLGQDQAKAVLSQHWSTFITQDDFQQIAQAGMNHVRIPIGYWAVSSLPDEPYVDGQLEYLDNAISWAREAGLKVVIDLHGAPGSQNGFDNSGRKGPIAWQQGDTVSQTVDAFRALAERYLPQSDVVTAIEALNEPNIPGGVSEAGLRDYYNQIADVVRQIDPDTSVFLSDGFLSTESWNGFKTGEDVVMDTHHYEMFDNYLISLDIDGHVKSACDFGKQIEGSDKPVVVGEWSGAVTDCTKHLNGKGVSTRYQGEYANNVKYGDCANTTQGSVADLSDQERTDTRRFIEAQLDAYEGKNGWLFWTWKTEGAPGWDMQDLLANGVFPSPLTDRQFPNQCA

SEQ ID NO: 25052 - protein, 439 aa, Neosartorya fumigata; identical to SEQ ID NO: 25017
  strain CEA10 / CBS 144.89 / FGSC A1163

SEQ ID NO: 25053 - protein, 881 aa, Neosartorya fumigata; identical to SEQ ID NO: 25016
  strain CEA10 / CBS 144.89 / FGSC A1163

SEQ ID NO: 25054 - protein, 238 aa, Neosartorya fumigata
  strain CEA10 / CBS 144.89 / FGSC A1163
MKLSLSVALSLAAATAQAATQFCDQWGSVTEGNYILYNNLWGQAQATSGSQCTTFESLSGNTIVWNTKWSWSGGQGQVKSFANAALQFTPKKLSSVKSIDSTWKWNYSGSNIVADVAYDMFLSTSPGGDHNYEIMVWLGALGGAGPISSTGSPIATPTVAGIKFNLYLGPNGSMQVYSFVAQSTTNSFSGDMRDFFTYLESNQGLSSDLYLVDVQAGTEPFSGSNAVFTVSDYSVSVA

SEQ ID NO: 25055 - protein, 1015 aa, Neosartorya fumigata; identical to SEQ ID NO: 25015
  strain CEA10 / CBS 144.89 / FGSC A1163

SEQ ID NO: 25056 - protein, 792 aa, Neosartorya fumigata
  strain CEA10 / CBS 144.89 / FGSC A1163
MSVAKSIAAVLVALLPGALAQANTSYVDYNVEANPNLTPQSVATIDLSFPDCENGPLSKTLVCDTSARPHDRAAALVSMFTFEELVNNTGNTSPGVPRLGLPPYQVWSEALHGLDRANFTDEGEYSWATSFPMPILTMSALNRTLINQIATIIATQGRAFNNVGRYGLDVYAPNINAFRSAMWGRGQETPGEDAYCLASAYAYEYITGIQGGVDPEHLKLVATAKHYAGYDLENWDGHSRLGNDMNITQQELSEYYTPQFLVAARDAKVHSVMCSYNAVNGVPSCANSFFLQTLLRDTFGFVEDGYVSSDCDSAYNVWNPHEFAANITGAAADSIRAGTDIDCGTTYQYYFGEAFDEQEVTRAEIERGVIRLYSNLVRLGYFDGNGSVYRDLTWNDVVTTDAWNISYEAAVEGIVLLKNDGTLPLAKSVRSVALIGPWMNVTTQLQGNYFGPAPYLISPLNAFQNSDFDVNYAFGTNISSHSTDGFSEALSAAKKSDVIIFAGGIDNTLEAEAMDRMNITWPGNQLQLIDQLSQLGKPLIVLQMGGGQVDSSSLKSNKNVNSLIWGGYPGQSGGQALLDIITGKRAPAGRLVVTQYPAEYATQFPATDMSLRPHGNNPGQTYMWYTGTPVYEFGHGLFYTTFHASLPGTGKDKTSFNIQDLLTQPHPGFANVEQMPLLNFTVTITNTGKVASDYTAMLFANTTAGPAPYPNKWLVGFDRLASLEPHRSQTMTIPVTIDSVARTDEAGNRVLYPGKYELALNNERSVVLQFVLTGREAVIFKWPVEQQQISSA

SEQ ID NO: 25057 - protein, 378 aa, Neosartorya fumigata; identical to SEQ ID NO: 25013
  strain CEA10 / CBS 144.89 / FGSC A1163

SEQ ID NO: 25058 - protein, 658 aa, Neosartorya fumigata; identical to SEQ ID NO: 25012
  strain CEA10 / CBS 144.89 / FGSC A1163

SEQ ID NO: 25059 - protein, 769 aa, Neosartorya fumigata
  strain CEA10 / CBS 144.89 / FGSC A1163
MHSNVGLAGLAGLLATASVCLSAPADQNITSDTYFYGQSPPVYPSPEGTGTGSWAAAYAKAKKFVAQLTPEEKVNLTAGTDANNGCSGNIAAIPRLNFPGLCVSDAGNGLRGTDYVSSWPSGLHVGASWNKALARQRAVQMATEFRKKGVNVLLGPVVGPLGRVAEAGRNWEGFSNDPYLSGALVYETVDGAQSVGVATCTKHYILNEQETNRNPGMEDGVEVAAVSSNIDDKTMHELYLWPFQDAVLAGSASIMCSYNRVNNSYGCQNSKTLNGLLKTELGFQGYAMTDWGAQHAGIAGANAGLDMVMPSTETWGANLTTAISNGTMDASRLDDMATRIIASWYQMNQDSDFPSPGAGMPSDMYAPHQRVIGRDASSKQTLLRGAIEGHVLVKNNHSALPLKSPQLLSVFGYDAKGPNALKQNFNWLSYSPAIQENHTLWVGGGSGANNAAYIDAPIDAIQRQAYEDGTSVLYDISSEDPEVDPTTDACLVFINSYATEGWDRPGLADNSSDTLVKNVARKCANTIVTIHNAGIRVVGEWIDHENVTAVIFAHLPGQDSGRALVELLYGRANPSGKLPYTVAKKAEDYGSLLHPSLPETPYGLFPQSDFDEGVYIDYRAFDRANITAQFEFGFGLSYTSFDYSGLQISNPKQSPQYPPSAAIQQGGNPHLWDNIVTVSAEIKNTGRVAGAEVAQLYIGIPNGPVRQLRGFEKVDVSAGETTQVQFALNRRDLSTWDVEAQQWSLQRGTYRVYVGRSSRDLPLTGSFTL

SEQ ID NO: 25060 - protein, 873 aa, Neosartorya fumigata
  strain CEA10 / CBS 144.89 / FGSC A1163
MRFGWLEVAALTAASVANAQVFDNSHGNNQELAFSPPFYPSPWADGQGEWADAHRRAVEIVSQMTLAEKVNLTTGTGWEMDRCVGQTGSVPRLGINWGLCGQDSPLGIRFSDLNSAFPAGTNVAATWDKTLAYLRGKAMGEEFNDKGVDILLGPAAGPLGKYPDGGRIWEGFSPDPALTGVLFAETIKGIQDAGVIATAKHYILNEQEHFRQVGEAQGYGYNITETISSNVDDKTMHELYLWPFADAVRAGVGAVMCSYNQINNSYGCQNSQTLNKLLKAELGFQGFVMSDWSAHHSGVGAALAGLDMSMPGDISFDDGLSFWGTNLTVSVLNGTVPAWRVDDMAVRIMTAYYKVGRDRLRIPPNFSSWTRDEYGWEHSAVSEGAWTKVNDFVNVQRSHSQIIREIGAASTVLLKNTGALPLTGKEVKVGVLGEDAGSNPWGANGCPDRGCDNGTLAMAWGSGTANFPYLVTPEQAIQREVISNGGNVFAVTDNGALSQMADVASQSSVSLVFVNADSGEGFISVDGNEGDRKNLTLWKNGEAVIDTVVSHCNNTIVVIHSVGPVLIDRWYDNPNVTAIIWAGLPGQESGNSLVDVLYGRVNPSAKTPFTWGKTRESYGAPLLTEPNNGNGAPQDDFNEGVFIDYRHFDKRNETPIYEFGHGLSYTTFGYSHLRVQALNSSSSAYVPTSGETKPAPTYGEIGSAADYLYPEGLKRITKFIYPWLNSTDLEDSSDDPNYGWEDSEYIPEGARDGSPQPLLKAGGAPGGNPTLYQDLVRVSATITNTGNVAGYEVPQLYVSLGGPNEPRVVLRKFDRIFLAPGEQKVWTTTLNRRDLANWDVEAQDWVITKYPKKVHVGSSSRKLPLRAPLPRVY

SEQ ID NO: 25061 - protein, 356 aa, Neosartorya fumigata
  strain CEA10 / CBS 144.89 / FGSC A1163
MLGKTVLLPLLVLLCHSLASASLVYRGADISSLLIEEKAGIEYKNVNGQTQPLENILKANGVNSVRQRVWVNPSDGSYNLDYNVKLAKRVKAAGMSVYLDLHFSDTWADPSHQTTPRGWSTNDIGTLTWQVYNYTMEVCNTFASNGIDVSIVAIGNEIRNGLLWPLGKPDNYANIANILHSAAFGVKDSTLSPKPKIMIHLDNGWDWSAQKFFYDRVLSSGANLVKSDFDLIGVSYYPFYNPSATLSALTTSLKNLRSTYGKDVLVVETDWPVLCPNPAYAFPSDLKDIPFSVAGQTTFVQRVANIVAQTPGGIGLYYWEPAWVQNAALGSSCADNLMVDWSTRQARTSLSVFATI

SEQ ID NO: 25062 - protein, 257 aa, Neosartorya fumigata; identical to SEQ ID NO: 24980
  strain CEA10 / CBS 144.89 / FGSC A1163

SEQ ID NO: 25063 - protein, 322 aa, Neosartorya fumigata
  strain CEA10 / CBS 144.89 / FGSC A1163
MLPFNSCVYVLLIISLMSNCRALCRATALQGRSLCATGGPDAAFRAEHERLSAFESRPSSGSYDMRRALDPIEIETWFHIVSGETDADLVTDEMVILQLHYLQKAYEKASISYRLKGVTRHINETWARNGDDSAMKKALRRGGYSTLNVYFQTNLQPPSTTDFARWTSDGDNRHAYNSDLAPPSVLGFCTLPDPSINSSSPRSSYSKDGCNVLAKTMPGGPMTHYNRGGTAIHEIGHWNGLLHTFEGESCSEDNAGDYIADTPQQSVPTDGCPSQKDSCPDSPGLDDIHNFMDYSSDDCYASFTSNQLKRMRDMWFSMRKGK

SEQ ID NO: 25064 - protein, 300 aa, Neosartorya fumigata
  strain CEA10 / CBS 144.89 / FGSC A1163
MAKQTLLLSPPSLSSQPGKLNETLQSYNRNATDLQMLDRLALGLASLPDSAYSSIVILAGGDNSFSESLKLINRQIFNQIIGSLRRGGYIYGQDAVSGIAFDHNEAILAGLIHVGNGKYQKPDIKEMQAVPLRLGRKNDHLAGAPSLQESAAEHPCPPETMISASTMNSNEASDDELINEDNLLDDSELSAPIIQRGPAPECRPKAGKRRRACKDCTCGLAQKLQEEDAVKRADADEQLDAMRLLHDDLAEVDFTVQGKVGSCGNCSLGDAFRCEGCPFIGLPAFQPGEEVRLLNNDVQL

SEQ ID NO: 25065 - protein, 505 aa, Neosartorya fumigata; identical to SEQ ID NO: 25021
  strain CEA10 / CBS 144.89 / FGSC A1163

SEQ ID NO: 25066 - protein, 725 aa, Neosartorya fumigata
  strain CEA10 / CBS 144.89 / FGSC A1163
MFRVGSWLYGKKPAANASTQSLDSLVELRDLEDAMRAATLILNDDVDGAEAGLAEGTSAFHNLGRGVVAFIRATLGFEQDIMRQASERLNEAETSASVDQHRAQHNSYAPNTYHSPMYLPGTEFALCQAIAQLMSAIVGVLNESLTESIKAFYRLRKAYITLDAILKMEQKYMEESRAATLVESTTSGSVPSSLRHSSSNLHSSSSSISSAKGKEAAADTLAAPSNDTDVQERLADLSLSGEPAVAEDPGQTPTPINTDILDHDPDSDIFQNQIDVFVHSGSNFCFGVLLLLISMVPPSFSKLLSIIGFHGDKERGLKMLWQASKFHNLIGGIAAFAILGYYNGFVRYCDIMPDSIPGKDGDVQGYPQKRLELLLAKMRERFPKSQLWLLEESRMSGANKNLDRALELLCGEERSPLKQVEALRVFERSLNAMYLHKYELCADSFLECVDLNSWSRSLYYYIAGSCHLSLYRDVKETDSAKAAKHAELAEKYFRMAPTVAGKKRFMARQLPFDVFVARKFAKWEARAKEWKVSLVDAVGVDPIEEMIFFWNGHSRMTDEQLQESLQKLAWSESSANTTWSREGPEEKAILKLLRAAVHRSLRKHTQAKEMLEDILGQDRTLFKGHLKDDWICPVAHFEMAANLWMERPTYIATHGGAKQDSNKESARPASVNDALQYEREKVRKCKEYLEKAAKWESYELDARIGLKVTAAMEAVQKWESTHPTL

SEQ ID NO: 25067 - protein, 320 aa, Neosartorya fumigata; identical to SEQ ID NO: 25019
  strain CEA10 / CBS 144.89 / FGSC A1163

SEQ ID NO: 25068 - protein, 262 aa, Neosartorya fumigata; identical to SEQ ID NO: 24986
  strain CEA10 / CBS 144.89 / FGSC A1163

SEQ ID NO: 25069 - protein, 721 aa, Neosartorya fumigata
  strain CEA10 / CBS 144.89 / FGSC A1163
MGAFRWLSIAAAASTALALTPEQLITAPRRSEAIPDPSGKVAVFSTSQYSFETHKRTSWWSLLDLKTGQTKVLTNDSSVSEIVWLSDDSILYVNSTNADIPGGVELWVTQASSFAKGYKAASLPASFSGLKAAKTKSGDIRFVAYGQSYPNGTAYNEELATAPLSSARIYDSIYVRHWDYWLSTTFNAVFSGTLKKGHGKNGYSLDGELKNLVSPVKNAESPYPPFGGASDYDLSPDGKWVAFKSKAPELPKANFTTSYIYLVPHDASETARPINGPDSPGTPKGIKGDSSSPVFSPNGDKLAYFQMRDETYESDRRVLYVYSLGSKKTIPSVAGDWDRSPDSVKWTPDGKTLIVGSEDLGRTRLFSLPANAKDDYKPKNFTDGGSVSAYYFLPDSSLLVTGSALWTNWNVYTAKPEKGVIKKIASANEIDPELKGLGPSDISEFYFQGNFTDIHAWVIYPENFDKSKKYPLIFFIHGGPQGNWADGWSTRWNPKAWADQGYVVVAPNPTGSTGFGQALTDAIQNNWGGAPYDDLVKCWEYVHENLDYVDTDHGVAAGASYGGFMINWIQGSPLGRKFKALVSHDGTFVADAKVSTEELWFMQREFNGTFWDARDNYRRWDPSAPERILQFATPMLVIHSDKDYRLPVAEGLSLFNVLQERGVPSRFLNFPDENHWVVNPENSLVWHQQALGWINKYSGVEKSNPNAVSLEDTVVPVVNYN

SEQ ID NO: 25070 - protein, 396 aa, Neosartorya fumigata
  strain CEA10 / CBS 144.89 / FGSC A1163
MIRRLAAFSALSGLATAWLPEVNKKITSTNGTNLFTSSNGKIRGVNLGSQFVFEPWIAEKAWSDMGCGGQKSEFDCVSRLGQANANSAFASHWGSWITQDDIAEMVSYGLNTIRVPVGYWMREDLVYSDSEHFPQGGLQYLENLCEWASDAGLYIIIDLHGAPGAQTPQNPFTGQYAPIAGFYQDYQFERALKFLEWMTTNIHQNDKFRNVGMLEVVNEPVQDAGKVGSMRSSYYPNAFKRIRAAEQSLNIDRNNYLHIQMMDRLWGSGDPNESLTDTYYAAYDDHRYLKWASVAVSKDSYISTSCSDQLNSNTPTIVGEWSLSVPDNVQWNSDWSPDSNKDFYKKWFAAQVTAYERQQGWIFWTWKAQLGDYRWSYQGGLLLTRPGIGDQQVLTL

SEQ ID NO: 25071 - protein, 211 aa, Neosartorya fumigata; identical to SEQ ID NO: 25039
  strain CEA10 / CBS 144.89 / FGSC A1163

SEQ ID NO: 25072 - protein, 477 aa, Neosartorya fumigata; identical to SEQ ID NO: 24918
  strain CEA10 / CBS 144.89 / FGSC A1163

SEQ ID NO: 25073 - protein, 382 aa, Neosartorya fumigata
  strain CEA10 / CBS 144.89 / FGSC A1163
MLHISIVAVTASLALVLSANAQAALYAQCGGEGYSGPTSCVAGAVCTVWNPWYSLRSMRPWNKHCTRHCAKYDNNDNNHNNHNNHNNEHRYTHRAKVLHHFVSYPKLPTERSWAHPASGDSYSQTGFDISSTKPSASNPLGNPTLPGWTTSGGLNWVGFLVSKYNTSLTLSYNFAYGGATTNASLVAPYTSTVLSFIDQVTEFTNSIASKPSYAPWTSGNTLVGVWMGVNDVGNSYWLSNIDELLLKIMDSYFGQLQILYDAGVRNYVLLGVPPINRSPLMLAQGTDVTTAEAAVIAKYNNLIATYLAQFKSKNSGVTATVVDTQAPFNQALDNPTAYGAPDATCYNSDGTSCLWFNDYHPGIAIQDLTAQAVASALKELFF

SEQ ID NO: 25074 - protein, 321 aa, Neosartorya fumigata
  strain CEA10 / CBS 144.89 / FGSC A1163
MKFVATLIACGLSGLALAAPTATVDSLGKRAADDAAFGYASLNGGTTGGAGGTTTTVSSYAAFTAAVSSDAKKVVYVSGPIKQSAKQVKVGSNTSIIGKDSTAVLEGFGLLVKEKSNVIIRNLGVKKVLAENGDAIGIQYSNNVWVDHVDVSSDRDHDKDYYDGLIDVTHAADYVTISNSYIHDHWKASLVGHSDNNGDEDKGHLRVTYANNYWSNINSRAPSLRFGTGHIYNSYFENVSDGINTRDGAQVLVESNQFVGSSKALYSTDDGYAVERDNDFGGAKNTALQGTLTTVPYSYSLLGSSKVKSAVVGVAGQTLKF

SEQ ID NO: 25075 - protein, 378 aa, Neosartorya fumigata; identical to SEQ ID NO: 24976
  strain CEA10 / CBS 144.89 / FGSC A1163

SEQ ID NO: 25076 - protein, 396 aa, Neosartorya fumigata
  strain CEA10 / CBS 144.89 / FGSC A1163
MKAIGATLLGLALVVQAQQPFYAQCGGNGWTGSTQCVAGACCSSINDWYYQCLSGNCMPSTTMTTTTATHTTSTSTSGATGSLPTSFRWSSTNALVGPKNDGRNLAGIKDPSIIEVDGTYHVFASTAQASGYNLVYFNFTDFNQAGNAPFFYLDQSGIGTGYRAAPQVFYFQPHQLWYLIFQNGNAAYSTNKDISNPAGWSAPKNFFSSVPSIITENIGKGYWVDMWVICDSSNCYLFSSDDNGHLYRSQTTLSNFPNGMGNTVIALSDSNPNNLFEASNVYRVGNEYLLLVEAIGSDGNRYFRSWTAPSLTGTWTGLANTEANPFARSNNVVFSGTAWTKSISHGEMVRSQVDQTMTISPCKLRYLYQGLSPTATGDYNSLPWRLALLTQTNSAC

SEQ ID NO: 25077 - protein, 372 aa, Neosartorya fumigata
  strain CEA10 / CBS 144.89 / FGSC A1163
MTVLVALFCLVTWTLCTRIPQYSTQGTQQPQQPEKTPHPHPQPEDAFPPTHATDLKIHDPSIIHVDGTYYSYSVGRHIRIHQAPSLDGPWERTGAVLNADSVIPKGDRKAPWAPQTVHHNDTYYCFYAVSNSGCRDSAIGVATSKSPGPGGWTDHGLLVQSGTGKGSDEHPFTSSNTIDPSVFVGEDGHGYLMFGSFWSGIWQVPLDESLLSVAGDTSSEARQLVYMEKAPLPASKHPNPLCREPSGARPIEGSFLSYHEPWYYLWFSYGKCCKFDTKNLPPPGREYSIRVGRSKSPRGPFVDKQGRDLANGGGEIVYASNRDVYAPGGQGVLTEKSGDILYYHYCRYPVIQEIEVDADLTVNKSTSYDFWV

SEQ ID NO: 25078 - protein, 366 aa, Neosartorya fumigata
  strain CEA10 / CBS 144.89 / FGSC A1163
MKISATAVVLLAGLAAGAPTKTIQSKFEKRQFGTGTDGLGALASLFPTLGGGGSSTSSGLGALASLIPGLGGSSSGSGFSLPGFTLPTSIPGLGSLGSLGSSGSSGASGLSGLSGLGGLSGLNGLGSSTTGSSAEASTSGTAATSSNSNSGGALFGLLGGEFPLFPRQPSRLLRYSDHVAKRGLLGSMTENGVKNKDACQPLTFIFARGTSELGNMGSVVGPPVATKLRSLLNNKVVVQGVDYPASVEGNALLGAAGGPTMASMVKQALSQCPDTKVVVGGYSQGAMVVHNAANSLSQGQIAAAVLFGDPFKSQAVGKVDKANVKEYCAAGDPVCLNGANVIAHLSYGSDAAEAAQFLVTASGVKA

SEQ ID NO: 25079 - protein, 272 aa, Neosartorya fumigata; identical to SEQ ID NO: 24922
  strain CEA10 / CBS 144.89 / FGSC A1163

SEQ ID NO: 25080 - protein, 259 aa, Neosartorya fumigata; identical to SEQ ID NO: 25041
  strain CEA10 / CBS 144.89 / FGSC A1163

SEQ ID NO: 25081 - protein, 454 aa, Neosartorya fumigata; identical to SEQ ID NO: 24963
  strain CEA10 / CBS 144.89 / FGSC A1163

SEQ ID NO: 25082 - protein, 292 aa, Neosartorya fumigata; identical to SEQ ID NO: 24966
  strain CEA10 / CBS 144.89 / FGSC A1163

SEQ ID NO: 25083 - protein, 1011 aa, Neosartorya fumigata; identical to SEQ ID NO: 24967
  strain CEA10 / CBS 144.89 / FGSC A1163

SEQ ID NO: 25084 - protein, 228 aa, Neosartorya fumigata; identical to SEQ ID NO: 24968
  strain CEA10 / CBS 144.89 / FGSC A1163

SEQ ID NO: 25085 - protein, 450 aa, Neosartorya fumigata
  strain CEA10 / CBS 144.89 / FGSC A1163
MQFTHLVALALALATSEAAHQGFNYGNTKSDGSAKSQADFQAEFSTAKNLVGTSGFTSARLYTMIQGGTANTPISAIPAAITEQTSLLLGLWASGGNFANEIAALKAAIAQYGDDLAKLVVGISVGSEDLYRNSVDGVKANAGIGTNPDEIVSYINEVRSTIAGTKLSGAPIGHVDTWTAWVNGSNSAVIDACDWLGFDGYPYFQNTMANSISDAKALFDESVAKTQAVAKGKEVWITETGWPVSGKTENLAVANLANAKTYWDEVGCPLFGKTNTWWYILQDADPVTPNPSFGIVGSTLSTTPLFDLSCSASSSSSAAASSTAGPSASSVIGGKASGFTTAAANSAKPTFTVGKGPGGSYNGTGFWNSTSSARPSSSAISGSSSGSAAGSSGSSGSSGSGASGASGQSSSSTGSSSAPSTSNILSNAASGLSGSICGAVVAVCLALAAL

SEQ ID NO: 25086 - protein, 440 aa, Neosartorya fumigata
  strain CEA10 / CBS 144.89 / FGSC A1163
MLITNPALLGILASLVPLALGAPNQPIQARSRKCVIPSSYASSHGTADDSPAVASAFAQCAENSVIVFQEGVDYNIFHPIKATNLSNVEIRVLGNLHLPQDITAVQNIVKSGQSTWFTFQGPRVDWTGADDIKNGWINSYGQAWWDANPANSSSFPNRPHLMSYKTSQASIKNFRSRKPIAWNVKLQGDDITVSHAIVDATSTGGFPFNTDGFDVEGTNISITDSVMFNGDDAIAVNTPSHNIVFARNTIGYQSHGMSIGSLGKDPTDFANITNLRFEDVTVIDALYAARFKSWSGGRGLVKNVVWKNIRTFNVTFPIFVTQSYSDQSASRPGTIDPFSSVMMEDFTWSDFSGTINTYHPGDGSCVTDPCWYNVGLPNLKHTEAIVLECNTESSCKNFRTEGIRLHPQSKDSPSVICMKATAELNPKLGFECKNGTFVPH

SEQ ID NO: 25087 - protein, 342 aa, Neosartorya fumigata; identical to SEQ ID NO: 24961
  strain CEA10 / CBS 144.89 / FGSC A1163

SEQ ID NO: 25088 - protein, 87 aa, Neosartorya fumigata; identical to SEQ ID NO: 25032
  strain CEA10 / CBS 144.89 / FGSC A1163

SEQ ID NO: 25089 - protein, 321 aa, Neosartorya fumigata; identical to SEQ ID NO: 25031
  strain CEA10 / CBS 144.89 / FGSC A1163

SEQ ID NO: 25090 - protein, 771 aa, Neosartorya fumigata; identical to SEQ ID NO: 24962
  strain CEA10 / CBS 144.89 / FGSC A1163

SEQ ID NO: 25091 - protein, 386 aa, Neosartorya fumigata
  strain CEA10 / CBS 144.89 / FGSC A1163
MKTAVLSLFLALQTYARVTGSPSGFAAGTTGGGSATPAAPSSLDELVQWITDDKPRVILIDRTWDFIGTEGTTTGKCCSMPSTTVCSGGTSKGQAWIQDHCDGGSWVSCKYDNAALTPLDVGSNKSIVGVGNKGVIKGKGLRVRNGNKNVIIQNIHITNLNPQYVWGGDAITLDNADKVWIDHNKISLIGRQFIVSGWGKAGHVTISNNEFDGRTSWSAGCNGKHYWTLLLLGEQDYYTFQGNWLHDVSGRAPHMGTDHTKSQIFFHGVNNYFQNVGGHAFDVDTNTWVLLEGNYFENVNTPLTDTSLRAGGKLYTTSTVAAAGACQDKLGYICEWNRLAGSGAWKDRTDADVKTKAAAFKSSLVGHYPVADVPAKVVANAGVGKL

SEQ ID NO: 25092 - protein, 521 aa, Neosartorya fumigata
  strain CEA10 / CBS 144.89 / FGSC A1163
MRLHAFTLLSLLGLVPSFAAASLSGSVGPLTSASAKAAKKTCNVLDYGAKADKKTDLGPPLAAAFAACKSGGLVYIPAGDYAMSTWVKLANGKAWALQIDGVIYRTGTDGGNMIMIEHTSDFELYSSTSSGAMQGLGYEFHASNNWSGPRLLRLWDVSDFSVHDLILVDSPSFHFSIDTCSNGEVYNMAIRGGNHGGLDGVDVWSTNIWIHDLEVTNKDECVTVKSPAKNILVENIYCNLSGGCAMGSLGADTDISDITYKNIYTWNSNQMMMIKSNGGSGTVSNVVFENFIGHGNAYSLDIDSFWSSMSAVSGDGVTLNNITIKNWKGTEANGAQRGPIKIICPDKVPCYNILIEDFAMWTETGSKQWYSCQSAYGSGFCLKSGSHHTSYAVTTTTVSSAPSGYSAAKMASDLSTDFGSTKSIPIPTIPTSFYPGATPYSALMSKQSTKAAKARAVDMSVETPAAASRSEQVVQGAPQETGQSAPESAGPVPSGNPGPVPTGGSRPSRHRHGHHHFGSAI

SEQ ID NO: 25093 - protein, 395 aa, Neosartorya fumigata; identical to SEQ ID NO: 24931
  strain CEA10 / CBS 144.89 / FGSC A1163

SEQ ID NO: 25094 - protein, 426 aa, Neosartorya fumigata
  strain CEA10 / CBS 144.89 / FGSC A1163
MSRSKTRQGKLPALGWNTWNAFGCDIDATKIMTAANEVVNLGLKDLGYEYINIDDCWSVKSGRDASTQRIIPDPDKFPDGISGVADQIHDLGLKIGIYSSAGLTTCAGYPASLGYEDIDAQTFAEWGIDYLKYDNCGVPSNWTDTYTYCVPDPGSKATNGTCPDNKNPAPAGYDWRTSLTAERYRRMRDALVSVDRTILYSLCEWGQANVNDWGNETGNSWRTTGDITPSWPRIAAIANENSFLMNHVDFWGYPDPDMLEVGNGNLTLAENRAHFALWAAMKSPLIIGTALDSISQDHLAILSNKILLKFHQDPVIGRPAQPYKWGYNPDWTFDPAHPAEYWSGASSVLGGTLVLMLNSEDTTQRRTAVWKEVPELKDVLGRQGKRRIGFRVTDVWTGKDLGCVRDHYSVELESHDVAALVVGRAC

SEQ ID NO: 25095 - protein, 471 aa, Neosartorya fumigata
  strain CEA10 / CBS 144.89 / FGSC A1163
MLDFMDYIQLAFAEATNWNRDNSYSSLTATAQSLLDFSTPERLRVHLSSLATPHFATSYTLGTVGLIDGSVSYLYSTVPLNNTPSRSALIPLRKLARGYRQVQPPVAPVEDCGWQSCLGGLGSSESKPSGNDDSQPSLGRKATLLNATLHLPPPTILNALFLRRMSPTMQLSLAVCSTRGAPLSNSAPQASLLGQLSHDTGKYSNEYLFSTDNSLFGWRGLWNFGPDPRHPKENSSPQLSLLSAGAEAYYSPVSSLIGMSTGLRFSTLPAATEMPSSSSSASSTTTTSNHGTPISTFPYTLTLVLTPLTGSLSTTYSLRASPNLAFSSRFGFNVYSWESEMVAGCELWRKRRKPSPPPVDDDGLEWARRKMRMADTPAFAPVEPPTTHNRDEENESVLKIRVDQSWNVRLLWEGRVKELLVSAGVGLGPSSFSSPSRAANSTPAGGGQSVGGGISGRSYWHGVGVSISYSS

SEQ ID NO: 25096 - protein, 840 aa, Neosartorya fumigata
  strain CEA10 / CBS 144.89 / FGSC A1163
MWSGIPIFALLSSIGIAAAETGLDGWLRYASVPCNGNCQRALPSHIVTLNSTRSSPVYVAGQELQDGLHQILGKHASVKSTGCSTDSSIIVGTVEAYRQVCNAGRQVPQLDVDGFWLSIREKSVLIVGQSERGALYGAYEYLSMLAQGNFSQVSYATSPHAPIRWVNQWDNMDGSIERGYGGPSIFFKDGVIRQDLSRVQQYARLLASVRINGIIVNNVNANASLLMPSNMDGLARIADIFRPYGIRVGISLNFASPSTLGNLSTYDPFDSSVIAWWGNVTDQLYARIPDMAGYLVKANSEGQPGPTTYNRTLADGANMFARALKPYGGVVMFRAFVYDHHISEDNWYNDRANAAVDFFKPLDGKFDDNVVVQIKYGPIDFQVREPASPLFANLYKTNTAIELQVTQEYLGQQSHLVYLPPLWQTILGFDLRVDQKPSLVRDIISGQRFDRPLGGWAAVVNVGTNSTWLGSHLAMSNLYAYGRLAWEPTLDSEDIVQDWIRLTFGLDRRIVDTLTQMSMESWPAYENYSGNLGIQTLTDILYTHYGPNPASQDGNGWGQWTRADHLSIGMDRTVKNGTKFSGQYPAEVAAMYENIETTPDNLLLWFHHVNYTQRLHSGKTVIQHFYDAHYTGAETAQTFVSQWESLRERIDAERYQHVLTRLIYQAGHSIVWRDAINNFYHNLSGIADEKQRVGHHPWRVEAEDMQLDGYVPYAVSPFETASNYTAIVTASNGTTGTASATLDFKTGTYDLGINYYDMYGGKSHWTVYLNDRVVGQWQGNSEDVLSHTPSIYLDGHSATRITFRDVKIHKGDRLKIVGKPDGVEPAPLDYVVVLPPGIVD

SEQ ID NO: 25097 - protein, 838 aa, Neosartorya fumigata
  strain CEA10 / CBS 144.89 / FGSC A1163
MVQLDVEKTIEELTLGEKVALTAGIDFWHTAAVPRLNIPSLRMSDGPNGVRGTRFFNGVPAACFPCATALGATWDTKLLYEVGRLMGEESIAKGAHVVLGPTINTQRSPLGGRGFESFAEDGVLSGILAGHYCKGLQETGVAATLKHFVCNDQEHERLAVDSIVTMRAMREIYLLPFQLAMRICKTACVMTAYNKVNGTHVSENKQIITDILRKEWGWDGLVMSDWFGTYSTCDAINAGLDLEMPGPTRWRGTALAHAVSSNKAFEFVMDERVRNILNLHNFVEPLGIPENAPEKALNRPEDQALLRRAAAESVVLMKNQDNILPLKKEKPILVIGPNAKTAAYCGGGSASLDAYYTVTPFEGVAAQSQGEVTFSQGVYSYKELPLLGPLLKTDDGKKGFKFRVYNEPPSEPNRQLIDELHLESSSGFLMDYKHPKIKTFTFYVDMEGYFTPEEDGIYDFGVTVVGTGKLFVDDELVVDNSKNQRQGTAMFGNATVEEKGSKELKAGQTYKVVLQFGTAPTSDLDMRGVVIFGPGGFRFGAARRVSQEELISKAAELASQASQVVIFAGLTSEWETEGYDRDHMDLPPGSDEMISRVLDANPDTVVVIQSGTPVTMPWAHKAKALLQAWFGGNECGNGIADVLYGNVNPAAKLPLSFPVRLQDNPSYLNFRSERGRVLYGEDIYVGYRYYEKVDLAPLFPFGHGLSYTTFSRSDLSLATTPEKPQLEDGEPITVTVSVTNTGSVAGAEIVQLWVAPPPTGVNRPVRELKGFTKVFLQPGETKKVEIVVEKKLATSWWDEQREKWASEKGTYEVLVTGTGDEVLKSSFEVEKTRYWLGL

SEQ ID NO: 25098 - protein, 370 aa, Neosartorya fumigata
  strain CEA10 / CBS 144.89 / FGSC A1163
MKVTILASAILALINGALALPANTPTLDVTLTQVDNTRIKATVKNTGNEKVTFVHLNFFQDAAPVKKVSLFRNATEVEFTGIKRRLLTEGLSDDALTTLAPGATFEDEFDVASTADLTEGGTVTIRTDGFVPITTDRKVSGYIPYQSNELEIEVDAAKAAAVPQAIKLLDRRTKVASCSGSRASALSTALRNAASLANAAASAASSGSSTRFQEYFKTTSSSTRNTVAARFRAVASEASSQSSGKTTYYCTDPYGYCDSNTLAYTLPSSNLIANCDIYYSYLPALTSSCHAQDQATTTLHEFTHAPAVYSPGTDDYAYGYRASTALSASQALLNADTYALFANGTPLLPLSTSTSKCSTLTMVIAVNLNC

SEQ ID NO: 25099 - protein, 368 aa, Neosartorya fumigata; identical to SEQ ID NO: 25008
  strain CEA10 / CBS 144.89 / FGSC A1163

SEQ ID NO: 25100 - protein, 214 aa, Neosartorya fumigata [sequence omitted]

SEQ ID NO: 25101 - protein, 765 aa, Neosartorya fumigata
  strain CEA10 / CBS 144.89 / FGSC A1163
MKWSILLLVGCAAAIDVPRQPYAPTGSGKKRLTFNETVVKRAISPSAISVEWISTSEDGDYVYQDQDGSLKIQSIVTNHTQTLVPADKVPEDAYSYWIHPNLSSVLWATNYTKQYRYSYFADYFIQDVQSMKLRPLAPDQSGDIQYAQWSPTGDAIAFVRDNNVFVWTNASTSQITNDGGPDLFNGVPDWIYEEEILGDRFALWFSPDGAYLAFLRFNETGVPTFTVPYYMDNEEIAPPYPRELELRYPKVSQTNPTVELNLLELRTGERTPVPIDAFDAKELIIGEVAWLTGKHDVVAVKAFNRVQDRQKVVAVDVASLRSKTISERDGTDGWLDNLLSMAYIGPIGESKEEYYIDISDQSGWAHLWLFPVAGGEPIALTKGEWEVTNILSIDKPRQLVYFLSTKHHSTERHLYSVSWKTKEITPLVDDTVPAVWSASFSSQGGYYILSYRGPDVPYQDLYAINSTAPLRTITSNAAVLNALKEYTLPNITYFELALPSGETLNVMQRLPVKFSPKKKYPVLFTPYGGPGAQEVSKAWQALDFKAYIASDPELEYITWTVDNRGTGYKGRAFRCQVASRLGELEAADQVFAAQQAAKLPYVDAQHIAIWGWSYGGYLTGKVIETDSGAFSLGVQTAPVSDWRFYDSMYTERYMKTLESNAAGYNASAIRKVAGYKNVRGGVLIQHGTGDDNVHFQNAAALVDTLVGAGVTPEKLQVQWFTDSDHGIRYHGGNVFLYRQLSKRLYEEKKRKEKGEAHQWSKKSVL

SEQ ID NO: 25102 - protein, 316 aa, Neosartorya fumigata
  strain CEA10 / CBS 144.89 / FGSC A1163
MVVLSKLVSSILFVSLVSAGVIEERQAASINQAFTSHGKKYFGTASDQALLQKSQNEAIVRKDFGQLTPENSMKWDATEPSQGRFNFAGADFLVNYAKQNGKKVRGHTLVWHSQLPSWVSAISDKNTLTSVLKNHITTVMTRYKGQIYAWDVVNEIFNEDGSLRDSVFSRVLGEDFVRIAFETARSVDPSAKLYINDYNLDSASYGKTQGMVRYVKKWLAAGIPIDGIGTQTHLGALTALASSGVSEVAITELDIAGASSQDYVNVVKACLDVPKCVGITVWGVSDRDSWRSGSSPLLFDSNYQPKAAYNAIIAAL

SEQ ID NO: 25103 - protein, 572 aa, Neosartorya fumigata
  strain CEA10 / CBS 144.89 / FGSC A1163
MAFNFNWSPLMADASFYTRAQDLLTAALNKSPKPPIIVDDIIVTELNLGSIPPELEILEIGDLAEDRFRGIFKMSYSGDAFLTLKTRVQANPLNTYLLTRPSFATPRPLAAATPLTIPLQITLSDFKLSGFVILVFSKQKGITVVFRNDPLESLKVSSTFDSIPFVRDFLQKEIEAQLRILFMDELPAIIHRLSLRLWVPEYRAGEELQTQTASANGEGPGQDPLASPPQDPVDALGNALNESEIESLSLDSSVETHSLFSQKNLLRLAALTDSQRTLSLFTPSIREVVYRAWTSPSDQTDASGSVTSPFFPVLSRTQSQVGSMSSFPDSASMVSSQSRSSTPSHTFSGYGLSLGAGRHSKAHARKRKKRVVDLRRPKTTDDAPSVSDESSFTESTSAPSICSAPLPVLDEQTDDPVTPPLSPDNDLHLPAIPERHRMSISRPALRRENASEMIRDTAECKPSSNAVGQAIQEEDLSATPRAAVRAHGASVLEKGKQDPDSSAGSSRQLPSTILPFINDNPTGGVVDQALVERLAGEIARRMRDEKFMASNACGPFWDRHSQEESPPPAYGH

SEQ ID NO: 25104 - protein, 403 aa, Neosartorya fumigata; identical to SEQ ID NO: 24929
  strain CEA10 / CBS 144.89 / FGSC A1163

SEQ ID NO: 25105 - protein, 983 aa, Neosartorya fumigata; identical to SEQ ID NO: 25004
  strain CEA10 / CBS 144.89 / FGSC A1163

SEQ ID NO: 25106 - protein, 440 aa, Neosartorya fumigata; identical to SEQ ID NO: 25003
  strain CEA10 / CBS 144.89 / FGSC A1163

SEQ ID NO: 25107 - protein, 452 aa, Neosartorya fumigata; identical to SEQ ID NO: 25002
  strain CEA10 / CBS 144.89 / FGSC A1163

SEQ ID NO: 25108 - protein, 632 aa, Neosartorya fumigata; identical to SEQ ID NO: 25001
  strain CEA10 / CBS 144.89 / FGSC A1163

SEQ ID NO: 25109 - protein, 869 aa, Neosartorya fumigata
  strain CEA10 / CBS 144.89 / FGSC A1163
MRVLSAIALVASLASSALSAPASESRVSTQLRSRDAEGYSSPPYYPAPNGGWLSSWADAYEKAQRVVRDMTLAEKVNLTTGTGIFMGPCVGQTGSALRFGIPNLCLQDSPLGVRNSDHNTAFPAGITVGATFDKDLMYARGVELGKEFRGKGINVLLGPSVGPIGRKPRGGRNWEGFGADPSLQAIGGAQTIKGIQSQGVIATIKHYIGNEQEMYRMSNVGQRAYSSNIDDRTLHEVYLWPFAEGIRAGVGAVMTAYNEVNSSACSQNSKLLNEILKDELGFQGFVMTDWLGQYGGVSSALAGLDMAMPGDGAIPLLGTAYWGSELSRSILNGSVPVSRLNDMVTRIVAAWYKMGQDGDFPLPNFSSNTQDATGPLYPGALFSPSGVVNQYVNVQADHNITARAIARDAITLLKNDDNILPLKKDDALKVFGTDAGPNPDGLNSCADMGCNKGVLTMGWGSGTSRLPYLVTPQEAIANISSNAAFFITDKFPSNVAVSSGDVAVVFISADSGENYITVEGNPGDRTSAGLNAWHNGDKLVKDAAAKFSKVVVVVHTVGPILMEEWIDLPSVKAVLVAHLPGQEAGWSLTDVLFGDYSPSGHLPYTIPRAESDYPSSVGLLSQPIVQIQDTYTEGLYIDYRHFLKANITPRYPFGHGLSYTTFSFSQPTLSVRTALDSTYPPTRPPKGPTPTYPTAIPDPSEVAWPKNFDRIWRYLYPYLDDPASAAKNSSKTYPYPAGYTTVPKPAPRAGGAEGGNPALFDVAFAVSVTVTNTGSRPGRAVAQLYVELPDSLGETPSRQLRQFAKTKTLAPGTSETLTMEITRKDISVWDVVVQDWKAPVRGEGVKIWLGESVLDMRAVCEVGGACRVI

SEQ ID NO: 25110 - protein, 926 aa, Neosartorya fumigata
  strain CEA10 / CBS 144.89 / FGSC A1163
MHVKAETVLALLTPAPPSVVGQHVVDLSGDGWTLSSTALNRTVPGHLPSQVHLDLFEAGVIDIMASMILTFVGLRMPIGRIPATRLKAYFESTWLVFDGLDTFATITFCDQHVGSTDNQFRQHHFDVSQILKECKQDPVLRINFGSAPNIANTIAKSPDAEEWPPGVQITNEYPNRWYIRKEQSDFGWDWGPAFAPVGPWKPSYIVQNSHAELYVLNTDIDIYRQGQINYLPPDQSQPWIVNASIDFLGPVPCKPSMSIEIKDAATGSVLSSGLLQNVTVSGKSITGTTTIDGDAPKLWWPSGMGKQNLYNVTITVQNDMKKSLAKVTKRTGFRTIFLNQRNITDDQLAQGIAPGANWHFEINGYEFYAKGSNIIPPDAFWPRVTQARMARLFDAVTAGNQNMLRVWASGAYLHDFIYDLADEKGILLWSEFQFSDALYPVNDAFLENVAAEVVYNVRRVNHHPSLALWAGGNEIESLMLPMARRADPTGYSKYIGEYEKLYISLILPLVYENTRSITYSPSSTTEGYLYVNLSAPVPMAERYSNTTPGSYYGDTDYYNYDTSVSFDYNHYPVGRFANEFGFHSMPSLQTWQQAVDPEDLQFNSSVVVLRNHHYTAGGLFTDNFKNSSKGMGEMTMGVEAYYPIPSKSDSVANFSAWCHATQLFQADLYKSQIQFYRRGSGMPERQLGSLYWQLEDIWQAPTWAGIEYDGRWKVLHYVARDIYQPIIVSPFWNYTTGRLEVYVTSDLWEPAQGTVNLTWVDLSGKSIANNAGTPETVSFTVGALNTTNIYTTNISELSLPDLKDSILILSLSGEGRLPNASSKKAFVHQNHFTPVFPKDLSLKDPKLEVSYSPESRKFTVQATGGVSLYTWLDYPAGAVGYFEANAFVLLPGVPKEVSFVAQEGNVTDDWLQRVTVQSLWDQKVRD

SEQ ID NO: 25111 - protein, 526 aa, Neosartorya fumigata
  strain CEA10 / CBS 144.89 / FGSC A1163
MTKLSLLPLLTLASAVLAKQDAFQAKCASFGRKIKLPNVHVNFVEYVPGGTNLTLPDNDVTCGASSQVVSADMCRVAMAVDTSKSSQITLEAWFPREYTGRFLSTGNGGLSGCIQYYDLAYTAGLGFATVGANNGHNGTSGKPFYQHPEVIEDFAYRSIHTGVVVGKQLTKMFYKEGFDKSYYLGCSTGGRQGFKSIQKYPNDFDGVVAGAPAFNFVNLISWSIHFYSITGSNTSDTYLSPESWKVVHDEIVRQCDEIDGAKDGIIEDTDLCQPVIETIICKPGASDKTNCITGAQAKTVRNVLSPFYGVNGTLLYPRMQPGSELFASSVVYNGQPFRYSTDWYRYVVYNNPDWDATKWTVEDAAVALAQNPYNIQTWDADISSFQKAGGKVLTYHGMQDQLISSDNSKLYYARVAEEMGLGPEELDDFYRFFPVSGMAHCTGGDGAYGIGNGLRTYNGAEPENNVLMAMVQWVEKGIAPEFIRGAKFSNGVGSSVEYTRKHCRYPRRNVYKGPGNYSDENAWECV

SEQ ID NO: 25112 - protein, 330 aa, Neosartorya fumigata; identical to SEQ ID NO: 24996
  strain CEA10 / CBS 144.89 / FGSC A1163

SEQ ID NO: 25113 - protein, 397 aa, Neosartorya fumigata; identical to SEQ ID NO: 24917
  strain CEA10 / CBS 144.89 / FGSC A1163

SEQ ID NO: 25114 - protein, 532 aa, Neosartorya fumigata; identical to SEQ ID NO: 24994
  strain CEA10 / CBS 144.89 / FGSC A1163

SEQ ID NO: 25115 - protein, 865 aa, Neosartorya fumigata
  strain CEA10 / CBS 144.89 / FGSC A1163
MGSIDTVGMGQRAIDQIISELSLNEKVALLSGVDAWHTFAIPRLGIPSIRTTDGPNGARGTRYFNGVPSACLPCGTALGATFDRDLIFSLGQLLAAECRAKGAHVLLGPTINIQRGPLGGRGFESFSEDPVLSGLAAASYCSGVQDGGVVPTLKHLVCNDQEHERVAVSALVTPRALREIYLLPFQLAIQGARPGAVMTSYNKVNGLHASENPGLIRDILRGEWGYEGAVISDWFGTYSVADAVNAGLDLEMPGPTRFRGPALMHALTSNKVSEKTLNERVRKVLELVQLASRAGVPEYAPERKLNRPEDRALLRRAAGESVVLLKNDKNDSTNSPILPLDREKTTLVIGPNADLAAYCGGGSASLLAYYTVTPRQGIADKCGAEQVVFSQGCYGHKELPLLGEHLRTIETGQPGYTFRVYTEPPPASGSFKGSDSRTPVDELHMTNSSAFLMDYSHPQISGDTYYATLEGTFEPPESGVYEFGLTVAGTGLLYIDGVLVVDNKTVQRAGTSFFGIGTVEERGERYLEAGKKHHVFVEFGTAPTSNLQHHHGVVSFGPGGLRLGGCRKLDTDTAIQQAVQSAAQADQVVVCVGLSGDWESEGFDRPHMDLPPGTEELVNAVLAVQPNAVIVVQSGTPVTMPWADKAKALLQAWYGGNEAGNGIADVLFGDVNPSAKLPLTFPRELSQNPSYLSYRSERGRVLYSEDIYVGYRYYDTTGQPPLFRFGHGLSYSTFHLRDLTVRETAPYAANIKESSLRVSVTVSNTSARPGAEVVLVYVRPPAAACSVGRPVRELKGYEKVMLQPGETREVSITIPLGLATSFWDEGCDAWLSEKGLYFVEAVGTGEGNTLVAPLTVQVSRVWNGL

SEQ ID NO: 25116 - protein, 221 aa, Neosartorya fumigata; identical to SEQ ID NO: 24992
  strain CEA10 / CBS 144.89 / FGSC A1163

SEQ ID NO: 25117 - protein, 125 aa, Neosartorya fumigata
  strain CEA10 / CBS 144.89 / FGSC A1163
MVLIIEIIKIGQIGPIGQRGQSGQRGQSGQRGQSGQIGQSGQSGQSGQSGQSGQIGQIGQIGQIGQIGQIGQIGQIGQARRTGRTGRTVHRRMLQASSSFNISPDISICRRATRNMGEEERPLGC

SEQ ID NO: 25118 - protein, 234 aa, Neosartorya fumigata
  strain CEA10 / CBS 144.89 / FGSC A1163
MWSSIAAFPVLVPVALACLGYEGGVPTPTAHHSNSAVIEVAAGQVFDAGWAKYDRGSGACKGQSEGDWKDAVFYLHSGATLKNVIIGANQAEGVHCDGPCTLQFVWFEDVCEDAITIKNDKAGQETWIIGGGAYHASDKIVQHNGCGTVNIINFYAEDYGKVYRSCGNCDKQCKRNVYVEGTTARNGGEVVGINLNYGDTATLKNVCADSAHPCVFYDGCAGDCEPKKVGYCSG

SEQ ID NO: 25119 - protein, 634 aa, Neosartorya fumigata; identical to SEQ ID NO: 24932
  strain CEA10 / CBS 144.89 / FGSC A1163

SEQ ID NO: 25120 - protein, 438 aa, Neosartorya fumigata; identical to SEQ ID NO: 24950
  strain CEA10 / CBS 144.89 / FGSC A1163

SEQ ID NO: 25121 - protein, 406 aa, Neosartorya fumigata
  strain CEA10 / CBS 144.89 / FGSC A1163
MLYPRNLALFSLLSLSSAAPSQVERSPDAVLKPRAVCTPTAGGSPSIDDVPAIRKAIASCGNGGTIVFPAGSTYYLNSVLDLAGCSNCDIQVEGVLKFSGSTEYWGGKTAMLNIDMINGLRLRSLTGSGVIDGNGQNAYDRFASDKNYKRPTLLYITGGSNIEVSGLRQKNPPNVFNSVKGDTQHVTFKNLRMDATSNSQNPPKNTDGFDIGASTHVTISSVSVTNDDDCVAFKPGSNYVTVEDVTCTGSHGISVGSLGKSGTDVVQNILAHRINMIESTKAAGIKTYPSGNGHGLSTVKNVTFSDFNVRGCDYAFQIESCYGESESYCESNPGNAILQGIVVKGFSGTTSGKYDPVVANLNCGARGTCDVSMSAFSVKAPSGKATVLCDNTPSSLGVSCTSGASG

SEQ ID NO: 25122 - protein, 324 aa, Neosartorya fumigata; identical to SEQ ID NO: 24952
  strain CEA10 / CBS 144.89 / FGSC A1163

SEQ ID NO: 25123 - protein, 349 aa, Neosartorya fumigata
  strain CEA10 / CBS 144.89 / FGSC A1163
MKSTFGLLALAAAAKLVSAHATVHAVWINDVDQGAGNSADGYIRSPPNNSPITDVTSTDMTCNVNGKNPVAKTLSVKAGDKVTFEWHHDTRSDSDDIIASSHMGPVMVYMAPTEKGTAGNGWVKIAEEGYSNGKWAVANLIANRGKHSITVPDVPAGEYLLRPEIIALHEGNRQGGAQFYMECVQVKVTSAGTKTLPAGVSIPGAYKATDPGVLFDMYNSFTSYPIPGPAVWDGSSSGSSGSSGSSPATTTAPAVSVTAVPTKEAPVDTSATPTTFVTATKPATTAAPAAPSASSGSNSGSDSCNSGSASGSVKIYGQCGGQNYSGPTSCEAGLICKEWNPYYHQCVSA

SEQ ID NO: 25124 - protein, 361 aa, Neosartorya fumigata
  strain CEA10 / CBS 144.89 / FGSC A1163
MRALSVFVALFSFLALSSASPGQDVAKRVTSGSLQQVTNFGSNPSGTLMYIYVPNNLATKPGIVVAIHYCTGTAQAYYTGSPYAQLAEKYGFIVIYPQSPYSGTCWDVSSQSALTHNGGGDSNSIANMVTWTISQYNADTSKVFVTGSSSGAMMTNVMAATYPELFAAATSTPASPPAVSTPPPTKSTAGTAAAPRATSSAPQRSGAVSPKQCTRGIPGHGPACRSTTAAWIPLSTRRITTKPASSGRVSSGTTITRRSRPRATPRRRTTRLPSGARICRASLQRASDIRFLFMGSRTWSGLGLPGVRRRRRLLLQRLRRRARRHRRGGRRPALVLQSTGVNVAVMGGRGRRRVRAGIPAP

SEQ ID NO: 25125 - protein, 254 aa, Neosartorya fumigata; identical to SEQ ID NO: 24955
  strain CEA10 / CBS 144.89 / FGSC A1163

SEQ ID NO: 25126 - protein, 565 aa, Neosartorya fumigata; identical to SEQ ID NO: 24956
  strain CEA10 / CBS 144.89 / FGSC A1163

SEQ ID NO: 25127 - protein, 453 aa, Neosartorya fumigata
  strain CEA10 / CBS 144.89 / FGSC A1163
MKFFALAALFASTVNSIAVDGLIPGARVIPANDVVALKKAGAYHQKHHHRRTVIIRSSSSDEDDVSADFLWGIKRANHGGRLLLQNGKKYVIGKKLDLTFLKDIEVQLDGELKFTNDVPYWQANNFYYDFQKSISFWRWGGEDIKIFGSGVLNGNGQRWYNEFAGQEILDPNNKYYRPILFVTENATRVSVEGITQLNSPCWTNFFVRTKDISFDNVFIHAYSTNASALPKNTDGFDTLNVDGLTVTNTRVDIGDDCLSPKPNTTNVFVKNLWCNGTHGASMGSIGQYPGVLDIIENVWIENVTLLNGENGARLKAWAGPDVGYGRINNVTYKNIHVENTDNPIVLDQCYFNINATQCAAYPSRVNFTNIVFEDIYGTSSGKRGKVVADLTCSPNAVCSGIRLKNIHLTSPAGSPPVIVCDGIQGDIGVECQSSSNSTTKRSVDLARSLKYRA

SEQ ID NO: 25128 - protein, 364 aa, Neosartorya fumigata
  strain CEA10 / CBS 144.89 / FGSC A1163
MHFFQSSLVAATMGAALVAAAPAADLETRGSCTFTSTSALKSGKASCSTITLQNIAVPAGETLDLTGLKAGTTVVFDGTTTFGYKEWEGPLISASGTSITIKQNPGAKIDCDGARWWDGKGGNGGKKKPKFFSAHKLNKSNITGLKVYNTPVHGFSIQSDHLTIKDVLLDNSAGTKLGHNTDAFDVGSSTYITIDGATVYNQDDCLAVNSGEHITFTNGYCNGGHGLSIGSVGGRSNNVVNDVTISNSQVINSQNGARIKTVYGATGSVTGVKFQDISLKGITKYGIVVQQDYENGKPTGKPTNGVKVSDITFEKVTGTVTSSATDIYILCGSGSCTNWTWSGNSVTGGKKSSSCKNVPAGASC

SEQ ID NO: 25129 - protein, 739 aa, Neosartorya fumigata
  strain CEA10 / CBS 144.89 / FGSC A1163
MQTLFLSLLAAAVTVHAYGSGGSNWDQAYSRAKDALQKLNQTEKVGLVTGVKWMGGPCVGNTYKPESIDYPSLCLQDSPLGIRFANPVTAFPAGINAGATWDTQLLYARGAAMGAEAKGLGIHVQLGPVAGPLGKNPNGGRNWEGFSVDPYLSGVAMEKTIRGMQDSGVQACAKHWLGNEQEHYRDTISSNIGDRAAHELYVWPFMDAVKAGVASVMCSYNKVNGTWACESDALNNKLMKEELGFPGYIMSDWNAQHSTVNSAVSGLDMTMPGSDFSNPPGSIFWGSNLEAAVADGSVPQSRLDDMVTRILAAWYLVGQDQGYPPVAFSSWNGGKANVDVTADHGTVARAVARDSIVLLKNGHGTLPLRKPKSLAIVGSDAIVNPAGPNACSDRGCNNGTLAMGWGSGTAEFPYLVGPLDAIQKRAAADGTKIVPSTTDDPTAGASAAAAAETAIVFINSDSGEGYITVEGNLGDRNNLDPWHNGNELVKAVAAASKNVIVVIHSVGPIILETILAQPSVKAIVWAGLPGQESGNALVDVIYGDTTPSGKLPYTIAKQAADYGASWINAETDDFPEGLYVDYRHFDAKGIAPRYEFGYGLSYTTFKYSGLWVNMDASAGAANGQVVPGGPADLFEVVGQVSVSVRNNGRVAGAEVAQLYLGLPDSAPATPPKQLRGFQKLMLQPGQTGRATFKLTRRDLSYWDVQQQKWVVPSGTFKVYVGSSSRDIREEGSFRVRRGW

SEQ ID NO: 25130 - protein, 242 aa, Neosartorya fumigata; identical to SEQ ID NO: 24972
  strain CEA10 / CBS 144.89 / FGSC A1163

SEQ ID NO: 25131 - protein, 237 aa, Neosartorya fumigata
  strain CEA10 / CBS 144.89 / FGSC A1163
MLYFTLLHSMTDQRGSDTMTDRKELVAVEHRLLGISNGVYTAAGSQALFDTAGASWCGAGCGKCYNLTSTGSAPCTGCGTGGAAGESIIVMVTNLCPYNGNQQWCPQVGATNNYGYSYHFDIMAQSEVFGDNVVVNFEPVACPGQATSDWETCVCYGQTETDETPVGMTPGGSNPSPLTSTTTTKTTTTETTITTTTGGATQTLYGQCGGSGWTGPTACASGATCKVLNPYYSQCLS

SEQ ID NO: 25132 - protein, 766 aa, Neosartorya fumigata
  strain CEA10 / CBS 144.89 / FGSC A1163
MGEICPRREDFDIDYILKNASLLEKVSLLAGYDFWHTAPLPRFNVPSVRVSDGPNGVRGTKFFDGVRAACLPCGTGLAATWDQSLLYDAGVLIGQDVYPTAAYIRGAQSTGVISTIKHFAANDQEHERISVNAVMSERALREVHLLPFQIAIADSAPGAVMTCYNKVNGQHLSESKEMLDGLLRREWGWKGLIMSDWFGTYSTAEALNAGLDLEMPGPTRLRGPLLELAISSRKVSRATLDERARTVLEFVQRARKAEVSAVESTRDFPEDRRLNRKLAADSIVLLKNESGLLPLNPQTLTSVALIGPNMKTAAFCGGGSASLQPYYSTSPYQGITSQLPPGVEVLYETGATSYAFIPELAASEVRTPEGQPGLGMRFYRDPPSVQERRVVEETIIQESSWQLMGFSNPELDRLFHADIEAELIAPATGPFQFGLAVYGSASLFLDDQLIIDNTTVQRGGTFFFGKGTLEETATVDLVQGQSYQIKVQFASGPSSKLVKPGVVNFGGGAGRLGMVQVVDPERAIARAVEAAKRADITILGVGLTRDHESEGFDRSHMDLPPAVASLVTAVLDVAPDAILLTQSGTPFSMLPWADLVKTHLHAWFGGNELGNGIADVLFGVVNPSGKLPLSFPRRIEDTPTYLNFGSERGQVTYGEGIYVGYKLLRKSPTSCALSIRVRSAPVHPCCFRSNSLLTRFVPQARFVVHLLCVLRFDGRHRVRYTECSKLGRRGRSGSSPAVYRGRSNNVVNRTSHQGAQRISKGGFAAR

SEQ ID NO: 25133 - protein, 88 aa, Neosartorya fumigata; identical to SEQ ID NO: 24945
  strain CEA10 / CBS 144.89 / FGSC A1163

SEQ ID NO: 25134 - protein, 845 aa, Neosartorya fumigata
  strain CEA10 / CBS 144.89 / FGSC A1163
MSKLQQFPLSKGWSFRDNEATSEDAWMPVPVVPSVVHQDLQANNKLKDPYIGFNELEARWVNEKSWTYKTVFQKPAAPAGSCIVLAFDGLDTFAKVKLDGNVILENDNMFLARRVDVTKALEAEGDHVLEIDFDCAFLRAKELRKQDPRHNWASFNGDPSRLSVRKAQYHWGWDWGPVLMTAGIWREVRLEVYSARVADLWTEVQLASDHQSAQVTAFVEVESVHSGSHRACFTLSLHGQEITREEIGVTENGTAKATFDVKEPSLWWPHGYGDATLYEVSVSLVKEQEELHRVSKKFGIRTAEVIQRPDKHGKSFFFRVNGVDIFCGGSCWIPADNLLPSITAERYRKWIELMVHGRQVMIRVWGGGIYEDYSFYDACDELGVLVWQDFMFGCGNYPTWPNLLESIRKESVYNVRRLRHHPSIVIWVGNNEDYQVQEQAGLTYNYEDKDPENWLKTDFPARYIYEKLLPEVVQEYSPGTFYHPGSPWGDGKTTSDPTVGDMHQWNVWHGTQEKYQIFDTLGGRFNSEFGMEAFPHMSTIDYFVENEADKYPQSHVLDFHNKADGHERRIATYLVENLRTATDLETHIYLTQVVQAETMMFGYRGWRRQWGDERHCGGALLWQLNDCWPTISWAIVDYFLRPKPAFYAVARVLNPIAVGVRREHHDWSVTHAQPPKTSKFELWVASSRQQEIQGTVELRFLSVNTGLEVRERIVHENVSIVPNGTTNLIVDGLIDHTVHSEPHVLAARIWVDGQLVARDVDWPQPFKYLDLSDRGLEVKKISESEDEQTLLISTKKPVKCLVFEEREGVRISDSAMDIVPGDDQRVTIKGLKPGDAPLKYKFLGQ

SEQ ID NO: 25135 - protein, 407 aa, Neosartorya fumigata
  strain CEA10 / CBS 144.89 / FGSC A1163
MAQTLAAASLVLVPLVTAQQIGSIAENHPELKTYRCGSQAGCVAQSTSVVLDINAHWIHQMGAQTSCTTSSGLDPSLCPDKVTCSQNCVVEGITDYSSFGVQNSGDAITLRQYQVQNGQIKTLRPRVYLLAEDGINYSKLQLLNQEFTFDVDASKLPCGMNGALYLSEMDASGGRSALNPAGATYGTGYCDAQCFNPGPWINGEANTLGAGACCQEMDLWEANSRSTIFSPHPCTTAGLYACTGAECYSICDGYGCTYNPYELGAKDYYGYGLTVDTAKPITVVMQFVTADNTATGTLAEIRRLYVQEGMVIGNSAVAMTEAFCSSSRTFEALGGLQRMGEALGRGMVPVFSIWDDPSLWMHWLDSDGAGPCGSTEGDPAFIQANYPNTAVTFSKVRWGDIDSTYSV

SEQ ID NO: 25136 - protein, 375 aa, Neosartorya fumigata
  strain CEA10 / CBS 144.89 / FGSC A1163
MKYAAFLPTIGALVSQAIAIGVQGTAEGFASSVTGGGSATPVYPSTTDELVSYLGDSEARVIVLTKTFDFTGTEGTTTATGCAPWGTASGCQVAINKDNWCTNYQSSAPSVSVTYDNAGSLGITVNSNKSLIGEGTSGVIKGKGLRIVSGAKNIIIQNIAITDINPKYVWGGDAITINQADLVWVDHVTTARIGRQHYVLGTEASNRITLSNNYIDGESDYSATCDNHHYWNIYLDGSSDKVTLKGNYLYKTSGRAPKVQGNTYLHAVNNYWNDNSNHAFEIGDGAYVLAEGNLFSDVTAAVESSSFTGELFGSASASSTCQSYIGRDCVANSFSSSGTLSGSNVDVLSKFKGETVASASAAGTSPASSAGQGHL

SEQ ID NO: 25137 - protein, 478 aa, Neosartorya fumigata
  strain CEA10 / CBS 144.89 / FGSC A1163
MTLLLGIFLARLAVAAAQSSCVSAWGQCGGISYTGSTCCQSGNTCAEINSYYYQCIPATAVSTSTTTVTSPSSSGSSSANTSGYTTTTVLPSPTATQNPYPPANASSCGSWALVDNVCCPYYCLSDNESESCTSSCTGGCGSPDSSMCKSGTMWGEQHTVTSNEDWHYSRSTHFGLTSGGACGFGLYGLCTKNSVTASWTDPMLGSTCDAFCTAYPLLCKDPANVTLRGNFAAPNGDYYTQFWPSLAASGNPDNYLSCGECFEVIRTKPDGTDYAVGESGYTDPIVLEVVDSCPCNANSKWCCGSGADHCGEIDFKYGCPLPEGSHHMDLSDIAMGRLQGNGSLADGVIPIRYRRVPCPKPGNIYIWLHDGAGPYYFALSAVNTNGPGSVISIEVQAGGSGPWVALEHDPNYTSSRPQERYGSWVLPQGKGPITVPVSMRLTAPNGQQVVKEGAITSYTPPATAVEGFWYIDLGVQFT

SEQ ID NO: 25138 - protein, 432 aa, Neosartorya fumigata; identical to SEQ ID NO: 24958
  strain CEA10 / CBS 144.89 / FGSC A1163

SEQ ID NO: 25139 - protein, 460 aa, Neosartorya fumigata
  strain CEA10 / CBS 144.89 / FGSC A1163
MDSKRGVVAAVLALLPLVSAQQPAASSAGNPKLTTYKCTTAGGCVAQDTSVVLDWGYHWIHTVDGYTSCTTSSGVDSTLCPDAATCAKNCVIEPANYTSAGVTTSGDSLTMYQYVQSNGVYTNASPRLYLLGPDKNYVMLKLLGQELTFDVDLSTLPCGENGALYLSEMSATGGRNEYNTGGAEYGSGYCDAQCPVIAWKNGTLNTSGASYCCNEMDILEANSRANSYTPHPCSATDCDKGGCGFNPYALGQKSYWGPGGTVDTSKPFTITTQFITDDGTTTGTLSEIRRQYMQNGKVIANAVSSTGVNSITEDWCTSVDGSAATFGGLTTMGKALGRGMVLIFSIWNDASGFMNWLDSGNAGPCSSTEGNPDLIKAQNPTTHVVFSNIRWGDIGSTFKGSDGSVTTTTSTTSTKTTTSTAPGPTQTHYGQCGGQGWTGPTACASPYTCQVLNPWYSQCL

SEQ ID NO: 25140 - protein, 321 aa, Neosartorya fumigata
  strain CEA10 / CBS 144.89 / FGSC A1163
MYLYTLILLFLASANVNAYANPGACSGNCWTHDPGLYQRKSDGKYFRFATGGGIHIASADSLEGPWTDDGYVLPSGSIIDLDGKTNLWAPDLHYHDGTYYLYYAVSSLGSQNSAIGVATSKTMEAGSWTDHGTTGIESTPSSPYNTIDANWIAVGGNQYVNFGSYWNNLFQVEMENGLKVKSGATPHQIAYNASGIHRQEAAFMFERNNYFYLTFSGGIALGYNDTWPAPGEEYFIAVCRSTSATGGFVDKNGVSCLNSGGSLLLSSHDFVYGPGGQGILQDSSKGFVLYYHYADTRIGKAVEDYQFGWNQLKWENDWPSV

SEQ ID NO: 25141 - protein, 528 aa, Neosartorya fumigata
  strain CEA10 / CBS 144.89 / FGSC A1163
MMWWFLLIGLASAAATASSASSASFESRCQHFHKEIHLQNVHVLSTTYVPIGSNIPMVYNPPICGGTASSSISTIQFCQVALNVTTSDKSQFFMEAWLPSNYTGRFLSTGNGGLNGCVSYADMVYATQYGFATIGTNNGHFGDTGQYFLNNPEVIEDFAYRALHTGTVVGKALTKLFYPQGYKNSYYLGCSTGGRQGWKSIQRFPDDFDGVVAGAPAINFVNLCSWGSRFLKITGPPGSETFVTSAQWSAVHNEILRQCDALDGAVDGIIEDTDLCQPVFETLLCNSTAVDKTSCLTGVQANTVNEVFSAMYGLDGKWLYPRMQPGSELAASFIYYSGNGFKYSDDWYKYVVYNDSNWDHSTWTLADAAAAAAQDPFQISSFDGNISGFQKAGGKVLHYHGLEDAIITSDSSKAYYKHVADTMGLSPSELDHFYRLFPISGMGHCSPGTGAASIGQGSSTYAGDDPQDNVLMAIVQWVEKGIAPEYVRGSKMSRDGTIDYRRKHCKYPKRNRYVGPGKYTDENAWKCV

SEQ ID NO: 25142 - protein, 388 aa, Neosartorya fumigata; identical to SEQ ID NO: 24920
  strain CEA10 / CBS 144.89 / FGSC A1163

SEQ ID NO: 25143 - protein, 528 aa, Neosartorya fumigata; identical to SEQ ID NO: 24940
  strain CEA10 / CBS 144.89 / FGSC A1163

SEQ ID NO: 25144 - protein, 648 aa, Neosartorya fumigata; identical to SEQ ID NO: 24923
  strain CEA10 / CBS 144.89 / FGSC A1163

SEQ ID NO: 25145 - protein, 454 aa, Neosartorya fumigata
  strain CEA10 / CBS 144.89 / FGSC A1163
MRGVWRYMPVYYYKCMLIPLLTFTKISIISKPQESRISLIICRTMPTVATFLGLAISGAAMASGAALGAYNVDPNSISVSGLSSGGFMSAQLGVAYSDTFKVGFGVFAGGPYDCARGQSYTTCMYNQNPSITTPVANMKSWSGNKINPVSNLQSRKIYMWTGTADTTVGPNVMSQLKTQLANFASAANVSYITTSGAAHTFPTDFDAAGDNSCSSSVSPYISNCQYDGAGAVLQWMYGPLNARNPGTLSGSIVSFSQTGEYGASGMDTTGYLYVPRACQPGSSTVCKLHVALHGCKQSYSMIGSKFVSNTGYNMWADTNDIIILYPQAVADNTMHTIWTGMPLPNPNGCWDWVGWYGANADQVGGVQMAAIVNQVARVVSGYGAGSSSSTTAATPTTTTGSITTTTTTTATVTTTAVAPLYGQCGGIGWTGPTACATGVCTAYSPYYAQCLLIV

SEQ ID NO: 25146 - protein, 217 aa, Neosartorya fumigata; identical to SEQ ID NO: 24942
  strain CEA10 / CBS 144.89 / FGSC A1163

SEQ ID NO: 25147 - protein, 355 aa, Neosartorya fumigata
  strain CEA10 / CBS 144.89 / FGSC A1163
MKITALASAILAVAQGALALPARAPALDITLSQVNNTRIKAVVKNSGTEKITFVHLNFFNDPSPVKKVSLYRNATEVEFTGIKQRLRSDGLSNDALTTLAPGATYEDEFDIASTANLTQGGPVTVRTQGFVPIAMNNKIAGYIPYSSNELELEVDAEKAVAVPASIKPLDRRTKITSSCTGNRATVLNTALRNAASIASKAADAASSGSSALFTEYFKSTSGNIRSAVAARLKAVASEASMNGGGSTTYYCSDPYGYCDSNVLAYTLPSTNEVVNCELFYTLQEVTNDCHGQDQATTIIHEFTHAPGVYPPGTEDLGYGYSAATALSTSNALNNADSYALFANGTSSFCVMTAFS

SEQ ID NO: 25148 - protein, 466 aa, Neosartorya fumigata
  strain CEA10 / CBS 144.89 / FGSC A1163
MPQRIQLDILASICEHHACTFSSLYPLGSGSGPAHRPFDCNILSYGAVADNTTDISTSLESAFNWCVRPNPGSRLVVPEGQYLISRGVVLSNATNWAFQLDGLITVAYGGNWTIDRALILEGLAGTDVLNTTINGEGDQKFLLDVLVIVNAVDFEFYSSNGLGAFQGQGYLYRNLNNTDRPRLVRLISPINASVHDLILVDSPKFHIVLDFAINVEAYHLTIRGANLGSYDGIDVIGTNYHIHDNEVTNRDECVSVKSPSHHALIENLVCNQAGSGISIGSLNVSAEISNILAQNISIIQGNNIAFIKTYPGGSGYVTNVTFSNFRSKASLYGLNINQYWQNTFEPDTGSVTLSNLVFRNFSGSVANGVQRPPLYLIANDLTYATNVTVEDFTVWTESGSSIVNKISNVFGHGDDSYGPNNGLVSLGAAEQPHTYTSTNIITASPTGWVPPKSPTWAAPSTGYGSK

SEQ ID NO: 25149 - protein, 587 aa, Penicillium amagasakiense
YLPAQQIDVQSSLLSDPSKVAGKTYDYIIAGGGLTGLTVAAKLTENPKIKVLVIEKGFYESNDGAIIEDPNAYGQIFGTTVDQNYLTVPLINNRTNNIKAGKGLGGSTLINGDSWTRPDKVQIDSWEKVFGMEGWNWDNMFEYMKKAEAARTPTAAQLAAGHSFNATCHGTNGTVQSGARDNGQPWSPIMKALMNTVSALGVPVQQDFLCGHPRGVSMIMNNLDENQVRVDAARAWLLPNYQRSNLEILTGQMVGKVLFKQTASGPQAVGVNFGTNKAVNFDVFAKHEVLLAAGSAISPLILEYSGIGLKSVLDQANVTQLLDLPVGINMQDQTTTTVSSRASSAGAGQGQAVFFANFTETFGDYAPQARDLLNTKLDQWAEETVARGGFHNVTALKVQYENYRNWLLDEDVAFAELFMDTEGKINFDLWDLIPFTRGSVHILSSDPYLWQFANDPKFFLNEFDLLGQAAASKLARDLTSQGAMKEYFAGETLPGYNLVQNATLSQWSDYVLQNFRPNWHAVSSCSMMSRELGGVVDATAKVYGTQGLRVIDGSIPPTQVSSHVMTIFYGMALKVADAILDDYAKSA

SEQ ID NO: 25150 - protein, 421 aa, Penicillium brasilianum
MKYPLLLATSAALALAGPQGFSKRASSFVWFGTSESGAEFGNQNIPGVLGTDYIWPDTSAIQTLRNAGMNIFRVAFLMERLVPTTLTSTPDSTYLQDLKSVLDYITSTGAYAIVDPHNFGRYYGNIINSTSDFAAFWTTVAKQFASNDKVIFDTNNEFNTEDQTLVLNLNQAAINAIRAAGATSQYIFVEGNSWSGAWTWTSVNTNLVSLTDPNNKIVYEMHQYLDSDGSGTSDTCVSSTIGQERVQSATEWLKSNGKLGFLGEFAGGANSVCQSAVTGMLDYMQANSDVWLGASWWAAGPWWGTYIYSIEPPSGTAYSYYLNILSAYFPSSSGSSTTTTTSTTTRSTSTSTTVSTTKSTSTTTSATKSTSTTTSTTSTGSTATATASHWAQCGGIGWTGATTCASPYTCQVQNAYYSQCL

SEQ ID NO: 25151 - protein, 64 aa, Penicillium brevicompactum
DTCGSGYNVDQRRTNSGCKAGNGDRHFCGCDRTGVVECKGGKWTEVQDCGSSSCKGTSNGGATC

SEQ ID NO: 25152 - protein, 248 aa, Penicillium chrysogenum
HFDINGMKGYSASFDDRTVKDIASDPTVKYVEPDMVVNATANVVQRNAPSWGLSRISSKKSGATDYVYDSTAGEGIVIYGVDTGIDIGHADFGGRAEWGTNTADNDDTDGNGHGTHTASTAAGSKFGVAKKASVVAVKVLGADGSGTNSQVIAGMDWAVKDSKSRGATGKSVMNMSLGGAYSRAMNDAAANVVRSGVFLSVAAGNEAQDASNSSPASAPNVCTIAASTNSDGSASFTNFGSVVDLYAP

SEQ ID NO: 25153 - protein, 92 aa, Penicillium chrysogenum
MQITSIAIVFFAAMGAVANPIARESDDLDARDVQLSKFGGECSLKHNTCTYLKGGKNHVVNCGSAANKKCKSDRHHCEYDEHHKRVDCQTPV

SEQ ID NO: 25154 - protein, 353 aa, Penicillium chrysogenum
MIPNITQLKTAALVMLFAGQALSGPVESRQASESIDAKFKAHGKKYLGNIADQGTLNGNPKTPAIIKANFGQLSPENSMKWDATEPSQGQFSFAGSDYFVEFAETNGKLIRGHTLVWHSQLPSWVSSITDKTTLTDVMKNHITTVMKQYKGKLYAWDVVNEIFEEDGTLRDSVFSRVLGEDFVRIAFETAREADPEAKLYINDYNLDSATSAKLQGMVSHVKKWIAAGVPIDGIGSQTHLGAGAGAAASGALNALASAGTEEVAVTELDIAGATSTDYVDVVNACLDQPKCVGITVWGVADPDSWRADESPLLFDASYNPKEAYNVSQLLSRQHAFDLYLKLGNLLLSRLHSD

SEQ ID NO: 25155 - protein, 412 aa, Penicillium chrysogenum
MLTKQTLLAFVGALALATGTTTTEETPTQAEIDAARATALPYSPVSNVKGLAFDRFVNIWLENTDFEPAALDENLSKLAKEGILLTNYFAISHPSQPNYCASAGGDTFGMDNDDFLQIPSNVSTIADLFDTKHISWGEYQEDMPYAGYQGKRYPLSGPNQYVRKHNPLVLFNSVTDDAVRPRQIKNFTTFYDDLKHHSLPQHMFITPNMTNDAHDTNITVAGNWVDRFLSPLLKNEYFTKDSLVLLTFDEGDTYSYPNRVFSFLVGGAIPEHLKGTTDDTFYTHYSIVASLSANWGLPSLGRWDCGANLLKMVADKTGYVNWEVDTSNVYLNETYPGPMSTDNYSSKWAVPATKGKCSAGHGIAEVVKNTYHGLQPTYDYASPVPYDVTSGNNVGIKYHRTLVCILSCSSLS

SEQ ID NO: 25156 - protein, 612 aa, Penicillium chrysogenum
DITFAGVQRALPNAPDGYVPTSVSCPASRPTVRSAAKLSTNETSWLEVRRGKTLSALKDFFGHVKVGDYDVGAYLDKHSGNSSSLPNIGIAVSGGGWRALMNGAGAVKAFDSRTDNATATGHLGGLLQSATYISGLSGGSWLLGSIYINNFTTVDKLQTHEAGSVWQFGNSIIEGPDAGGIQLLDSAGYYKDLADAVDGKKKAGFDTTLTDIWGRALSYQMFNASNGGLSYTWSSIADTPEFQDGDYPMPFVVADGRNPGELVIGSNSTVYEFNPWEFGTFDPTIFGFVPLEYLGSKFEGGSLPSNESCIRGFDSAGFVIGTSSSLFNQFLLQINTTSLPSFIKDVFNGILFDLDKSQNDIASYDPNPFYKYNEHSSPYAAQKLLDVVDGGEDGQNVPLHPLIQPERHVDVIFAVDSSADTDYFWPNGTSLVATYERSLNSSGIANGTAFPAVPDQNTFINLGLSTRPSFFGCDSSNQTGPSPLVVYIPNAPYSYHSNISTFQLSTDDAERDNIILNGYEVATMANSTLDDNWTACVACAILSRSFERTGTTLPDICSQCFDRYCWNGTVNSTRPESYDPAFYLADNSMASVSLPTMLSTVVAAGLAMLILV

SEQ ID NO: 25157 - protein, 398 aa, Penicillium chrysogenum
MGFLKVLATSLATLAVVNAGKLLTGSDAGAVVPGSYIVVMNDGVSNDVFKNHRDWAATVHARIASRKGGESGPGKNFDINGMKGYTASFDDRTVKDIASDPAVKYVEPDMVVNATENVVQPNAPSWGLPRISSQKPGATDYVYDSTAGEGIVVYGVDTGIDIRHSDFEGRAEWGTNTVDNDNTDGNGHGTHTASTAVGSKFGVAKKASVVAVKVLSADGSGTNSQVIAGMEWAVKDAKSRGVTGKSVMNMSLGGAFSRAMNDAAANVVKSGVFLSVAAGNEAQDASNSSPASAPNVCTIAASTSSDRSASFSNFGSVVDLYAPGESITAAYPGGGSKTLSGTSMAAPHVAGAAAYLMALEGVASDKACARIVELAISSISSAPFGTTSKLLFNGLNAK

SEQ ID NO: 25158 - protein, 529 aa, Penicillium chrysogenum
MASTLSFKIYKNALLLAAFLGAAQAQQVGTSTAEVHPSLTWQKCTAGGSCTSQSGKVVIDSNWRWVHNTGGYTNCYTGNDWDRTLCPDDVTCATNCALDGADYKGTYGVTASGSSLRLNFVTQASQKNIGSRLYLMADDSKYEMFQLLNQEFTFDVDVSNLPCGLNGALYFVAMDEDGGMARYPTNKAGAKYGTGYCDAQCPRDLKFINGQANVEGWEPSSSDVNGGTGNYGSCCAEMDIWEANSISTAFTPHPCDDPAQTRCTGDSCGGTYSSDRYGGTCDPDGCDFNPYRMGNQSFYGPSKIVDTESPFTVVTQFITNDGTSTGTLSEIKRFYVQNGKVIPQSVSTISAVTGNSITDSFCSAQKTAFKDTDVFAKHGGMAGMGAGLAEGMVLVMSLWDDHAANMLWLDSTYPTSASSTTPGAARGSCDISSGEPSDVEANHSNAYVVYSNIKVGPLGSTFGSTDSGSGTTTTKVTTTTATKTTTTTGPSTTGAAHYAQCGGQNWTGPTTCASPYTCQRQGDYYSQCL

SEQ ID NO: 25159 - protein, 398 aa, Penicillium chrysogenum
MGFLKLLSTSLATLAVVNAGKLLTANDGDEVVPSSYIVVMNDGVSTAQFETHRNWAANVHARTRSLKGGESGPGKHFDINGMKGYSASFDDRTVKDIASDPTVKYVEPDMVVNANANVVQRNAPSWGLSRISSKKSGATDYVYDSTAGEGIVIYGVDTGIDIGHADFGGRAEWGTNTAENDDTDGNGHGTHTASTAAGRKFGVAKKPSAVAVKVLGADGSGTNSQVIAGMDWAVKDSKSRGATGKSVMNMSLGGAYSRAMNDAAANVVRSGVFLSVAAGNEAQDASNSSPASAPNVCTIAASTNSDESASFTNFGSVVDLYAPGKDITAAYPGGGSKTLSGTSMAAPRVAGAAAYLMALEGVTSDKACARIVELAISSISSAPSGTTSKLLYNGINAQ

SEQ ID NO: 25160 - protein, 398 aa, Penicillium chrysogenum
MGFLKLLSTSLATLAVVNAGKLLTANDGDEVVPSSYIVVMNDGVSTAQFETHRNWAANVHARTRSLKGGESGPGKHFDINGMKGYSASFDDRTVKDIASDPTVKYVEPDMVVNATANVVQRNAPSWGLSRISSKKSGATDYVYDSTAGEGIVIYGVDTGIDIGHADFGGRAEWGTNTADNDDTDGNGHGTHTASTAAGSKFGVAKKASVVAVKVLGADGSGTNSQVIAGMDWAVKDSKSRGATGKSVMNMSLGGAYSRAMNDAAANVVRSGVFLSVAAGNEAQDASNSSPASAPNVCTIAASTNSDGSASFTNFGSVVDLYAPGKDITAAYPGGGSKTLSGTSMAAPHVAGAAAYLMALEGVTSDKACARIVELAISSISSAPSGTTSKLLYNGINAQ

SEQ ID NO: 25161 - protein, 397 aa, Penicillium chrysogenum
MGFLKVLATSLATLAVVDAGTLLTASNTDAVIPSSYIVVMNDDVSTAEFSTHREWATNVHARLSRRKNGETGPGKHFEINGLKGYTASFDENTAKDIANDPAVKYIEPDMIVNATANVVQSNVPSWGLARISSKRTGTTSYTYDSTAGEGVVFYGVDTGIDISHSDFGGRAKWGTNVVDNDNTDGNGHGTHTASTAAGSKYGVAKKATLVAVKVLGADGSGTNSGVISGMDWAVKDAKSRGANGKYVMNTSLGGEFSKAVNDAAANVVKSGIFLSVAAGNEAENASNSSPASAAEACTIAASTSTDGSASFTNFGSVVDLYAPGQSITAAYPGGGSKTLSGTSMAAPHVAGVAAYLMALEGVSAGNACARIVQLATSSISRAPSGTTSKLLYNGINV

SEQ ID NO: 25162 - protein, 1013 aa, Penicillium chrysogenum
  strain ATCC 28089 / DSM 1075 / Wisconsin 54-1255
MTRILNCLLVLLACLGVSSKAEDQAVTQWPLQDNGLNTVVQWDHYSFQINGQRIFIFSGEFHYWRIPVPALWRDILEKIKAAGFTAFAFYSSWAYHAPNNATVDFTTGARDITPIFELAKELGMYIIVRPGPYVNAEANAGGFPLWVTTGDYGTLRNDDTRYTNAWTPYFTEVTEITSRYQVTDGHYSIVYQIENEYGNQWLGDPTLRVPNETAIAYMELLKANARDNGITLPLTVNDPNMKTHSWGKDWSDAGGNVDVAGLDSYPSCWTCDISQCTSTNGAYVPFQVLEYHDYFQESQPSMPAFMPEFQGGSYNPWGGPEGGCPGDIGDDFANLFYRWNIGQRVTAMSLYMMFGGQNPGAMAAPVTASSYDYSAPISEDRSIWSKYHETKLLALFTRSAKDLTMTELMGNGTQYTDNPAVRAYELRNPETNSAFYATFHSNTSISTNEPFHLKVNTSAGVLTVPKYASTIRLNGHQSKIIVTDFTFGSKSLLYSTAEVLTYAVFDKKPTLVLWVPTGESGEFSIKGAKKGSIKKCQGCSRVKFIKEHGGLTTSLTQSAGMTVLEFDDGVRVILLDRTSAYDFWAPALTNDPFVPETESVLIQGPYLVRDAKLSGSKLAITGDVVNATTLDVFAPKGVKSVTWNGKKVDTHSTEYGSLKGSLDAPQSIKLPALASWKSKDSLPERFADYDDSGAAWVDANHMTTLNPRTPTSLPVLYADQYGFHNGVRLWRGYFNGTATGAFINVQGGSAFGWSAWLNGEFLASHLGNATTSQANLSLSFTDATLHTDTPNVLLIVHDDTGHDQTTGALNPRGIMDAKLLGSDSGFTHWRLAGTAGGESDLDPVRGVYNEDGLFAERVGWHLPGFDDSDWGEEGSAKDSTTSVLSFEGATVRFFRTTCPLDIPAHTDVSISFVLSTPAGATTEYRAQLFVNGYQYGRYNPYIGNQVVYPVPVGILDYKGENTIGVAVWAQSEEGASIGIDWRVNYLADSSLDVASWDTKDLRPGWTEERVKYA

SEQ ID NO: 25163 - protein, 92 aa, Penicillium chrysogenum
  strain ATCC 28089 / DSM 1075 / Wisconsin 54-1255
MHITSIAIVFFAAMGAVASPIATESDDLDARDVQLSKFGGECSLKHNTCTYLKGGKNHVVNCGSAANKKCKSDRHHCEYDEHHKRVDCQTPV

SEQ ID NO: 25164 - protein, 651 aa, Penicillium chrysogenum
  strain ATCC 28089 / DSM 1075 / Wisconsin 54-1255
MASGMLSMCPTPRNTPNRPIRPVRICVCGDEGTGKSSLITSLVKGVFVTNKIQPVLPQITIPPTLGTPENVTTTTVVDTSALPQERNNLAREIRKCNVILLVYSDHYSYERVALFWLPYFRSLGVNVPVVLCANKSDLATGHSETRVVEEEMLPLMAEFKEIDSCIRTSAREHRNVNEAFFVCQKAVTHPIAPLFDSKEAALKPAAVAALQRIFYLCDKDRDGYLSDKELKDFQIRCFSKPLNEADLNHIKDTIQKAYPDSVTESGIDCQGFIHLNKLYSEKGRHETVWIILRAFQYTDNLSLQEKFLHPKFEVPPYASAELSPEGYRFFVNLFLLSDKDNDGGLNEAELASLFAPTPGLPASWVDSSFPSSTVRNEAGHVTLQGWLAQWSMTTFLSPKTTLEYLAYLGFEPSDQSDQSITAALKVTRPRRKRRRPGRVGRNVVQCHVLGAPGSGKSALLDALLSRGFSTTYHPTIQPRTAVNTVELPGGKQCYLILDELGELEPALLENQSKLLDQCDVIAYTYDSSDPDSFSYIPALLAKYPHLEELPSVFIALKADLDRTTQRAEHQPHEYTAMLNMPSPPLHVSVTWSSIQEVFVHIAEAAMEPSTAFPRSEEDVEGKWMSWGIALGAVVCAGAAAVMIWRRVGSGN

SEQ ID NO: 25165 - protein, 351 aa, Penicillium chrysogenum
  strain ATCC 28089 / DSM 1075 / Wisconsin 54-1255
MYSLLGPALFGSLVAAHGHVTNIVINGVSFDGWDINSDPYAQTPPVVVAWGTPNTANGFIAPDAYETSDIICHLDATNAKGHAVVAAGDRVFLQWTPDWPVSHHGPIVDYLASCGASGCETVDKTTLEFFKIDGVGLVDGTTVPGFWADDQLIAQDSGWMVEIPSSIAPGHYVLRHEMIALHGAGTEGGAQNYPQCFNLQITGSGSDKPPGVLGTDLYRPTDPGILVNIYTSLSTYIVPGPTLYSGAVSIVQTTSAITASGTPVTGTGGATGGTTTTTTSKASTTTLVTTTNAATTTSKATTTTAPGGGGATQTPYGQCGGSGWTGATACASPAACSSLNPWYSQCVPTAA

SEQ ID NO: 25166 - protein, 212 aa, Penicillium chrysogenum
  strain ATCC 28089 / DSM 1075 / Wisconsin 54-1255
MNFKLLSLLLAGLATAGPIEQRQTSSSGNELRDGPCQPVTFIFARASTEQGLLGGSTGPAVCNDLKSARNQEVACQGVGPKYQATLAANSLPAGTSDEAIEEAKGLFEQAASKCPDTQIVAGGYSQGTAVMHGAIPKLSDAIKDQIKGVVLFGDTRNQQDNEQIPDFPKDKTKIYCAVGDQVCHGSLIVAAPHFSYVADAGDASRFLVEKLD

SEQ ID NO: 25167 - protein, 385 aa, Penicillium chrysogenum
  strain ATCC 28089 / DSM 1075 / Wisconsin 54-1255
MKFLTLALSATATAMIIVNPEQQPLAPSIVQNPQHKSLIELAPYRTRWVTEEEKWSLKLDGVNFIDVTDEYQSGSYGTLHTTRVVHYPGAMEHAHEILPLTETLDKSNMRSNLEHFTSFYTRYYKSQTGIESATWLFDQVTAAVHESGASDHGATVERFAHPWGQFSIIARIPGQTDNTVILGSHQDSINLFLPSILAAPGADDDGSGTVTILEALRALLRSETIAHGQARNTIEFHWYSAEEGGLLGSQAVYANYKKNQRNVKAMLQQDMTGYVQGTLDAGEKESVGVIIDYVDQGLTAFIKEVITTYCDVPYVETKCGYACSDHASASRYGYPSAFVIESQFENSDKRIHTTEDKIEYLSFDHMLQHAKMSLAFAYELAFAPF

SEQ ID NO: 25168 - protein, 300 aa, Penicillium chrysogenum
  strain ATCC 28089 / DSM 1075 / Wisconsin 54-1255
MRSAVILAALAVGTCARVIEKEVYVTEWTTTTATETVTQWPTNAPSTAVLVKQDPTKPANAAVHTADISKKTTVESVPPAAPTPAPEVEPAEPSSATTWSSTWSSATEAEIQPETSSAAPVATSSATSTTAAATAAPSAGNSYHESVLHYHNIHRSDHSASALTWSDDLAQAAHTLASRCVYEHDTSIPSASGSYGQNIAYGYDEAQVGEKIISQMMYTDEEPYFASLYGQASPDMSNFSKWGHFTQIVWKGTSHVGCATVSCSDLKNAGGAAPFTVCNYGTPGNYAGEYADNVLKPNSA

SEQ ID NO: 25169 - protein, 982 aa, Penicillium chrysogenum
  strain ATCC 28089 / DSM 1075 / Wisconsin 54-1255
MRLFALLPVLLGLISSHFVSATDNGKTTDVTWDKYSLSVKGERVYVFSGEFHYQRLPVPELWLDVFQKLRANGFNAISIYFFWSFHSASEDTFDFENGAHDVQRVFDYAKQAGLYVIARAGPYCNAETSAGGFALWASNGQMGSTRTSASSYYDRWYPWIQEIGKIIAANQITNGGPVILNQHENELQETIHSADNTVVKYMEQIKAAFSDAGIIVPSTHNEKGMRSMSWSTDYQDVGGAVNIYGLDSYPGGLSCTNPNSGFNLVRTYYQWFQNYSSSQPEYLPEFEGGWFSAWGGSFYDQCSTELSPEFADVYYKNNIGSRVTLHNIYMVMGATSWGQSAAPVVYTSYDYSAPMRETREIRDKLKQTKLIGLFTRVSSGLLQTQMEGNGTGYTSDASIYTWALRNPETHAGFYVLAHSTSSSRAVTTTSLNVNTSAGALTIPNIELAGRQSKIIVTDYQTGDGSSLLYSSAEVLTYATLDVDVIVFYLNIGQKGEFAFKDAPTHLTFKTYGNSKVSSAKSDHGTKYTYCQGDGTTVLKFSHGVLVYLLDKETAWNFFAVPTTSNPRVAPSEQILALGPYLVRTASVSGHTVSLVGDNANATSLEVYTGNSKVTQIKWNGKETPTKKTAYGSLIGSAPGAEHAKLSLPTLKSWKAQDTLPEINPDYDDSRWTVCNKTTSVNSVAPLTLPVLYSGDYGYHAGTKIYRGRFDGVTATGANITVQNGVAAGWAAWLNGVYVGGAIGDPDLAATSAELEFTSSTLRRKDNVLTVVMDYTGHDQANVKPNGSQNPRGILGATLLGGDFTSWRIQGNAGGEANIDPVRGPMNEGGLYGERLGWHLPGYKGSKTATSESPLDGVSGAAGRFYTTTFKLDLDSDLDVPIGLQLGASADAPAVVQIFMNGYQFGHYLPHIGPQTRFPFPPGVINNRGENTLAISLWALTEQGARLSQVDLVAYGAYRTGFNFNHDWSYLQPQWENNRGQYV

SEQ ID NO: 25170 - protein, 437 aa, Penicillium chrysogenum
  strain ATCC 28089 / DSM 1075 / Wisconsin 54-1255
MKFLAIGALLLSTVSALATEHIIKGAQIIPASDKAGLKKIGAHGHHKHHDRRTVTIRSSKSDTDDISDDFLWGIKAANHGGRLLLQKGKTYVIGKKLDLSFLDDIEVQLEGEVKFTDDIDYWQANHFYYSFQRSITFWVWGGQDIKIFGKGTLNGNGQEWYNAFAGMEILDPDNVFYRPVLFVTDNATRVSVEGITQLNSPCWTNFFVRTKDVSFDDVYINSFSTNASALPKNTDGFDSFNVDGLRVTNTRVDVGDDCFAPKPNTTNIFVQNLWCNNTHGVSMGSIGQYPGVEDIIEHAWIENVTLVNGQNGVRLKAWAGPDVGFGRINNITYKDVRVENTDSPIVLDQCYFNIDAATCAEYPSSVNFTNINFENIYGTSSGKNGKVVADLTCSPNSVCTDIHLSDIDITSPAGGPPIVTCDGIDGDVGVECQSSSA

SEQ ID NO: 25171 - protein, 103 aa, Penicillium chrysogenum
  strain ATCC 28089 / DSM 1075 / Wisconsin 54-1255
MHFHYQTLGAVLASLVFSTASAAYCRVGDMWPDMHDCHNFFECAAGGIPVLKTCGPGTAYCHETRVCDYEGKIPLCSHKGWKWDVATKKGREGAAHPRGFGDA

SEQ ID NO: 25172 - protein, 317 aa, Penicillium chrysogenum
  strain ATCC 28089 / DSM 1075 / Wisconsin 54-1255
MAPSFITIDANDMDVDFSTTKPVQAKRTLLLAPPSIATQEDKLRDLFSTFDRSTTDLQMLDRLSAGVVSLPATTYDLVLILTDTDGTRRSEALQLLTRNVYTTLVPAMKAGAKLQTQDSALNASDAMEAVLAGLVQSDNGFEKPNFEPSAAVPLKFGLKKKNKPTPTAVPSIPTGFAAPMGIDSPVTNHDRDEDDELINEDTLLSEEDLTRPIMPPPECQPKTGRRRRACKDCTCGLADKLEAEDKERRANADKELNVMKLDTGDLNELDFTVEGKTGSCGSCALGDAFRCDGCPYMGLPAFKPGQEVQILNDVAQL

SEQ ID NO: 25173 - protein, 438 aa, Penicillium chrysogenum
  strain ATCC 28089 / DSM 1075 / Wisconsin 54-1255
MSIEVDWAAATSGPDGEALAERIRSFVHDKFQEITLPRFIRSVQVHSFDFGTIAPDLEVKDICEPFADFYEEEADDADTSVASEELGHELHESPYEDDMTYNPTAHNLHSFSHHPYPGEGFQPSALRSPLGDHLNPHFMPRASTPGIPGGTSTLGYHMRSLGGLSGTQTPLAAVAGGTSFASGWSDSGMGVGPRSQAARPAGPHHLAEPDLDTTNSTSRPSTANTLPSHPSLGHSGSSGSNPHTSDPTDAPQPSIETSDDPAAEGHSLPIPPRMRERRPEDFQVLCHAKYAGDVRMSLTAEILLDYPMPSFVGLPLKLNVTGITFDGVAVVAYIRKRVHFCFLSAEDADALLGSEQSQGSQNPSDDGRPRSGGDQKDKELKRQGGLLQEIRVDSEIGRKEDGKQVLKNVGKVERFVLAQVRRIFEEELVYPSFWTFLV

SEQ ID NO: 25174 - protein, 425 aa, Penicillium chrysogenum
  strain ATCC 28089 / DSM 1075 / Wisconsin 54-1255
MWSIPVILSLLIAQLSPVVAKGHQNSCVIKSGGTNVTDDAPAILKAFRECGQNGRIVFEPITYYVNSVMNISWLENVDIDIRGTLLWSTDIPYWLNNSMDVGYQNQSTALIIGGNNVRINGYEKGTFDGNGDYWYQWIREQPNTSNYPGRPHGVTFDSLTNSVIRGLAFLRSQMWTMSIINSHNVLLDGILVNNTGNWAQSSNTDGADTIRSSHITFNNWTVYNGDDSLSMKANSTDITITNCKFYNGLGIAMGSIGQYNDQFETIERITVKDIEYDNTLHAFYIKTWTDDQNGYPPNGGGGGLGFASDMKLTNLTTKGLRGAAFAISQCTRFSGAPGQGNCTNSEFQIRNVEIDGLSGTSESTRLASLQCSAVAPCTNITIVDSTLHLDNGTAASEFLCGNVANPTGFKCTGAPCVGGSATGEC

SEQ ID NO: 25175 - protein, 402 aa, Penicillium chrysogenum
  strain ATCC 28089 / DSM 1075 / Wisconsin 54-1255
MRFISLLSIAGVTGLVLAAPGPSLSKRAGSFVWFGANEAGAEFGSGNIPGELGTDYIWPSTSTIQTLRDAGMNLFRIPFAMERLVPGTLTSSMDATYLASLKSTVNYVTSSGGYAVIDPHNFGRYYGNIITSTSDFAAFWTALASEFASNDKVIFDTNNEFHSQDQTLVLNLNQAAINAIRAAGAKSQYIFVEGNSWSGAWTWTTVNDNMKALTDPQDLIIYEMHQYLDSDGSGTSETCVSSTIGRERVVAATQWLKDNGKRAFLGEFAGGANPVCQSAVTGMLDYLQANSDVWVGASWWSAGPWWGNYMYSLELPSGVGYTYYMSLLRNYFPGSTGSGGTTTAAPTSTPTVATATKTTTTGSSTTGAAHYAQCGGKSWTGATTCASPYACQKQSDYYSQCL

SEQ ID NO: 25176 - protein, 529 aa, Penicillium chrysogenum
  strain ATCC 28089 / DSM 1075 / Wisconsin 54-1255
MASALSFKIYKNALLLAAFLGAAQAQQVGTSTAEVHPSLTWQKCTAGGSCTSQSGKVVIDSNWRWVHNTGGYTNCYTGNDWDRTLCPDDVTCATNCALDGADYKGTYGVTASGSSLRLNFVTQASQKNIGSRLYLMADDSKYEMFQLLNQEFTFDVDVSNLPCGLNGALYFVAMDEDGGMARYPTNKAGAKYGTGYCDAQCPRDLKFINGQANVEGWEPSSSDVNGGTGSYGSCCAEMDIWEANSISTAFTPHPCDDPAQTRCTGDSCGGTYSSDRYGGTCDPDGCDFNPYRMGNQSFYGPSKIVDTESPFTVVTQFITNDGTSTGTLSEIKRFYVQNGKVIPQSVSTISAVTGNSITDSFCSAQKTAFKDTDVFAKHGGMAGMGAGLAEGMVLVMSLWDDHAANMLWLDSTYPTSASSTTPGAARGSCDISSGEPSDVEANHPNAYVVYSNIKVGPLGSTFGSTDSGSGTTTTKVTTTTATKTTTTTGPSTTGAAHYAQCGGQNWTGPTTCASPYTCQKQGDYYSQCL

SEQ ID NO: 25177 - protein, 402 aa, Penicillium chrysogenum
  strain ATCC 28089 / DSM 1075 / Wisconsin 54-1255
MSITKALAVFALLGSSLALPDRTRHNHSRASPCTPAAGGSASIDDVPAITSAIASCGKGGTILIPAGKTYYLNSPLDFAGCVGCDFQVEGLLKFSSSTETWKGQTAMINIKNIDGLKIRSLTGNGVIDGSGQNAWDLFAKDSSYERPTLLYITGGSNIEVSNLRQKNPPNVFNSVKGDTKTAKFFDLKMDATSKSDNEPKNTDGFDIGASTDVTISNVNVKNDDDCVAFKPGADGVTVKDITCTGSHGLSVGSLGKSSDDFVKNVHVSGATMIKSTKAVGIKTYPSGGGHGMSTVSNVTFTDIVVDGCDYAIQIQSCYGEDENYCVENPGDADLTDIVFDKISGETSGKYKAVTGTLACGARGTCDVKVGGYTVEAPSGGSEVLCANTPSDLGVKCTPGASG

SEQ ID NO: 25178 - protein, 398 aa, Penicillium chrysogenum; identical to SEQ ID NO: 25160
  strain ATCC 28089 / DSM 1075 / Wisconsin 54-1255

SEQ ID NO: 25179 - protein, 206 aa, Penicillium chrysogenum
  strain ATCC 28089 / DSM 1075 / Wisconsin 54-1255
MKFSTSLIALVAAGLASAQLPDVPACSLSCFLSALQSDGCSELLDFACHCQKTELVTSITPCVEKACEHKDQVSVSNAVVEQCSSAGHPISIPPIETTSASPSETPSASSSVPAETTATPTESASESSSAVESSSAAETDSTTAGTTATGSQPVGSSSGAATSTPLVTKTDSATPSASSPAFNGAANVKGNLAGVAALAAAAAYVL

SEQ ID NO: 25180 - protein, 485 aa, Penicillium chrysogenum
  strain ATCC 28089 / DSM 1075 / Wisconsin 54-1255
MLDFMDYIQLSFAEATHWNRDNSYSSLNTTAQSILDFSTPERLRVHLSSLSTPHFATSYTLGTVGLLDGSVSYLFSTVPFDNLPSGSASIPLRKISPGYRQVQAPATPIETWGWDSLLDGVSIPGLTNGSRPEPPIPKDEESIKESEAKRKATLLHASLHLPPPSTLYALFLRRISSNMQLSLAVCSTQGPPQSKSAPQASMLTQLSHDTGKYSNEYLFSTDNALFGWRGLWNFGPDPRYTRDVPPPLSLLSAGAEAYYSPISSLIGMSTGLRFTTLPAATEIPPSSSPSSTRTPISTFPYTLTLTLAPIVGSLSTTYSLRASPNLAFSSRFGFNVYSWESEMVAGCELWRRTKKSDSSSDDDLEWARRKMRMHDFGVSLPGSPASPLLEDPARPEGPVSSNAHTEAETSDSVIKLRIDQSWNVRLLWEGRVKELLVSAGVGLGPGSFSLSPSVSSASGSGSAQSGGGPGMSYWRGVGVSVLYSS

SEQ ID NO: 25181 - protein, 396 aa, Penicillium chrysogenum
  strain ATCC 28089 / DSM 1075 / Wisconsin 54-1255
MVVFSKVTASLACFSAVVSAAAVPVKSPRQGFSVNQVQKTVTGTRTVNLPGVYANALAKYGATVPANVHAAAVSGSAITTPEENDVEYLTPVKIGESTLNLDFDTGSADLWVFSTELSSAEQSGHDVYDVSSSGKKLTGASWSISYGDGSGASGDVYKDTVTVGGVKATGQAVEAAKKISQQFVQDKSNDGLLGLAFSSINTVSPKPQTTFFDTVKSDLDKPLFAVTLKHGAPGTYDFGYIDKKKFTGSLTYTDVDNSQGFWSFTADSYKVGTGSAGPSIEGIADTGTTLLLLDDGVVSDYYKKVDGAKNNYSAGGYVFPCDADLPDFTVTIGSYDAVVPGKHIKYAPVTTGSSSCFGGIQSNSGIGFSIFGDIFLKSQYVVFDAEGPRLGFAAQA

SEQ ID NO: 25182 - protein, 208 aa, Penicillium chrysogenum
  strain ATCC 28089 / DSM 1075 / Wisconsin 54-1255
MKFSLLALALATAAFASPMDIDARALSEGNELRNGDCKDITFIFARASTEPGLLILTHPNDRMSKPGKVACQGVGPKYTADLPSNALPGNTSPAAIAEAQGLFEQAAKKCPDTQILAGGYSQGTAVMDGSIKKLSSDVQAKIKGVALFGYTRNAQERGQIQGFDKDKTKIYCAVGDMVCQGTLVITAAHFTYVADAGAATRWLVSKLD

SEQ ID NO: 25183 - protein, 425 aa, Penicillium chrysogenum
  strain ATCC 28089 / DSM 1075 / Wisconsin 54-1255
MKTLAILTLTGLVSAQAAPYAQCGGGGYSGPTTCGSGWTCQYQNDWFSQCVESTNGGTTLSTKVLTSTSKTTTTTKATASATGFPTTNGLEFEIDGKTNYFAGSNSYWIGFLTNNDDVDLVFDHMSESGLRILRVWGFNDVNTVPSSGTVYYQLLKDGTATINTGADGLQRLDYVVASAEARNVKLIINFVNNWSDYGGMAAYVTAFGGSQTSWYTNTAAQTAYRAYIKAVVSRYIDSPAVFAWELANEPRCKGCDTSVLYNWIKSTSAYIKSLDSKHMVAIGDEGFGLDTGSDGSYPYGYSEGLNFTMNLGIDTIDFATFHLYPTSWGTSFDWGNGWVKSHGAACTAAGKPCLFEEYGATSDHCNIEAPWQKTALDTTGVAADLYWQYGDTLSSGKSADDGNTIYYGTSEFTCLVTDHVAAIDS

SEQ ID NO: 25184 - protein, 835 aa, Penicillium chrysogenum
  strain ATCC 28089 / DSM 1075 / Wisconsin 54-1255
MRALLFFASLGFVAAENGLNGWLRYASLPCSGQCRSNLPSSIVILNTTETSPVYVAGTELQNGLKGVYGKRVQVKHNKCKASSSVVVGTVDQYREICGAAKGVPELEEDGFWLDTKGKNVQILGQNERGALYGTFEYLSMLAQGNHSKVAYATNPSAPIRWVNQWDDMDGRIERGYGGPSIFFKDGQVVDDLTRVAEYARLLASIRINAVVINNVNANATLLSPTNLDGVARIADVFRPYGVQVGLSLNFASPQTYGGLSTFDPLDASVVEWWSKITAQVYDRVPDMAGYLVKADSEGQPGPQTYNRTLADAANLFAKEVQPYGGIVMYRAFVYNKLNESIWTDDRANAAVDFFKDLDGEFDDNVVIQIKYGPIDFQVREPPSPLFANLFNTSMAIELQVTQEYLGQQSHLVYVAPIWKTILDTDLRVDHQPSLVRDIVAGKRFNRKLGGSAAVVNVGTNTTWLGSHLSMSNLYAYGRLAWNPADDAQDILQDWIKLTFGLDRKVLDTITRMSMESWPAYEQYSGNLGIQTLTDIIYTHYGPSPASQDNNGWGQWTRADRDSIGMDRTVANGTGFSGQYPDELAAMYENIATTPDNLLLWFHHVGYTHRLHSGKTVIQHFYDEHYSGAETAQTFLTQWESLEGKIDTERYNHMRHFLDYQSGHSILWRDAINTFYHNLSGIPDQAKRVGHHPWRIEAEDMKLEGYKTYTVSPFETASGSVAIVTTSNSTAGTASTKINFPTGTYDLAVNYYDIYGGQSEWKVYLNNREIGQWIGNSEDTFSHTPSIYLDGHSAIRIKFRGVKVHKGDTLKIVGMPNGNEPAPLDYVALLPAGIVD

SEQ ID NO: 25185 - protein, 396 aa, Penicillium chrysogenum
  strain ATCC 28089 / DSM 1075 / Wisconsin 54-1255
MVHFSTIALALASALPQLTQGAGLHTSAVAKGKLYFGSATDNPELTDVPYLTQLSNTDDFGQITPGNSQKWDALEPSQNTFSYTNGDVIANLAAKNGQKLRCHTLVWHSQLPSWVSSGSWTNATLIAAMKNHITNVVTHYKGKCYAWDVVNEALNEDGTYRDSVFYKYIGEAFLPIAFATAAAADPDAKLYYNDYNIESPGSKSSGAQRIVKLVQQYGAKIDGVGLQAHFIVGSTPSQSAQTTNLAAFTALGVDVAYTELDIRMTLPSTTALLTQQSTDYKNTVAACMANTKCVGITIWDYTDKYSWVPSTFPGQGDACPWDKNLVKKPAYAGILAALGGTSSTTTTLVTSTTTAGSGGATRVPLYGQCGGSGWTGGTTCASGTCKHINDWYSQCL

SEQ ID NO: 25186 - protein, 564 aa, Penicillium chrysogenum
  strain ATCC 28089 / DSM 1075 / Wisconsin 54-1255
MAFKFNWSPLIADASFYTRAQDLLTAALNKSPKPPIIVGDITVTELNLGSIPPELEILEIGDLAEDRFRGIFKMSYTGDAFLTLKTRVQANPLNTYLITRPSFASPLPLAAATPLTIPLQITLSDFKLSGFVILVFSEQKGITLVFRNDPLESLKVSSTFDSIPFVRDFLQGEIEAQLRILFIDELPAIIHRLSLQLWDPEYRAEEIQNQMNTTLTPTKGPGHDPLVTPPQDPVDSLGNVLDESDIASLSLDSAAETHSLFSQKNLLSLATLTDSQRTLSLFTPSIQQVVYRAWSSPDQNDSSASVMSPISPPLSRTQSQTGGIFASIDNASTSSAQSRTPTGPTQSFSSYGLSLGASRHSRAHARRRKKRVVDLRSRPTTPSDSASVSVSDESTYTESASAPSVTSAPLQAIHEQPDDPVTPPLSPESDQSLPAIVEERRLSLSRSLPRRDLSSEIVRDRAEPSEPRNPFNTDDVIVTVGSVRPTPHQEASPPLGPTRQLSAAGLPFPHDSSTGSVVDQVFLDTLAGEVARRMRDEKLMAPNSCGTFCGHGLPEEPPPPAYGQ

SEQ ID NO: 25187 - protein, 369 aa, Penicillium chrysogenum
  strain ATCC 28089 / DSM 1075 / Wisconsin 54-1255
MRTSFLSMLALGAAAVSAAPAPSRASELVERGSSTCTFTSAASASASKKACSTIVLDNIKVPAGETLDLSKLQDGTKVIFRGETTFGYKEWKGPLIRVEGSNIEVSGEKGHLINGDGARWWDTKGTNGGKDKPKFFYAHKLKDSSITGLNVKNTPVQAFSVQADNLVLDHITIDNSDGDTKGGHNTDAFDVGESTYITISNANIKNQDDCLAVNSGENIVFTGGYCSGGHGLSIGSVGLRDNNIVKNVTISDSTVTNSDNGVRIKTIYKATGDVSDVTFSNIELSNIAKYGIVIEQDYENGSPTGTPTTGVPITGLTVEKVTGSVESKATPVFILCGDGSCSDWTWSGNDISGGKASSKCKNVPSVASC

SEQ ID NO: 25188 - protein, 556 aa, Penicillium chrysogenum
  strain ATCC 28089 / DSM 1075 / Wisconsin 54-1255
MAFNFNWSPLMADASFYTRAQDLLTAALNKSPKPPIIVDDIHVTELNLGSIPPELEILEIGDLAEDRFRGIFKMSYTGDAFLTLKTRVQANPLNTFLLTRPTFGSPVPLAAATPLTIPLQITLSDFKLSGFVILVFSKQKGITVVFRNDPLESLKVSSTFDSIPFVRDFLQKEIEAQLRILFMDELPAIIHRLSLRLWVPEYRTGEEMNDETDNTAKSSEGPGQDPLASPPQDPVDSLGNALNESEIASLSLDSSVETHSLFSQKNLLRLAALTDSQRTLSLFTPSIQEVVYRAWTSPTDTSEFPSSVISPLSPTLSREQSQMGSMSSLHETASNASMQSRPSMSSHSFSTSTYGLSLGAGRHSKAHARKRKKRVVDLRRPKTTDDAMSVSDESVMTESSRPPSIASAPLPIVNEPSDDPVTPPLSPEVDCHLPIIPERHLPSFSRPTRRDADLSYSHETIRGPKAEDVDATPRATMRGYPQERAEAGPSSNQRTPLPAAVLPFSKDENANVDPVLVDRLAGEIARRMREDKLMTNACSGFWSRQHEDSPPPAYGH

SEQ ID NO: 25189 - protein, 328 aa, Penicillium chrysogenum
  strain ATCC 28089 / DSM 1075 / Wisconsin 54-1255
MNRNNHAKPTRWLAILMLLTMQILNANADVVTVWTTIKLPAPTPTAPLHPSYTSLDEFKDDMLEVTNEYRANHDANPLEWNDTLADYSREWAEACIWKHSKSSYGENLAYGYGNVSAAVIAWGEERNMYNFGKPTGFTEETGHFTQLVWKSTTQVGCAAFNCGYSKNDKSKRDDGAEVQEDVFEEDAFRENVFEGVMMAPRSSGDEAEGDGLEGLKATRSEPRAQGWYVVCEYTPPGNVVGSHNSYFRKNVLPKKASAVDSSTESSSPTTPESSSTPRPEPSPNAATSTTIGSQSQPTGGAMRFALDSTLGIMLVGLGTVGVGRGLYT

SEQ ID NO: 25190 - protein, 425 aa, Penicillium chrysogenum
  strain ATCC 28089 / DSM 1075 / Wisconsin 54-1255
MKISNTLTQAFGLLLPLSAAVQAKEYSRSEVCQPNHPFKPLPGSQARTRTCHVANHGDGRDDSANVLSALKQCNNGGKVVFDADKKYTIGKALDMTFLKHVDLEIQGHVQFSDDTDYWQENSFKQIFQNATTFFQIGGEDVNVYGEGTLDGNGQVWYDLYAEDPLILRPILVGIVGLNGGTIGPLNLRYSPQWYQFVANSSNVLFDGIDISGYSSSENEAKNTDGWDLYRSTNVVIQNSVINNGDDCVSFKPNVTDILVQNLHCNGSHGISVGSLGQYPGEVDIVQNVLVYNISMFNASDGARIKVWPGGSAAMSTDLQGGGGSGLVKNITYDGMTIDNVDYAIEVTQCYGQKNLTLCNEFPSKLAIEDIVFKNFKGVTSGKRDPDVGMIVCSSPDVCSNIKASNIDVVSPDGDDQFTCTNVSLL

SEQ ID NO: 25191 - protein, 241 aa, Penicillium chrysogenum
  strain ATCC 28089 / DSM 1075 / Wisconsin 54-1255
MHSSAILLGLIGIASAQTLNIPSRVGDIVSLPSPSEISGDVDLGNGEYDRGRACDSDEDTGDDNAVFILKDGASLSNVIIGENQLEGIHCEGSCTLTNVWFRDVCEDAISIVGNGDALIKGGGAQEASDKVIQHNGAGTVTIDGFTVVNAGKLYRSCGNCSNNKSKSPRHVVVKNVQASGVSSLIGINSNYGDTSSVSDTCGSDVSHVCQEYEGVEKSEDRESPKLDSTDSCKGQTSLSSC

SEQ ID NO: 25192 - protein, 483 aa, Penicillium chrysogenum
  strain ATCC 28089 / DSM 1075 / Wisconsin 54-1255
MKFTNIVLAASAATVACAYPRGRDAVPNKQSADIKKRANGFTWLGVSESGAEFGEGNIPGTLEKDYTWPKTSQIQILRDAGMNIFRVPFLMERLVPTTMTGTPDATYMAALKSTVKFITDSGAYAVLDPHNYGRYAGSIISSTSDFKAFWKTVATEFATNEKVIFDTNNEYHDLDQTLVLDLNQAAIDAIRAAGATSQYIFVEGNAWSGAWSWTDNNDNLKALTDSEDKVVYEMHQYLDGDSSGTSETCVSSTIGKERLQSATAWLQENNKKGFIGEFAGGVNSDCQAAVDGMLSYMTENSDVWMGAEWWAAGPWWGSYMYSLEPSDGPAYSTYLPILEKYFVDGTASAPASSSSSAPTSTKSAAQTSTTTAAVDVTSTPSSNVQVPSSVVEPSSSASAPAETSAPVAPVVPTPTTVAPTTLVSATSTSTAKPNAQVPTNSPSTGNVAKHYYQCGGINWTGPTVCETGTTCVKQNPYYYQCVA

SEQ ID NO: 25193 - protein, 270 aa, Penicillium citrinum
WGALGHATVAYVAQHYVSPEAASWAQGILGSSSSSYLASIASWADEYRLTSAGKWSASLHFIDAEDNPPTNCNVDYERDCGSSGCSISAIANYTQRVSDSSLSSENHAEALRFLVHFIGDMTQPLHDEAYAVGGNKINVTFDGYHDNLHSDWDTYMPQKLIGGHALSDAESWAKTLVQNIESGNYTAQAIGWIKGDNISEPITTATRWASDANALVCTVVMPHGAAALQTGDLYPTYYDSVIDTIELQIAKGGYRLANWINEIHGSEIAK

SEQ ID NO: 25194 - protein, 511 aa, Penicillium citrinum
MRLPVSFPLTVLSLLGSTIAHPYGETEAVLRSEPKSNQAKADAVKEAFQHAWNGYMKYAFPHDELTPVSNGHADSRNGWGASAVDALSTAVIMGKADVVNAILEHVADIDFSKTSDTVSLFETTIRYLAGMLSGYDLLQGPAKNLVDNQDLIDGLLDQSRNLADVLKFAFDTPSGVPYNNINITSHGNDGATTNGLAVTGTLVLEWTRLSDLTGDEEYAKLSQKAESYLLKPQPSSSEPFPGLVGSSININDGQFADSRVSWNGGDDSFYEYLIKMYVYDPKRFETYKDRWVLAAESTIKHLKSHPKSRPDLTFLSSYSNRNYDLSSQHLTCFDGGSFLLGGTVLDRQDFIDFGLELVDGCEATYNSTLTKIGPDSWGWDPKKVPSDQKEFYEKAGFYISSGSYVLRPEVIESFYYAHRVTGKEIYRDWVWNAFVAINSTCRTDSGFAAVSDVNKANGGSKYDNQESFLFAEVMKYSYLAHSEDAAWQVQKGGKNTFVYNTEAHPISVARN

SEQ ID NO: 25195 - protein, 397 aa, Penicillium citrinum
MGFLKVLATSLATLAVVDAGTLLTASNTDAVIPSSYIVVMNDDVSTAEFNTHREWATNVHARLSRRKNGETGPGKHFEINGLKGYTASFDESTAKDIANDPAVKYIEPDMIVNATANVVQSNVPSWGLARISSKRTGTTSYTYDSTAGEGVVFYGVDTGIDISHSDFGGRAKWGTNVVDNDNTDGNGHGTHTASTAAGSKYGVAKKATLVAVKVLGADGSGTNSGVISGMDWAVKDAKSRGANGKYVMNMSLGGEFSKAVNDAAANVVKSGIFLSVAAGNEAENASNSSPASAAEVCTIAASTSTDGSASFTNFGSVVDLYAPGQSITAAYPGGGSKTLSGTSMAAPHVAGVAAYLMALEGVSAGNACARIVQLATSSISRAPSGTTSKLLYNGINV

SEQ ID NO: 25196 - protein, 411 aa, Penicillium decumbens
MRSSHKRNLAALLSISGAAVAQQTAWGQCGGQGWSGATSCVSGYTCSYTNDWYSQCVPGSSGGGGSNPTTTTTMIRTTTTASSSGPTGGAGGGKVRFAGVNIAGFDFGVVISGTQDMTQIVDESVDGVNQMRHFVNDDGFNIFRLPSGWQFLVNNNLGGSLDSNNFAKYDKLVQGCLSLGAYCIVDVHNYARWNGGVIGQGGPTDDQFTSLWTQLATHYKSESKIIFGVMNEPHDLDINRWATTVQKAVTAIRKAGATSQMILLPGTDFTSAANFVENGSGAALSAVTNLDGSTTNLIFDVHKYLDSDNSGTHAECVTNNADAFNSLAQWLRTNKRQAMLTETGGGNVQSCGTYMCQQLDVLNQNSDVYLGWTSWSAGGFQVSWNYVLGEVPTNNVDTYLVKQCFVPKWKN

SEQ ID NO: 25197 - protein, 474 aa, Penicillium decumbens
MSFTRRQFLAAALALLPLAQAQQPAVANPANPSLKTYKCSKSGGCVAQDTSVVLDWNYHWIHTANGYDSCTTSSGVDPTLCPDATTCSKNCVIEPANYTSSGVATSGDSLTLHQYVKSDGTYNNASPRVYLLGPDGDYVLMKLLGQELTFDVDLSTLPCGENGALYLSEMSGSGGRNANNKGGAAYGSGYCDAQCPLETWKNGTLVPGGQAYCCNEMDILEGNSAANSYTPHPCSSDDCDKGGCGFNPYAQGKTNYWAPGGTVDTSKPFTINTQFITNDGTTTGTLTEIRRQYIQNGKVIANAKSSAGVDSIKEAWCESVDGAAATFGGLTTMGKALGRGMVLIFSIWNDVSGNMNWLDSGSNGPCSSTEGSPTNLIAQNPDTHVVFSNIRWGDIGSTFNAPGGSGSSSSTTTTTTVATTKATSTTTKISTTTTAGGATQTQWGQCGGQGYTGPTACVSGTTCKAQNPYYSQCL

SEQ ID NO: 25198 - protein, 266 aa, Penicillium decumbens
MKGKVAFLLLDLLASAAAYKATTTRYYDGQEGACGCGSSSGLFPWQLGIGNGVYTAAGSQALFDTAGADWCGAGCGKCYKLTSTGEPPCKDCGTGGVAGQSIIVMVTNLCPYNGNQQWCPNPGSTNQYGYSYHFDIMAQNEIFGDNVVVDFEPIACPGQANSDWQSCVCYGKTETDTTPVGLTAGGGGGGSSQSSTTSQGSTTTRTTLTATTTAGSGSGSGSGSGSSSGTQSVYGQCGGSGWTGPTNCASGSKCTAQNQWYSQCLP

SEQ ID NO: 25199 - protein, 499 aa, Penicillium decumbens
MAQLSFLTLAVLGLSGTVAAQSACASAWAQCGGSNFNGPTCCVSGSSCSVLNPYYSQCVPGTQVPGSGSGSSSTRSSSTTTAGGTGPSTTATAGGGAAGTSKYTTSTSFPAATATQPAYPSADPSSCGAWTLVDNVCCPEYCLSNNKSESCTSSCSGGCGTPPSSMCKSGTMWGEQLEVGTDEDWHYSRSTHFGLTSGGACGFGLYGPCTKGSKTASWTDPMLGSTCDAFCTAYPLLCKDPSDVTLRGNFAAPNGDYYTQFWPSLIGALPGSPDNYLSCGECFELIRTRADGTEYQVGDSGYTDPIYLEVVDSCPCSANSKWCCGSGADHCGEIDFKYGCPLPEGSHHMDLSDIAMGRLQGNGSLTDGVIPIRYRRVPCPKPGNAYVWLRDGGSEYYFALSVVNTNGVGSITTVEVKGKGSNSWVALKRDPNYTSSRPQERYGAWVIPQGKGPFSLPVGIRVTSPDGQQIVNENAITSFTAPAGSVEGFYYIDLGVQFT

SEQ ID NO: 25200 - protein, 477 aa, Penicillium decumbens
MSFTRRQFLAAALGLLPLAQAQQPAVANPANPSLKTYKCSKSGGCVAQDTSVVLDWNYHWIHTANGYDSCTTSSGVDPTLCPDATTCSKNCVIEPANYTSSGVATSGDSLTLHQYVKSDGTYNNASPRVYLLGPDGDYVLMKLLGQELTFDVDLSTLPCGENGALYLSEMSGSGGRNANNKGGAAYGSGYCDAQCPLETWKNGTLVPGGQAYCCNEMDILEGNSAANSYTPHPCSSDDCDKGGCGFNPYAQGKTNYWAPGGTVDTSKPFTINTQFITNDGTTTGTLTEIRRQYIQNGKVIANAKSSAGVDSIKEAWCESVDGAAATFGGLTTMGKALGRGMVLIFSIWNDVSGNMNWLDSGSNGPCSSTEGNPTNIIAQNPDTHVVFSNIRWGDIGSTFNAPGGSGSSSSTTTSKATTTVATTKATSTTTKISTTTTAGGATQTQWGQCGGQGYTGPTACVSGTTCKAQNPYYSQCL

SEQ ID NO: 25201 - protein, 546 aa, Penicillium decumbens
MKGSISYQIYKGALLLSSLLASVSAQGAGTLTAESHPALTWQKCSAGGSCTPVSGSVVIDANWRWVHDKNGKNCYTGNTWDATLCPDDKTCAANCAVDGASYASTYGVTTSGNSLRINFVTQASQKNIGSRLYLLENDTTYQKFNLLNQEFTFDVDVSNLPCGLNGALYFVDMDADGGMAKYPTNKAGAKYGTGYCDSQCPRDLKFINGIANVEGWTPSSNDPNSGVGGHGTCCAEMDIWEANSISEALTPHPCDTPGQTMCEGNACGGTYSNDRYAGTCDPDGCDFNPYRQGVTNFYGPGMTVDTKSPFTVVTQFLTDDGTSTGTLSEIKRFYVQNGKVIGQPQSTVAGVSGNSITDSFCKAQKAAFGDTDDFTKHGALAGMGAAFEEGMVLVMSLWDDHNSNMLWLDSTYPTTASSTTLGAKRGSCDISSGAPNDVESQNANSYVVFSNIKAGPIGSTFNSGSTGGGNGSGSTTTTKGSTTTTKAPTTTTTTTSKATTTTAASGGNGGGAAHWAQCGGVGYTGPTTCASPYTCTKQNEYYSQCL

SEQ ID NO: 25202 - protein, 464 aa, Penicillium decumbens
MQRTSAWALLLLAQIATAQQTVWGQCGGIGYSGPTSCVAGSSCSTQNSYYAQCLPGSGNGGGGAATTTTTAGQTTKTTMATTTTTSTKTSAGSGGSTTTAPPASNSGNPFKGYQPYVNPYYASEVQSLAIPSLAASLAPKASAVAKVPSFVWLDTAAKVPTMGTYLADIKAKNAAGANPPIAGIFVVYDLPDRDCAALASNGEYSIANGGVANYKKYIDSIRAQLLKYPDVHTILVIEPDSLANLVTNMNVAKCSGAHDAYLECTDYALKQLNLPNVAMYLDAGHAGWLGWPANIGPAADLFASVYKNAGSPAAVRGLATNVANYNAWSISTCPSYTQGDQNCDEKRYINALAPLLRANGFDAHFIMDTSRNGVQPTKQQAWGDWCNVIGTGFGTPFTTDTGDALQDAFIWVKPGGECDGTSDTSSPRYDAHCGYSDALKPAPEAGTWFQAYFEQLLVNANPSF

SEQ ID NO: 25203 - protein, 410 aa, Penicillium decumbens
MVHLSATSLLLAAGILPNLALGAGLNDAAKAIGQVYFGSATDNPELSDSAYVKQLSNTADFGQITPGNSQKWDATEPSRNVFTFSGGDTVAKLAQSNGQKLRCHNLVWHSQLPSWVTNGNFNNATLISIMKNHITNLVQHYKGQCYAWDVVNEALNEDGSYRQSVWYNTIGPAYLPIAFATAASVDPTVKLYYNDYNIEYSGAKAAGARRIVELVQSYGAKIDGVGLQAHFIVGSTPSKDDQKKVMAGYTAYGVEVAITELDIRMNLPSTNAQLTQQATDYSNTVSACVETKNCVGITIWDWTDKYSWVPSTFSGQGAACPWDSNFQKKPAYNAILNALNAGSSTGGGSPTTTTTTTAAATTTTAPGGSGSTGGMAQHWGQCGGNGWTGPTTCASPYTCQASNPWYSQCL

SEQ ID NO: 25204 - protein, 310 aa, Penicillium decumbens
MISLSSVAIALTTVVGALALPSDQSVNLAARQAITSSQTGTNNGYYYSFWTNGAGSVSYSNGAAGQFSVNWANQGGGDFTCGKGWNPGKAQDISFSGTFTPNGNAYLSIYGWTTGPLVEYYILENFGSYNPGNGMTHVGTLTSDGSDYDIYKHTQVNQPSIVGTSTFDQYWSIRKNKRSSGTVTTANHFSAWASHGMNLGSHNYQILSVEGYQSSGSASMTVSAGSSSSGGSGSGSGSGSGSGSGSGSQTTTAGSSTGTGTGSGSGSGSGGSGGNCAAQWGQCGGQGWNGPTCCSSGTCKASNQWYSQCL

SEQ ID NO: 25205 - protein, 367 aa, Penicillium digitatum
MRTSFVTMLALGAAAVSAAPAAPVTDLVERGSSCTFTTAEAAKAGKGSCSTIVLDNIKVPAGETLDLTKLKSGTQVVFKGETSFGYKEWTGPLVSFSGSNIHVSGAAGHVINGGGPSWWDGKGTNGGKKKPKFFYAHHLDDSTISGLNVKNTPVQGFSILADRLTLDHITIDNSEGDAKGGHNTDAFDVGSSTFITISNANIKNQDDCLAINSGSNIKFVGGTCSGGHGISIGSVGLRDNNIVKDVTISDSTVINSDNGVRVKTIYQATGAVSGVTFSNIKLSNIAKYGIVIEQDYENGSPTGKPTNGVPISELTIENVTGTLKSSATEVYILCGNGSCKNWKWAGNSLSGGKKSGKCGNVPAGASC

SEQ ID NO: 25206 - protein, 386 aa, Penicillium echinulatum
PPASRSISSTTEALHARLASPHGSGEVIRPDTVGDPLLLAVDDVVLNIFRVPFLMERLIPNSMTASPDAAYLKGLTDTINFITSLGAHAIVDPHNYGRYYGKVITSTSDFKAFWTTVAKQFASNDKVIFDTNNEFNTEDQSTVYDMNQAAIDAIRAAGATSQYIFVEGNSWTGAWTWVSVNSGLANLTDPQNKIVYEMHQYLDSDGSGTSGTCASSTIGKERVTSATQWLKDNNKLGFLGEFAGGANSVCESAITGMLDYMQANSDVWLGASWWAAGPWWGNYFASMEPPSGAGYTYYYKILSNYFPGKSTGGGSTTTTTTAPATTTTKAPVTTTTTTTAPATTTATGGATAAHWAQCGGVGYSGPTACASPYTCKVQNDYYSQCL

SEQ ID NO: 25207 - protein, 1011 aa, Penicillium expansum
MKLLSSLALAALAAQVSGAAISHKLDGFTLREHADASKRELLQKYVTWDKHSIFINGERLMMFSGEVHPYRLPVASLYIDVFEKIKALGFNCVSFYVDWALLEGKPGHYTAEGIFDLQPFFDAAKEAGIYLLARPGPYINAEVSGGGFPGWLQRVNGTLRTSIGDYLKSTDNYASHIAKTIAKAQITNGGPIILYQPENEYSGACCGYEDFPDGSYMQYIEDHARDAGIVVPFISNDAYAGGHNAPGTGKGAVDIYGHDGYPLGFDCANPSVWPDGNLPTNYHTLHEEQSPTTPFSVVEFQGGAFDPWGGVGFAKCAHLLNHEFERVFYKNDFSFGVTFFNLYMIFGGTNWGNLGHPGGYTSYDYGSAISESRNVTREKYSELKLLGNFAKVSPGYVVANPGNLTTSKYTKTADLTVTPLLGESSSAGSFFVIRHSNYNSQASVKYQLTLPTSAGELTIPQLGGELTLSGRDSKIHVTDYDVAGSNILYSTAEVFTWKKFDNGKVLILYGGPGEHHEFAVTGASASSVIEGSSSGITSKKIGDALVVAWDVSSKRRIIKIGDLKVFLLDRNSAYNYWVPHLPTKGKAPGYVSKKAIDSSIIVKAGYLVRSAFLSGKDLHIQADFNATTPIEIIGAPSSAKNLVINGKKTKTNVDDNGIWSASVSYSTPEIHLPSLKDLKWQSIDTLPEVKNSYDDSAWTSADQPHTLNTAHELQTPTTLFSSDYGYHTGTLLYRGHFVANGKESIFFIQTQGGSAYGHSVWVNETYVGSWEGSGSNDNYNATYTLPSLATGKKYAITVVIDNMGLDVNWVIGQEGMKNPRGIIRYNLAGHDASAISWKLTGNLGGEDYRDTVRGPLNEGGLYAERQGFHQPKPSTKNWDSSSPFTGLTKPGIRFYSASFDLDLPSGYDIPLYFNFGNSTAPPDAYRVQLFVNGYQYGKYVNNVGPQTSFPVPEGILNYHGTNWIALSLWAQQESGAKLNSFELINTTPVLTSLDKVKSVDQPKYKSRKGAY

SEQ ID NO: 25208 - protein, 378 aa, Penicillium expansum
MILTRSVVLGFLGSASLALASPVAELAEGSRLTPRGSACSYSGTSGAAAAIAGKAGCSSITLNNVVVPAGTTLDLTGLASGTKVIFEGTTTFGYKQWAGPLISISGTNIQVSGASGHLIDGQGSRWWDGEGSNSKTNIKPKFFFAHSLKGSSTITGLNIKDSPVQVFSISGSSGLTISGVTIDNKNGDTNSLGHNTDGFDIGDSDSITITGATVYNQDDCLAINSGTNIVFSGGYCSGGHGLSIGSVGGRSNNVVETVHISSTQVVNSQNGVRVKAVSGATGTIKGVTFQDITLSGITSQGITIRQEYTNSGYTGSPTTGVPITGLTLNNVHGTVTSKGTDITIECGSSASCSGWTWTKVAVSGGKADVCKNAPSGTC

SEQ ID NO: 25209 - protein, 457 aa, Penicillium funiculosum
MLRYLSIVAATAILTGVEAQQSVWGQCGGQGWSGATSCAAGSTCSTLNPYYAQCIPGTATSTTLVKTTSSTSVGTTSPPTTTTTKASTTATTTAAASGNPFSGYQLYANPYYSSEVHTLAIPSLTGSLAAAATKAAEIPSFVWLDTAAKVPTMGTYLANIEAANKAGASPPIAGIFVVYDLPDRDCAAAASNGEYTVANNGVANYKAYIDSIVAQLKAYPDVHTILIIEPDSLANMVTNLSTAKCAEAQSAYYECVNYALIKPHLAHVAMYIDAGHAGWLGWSANLSPAAQLFATVYKNASAPASLRGLATNVANYNAWSISSPPSYTSGDSNYDEKLYINALSPLLTSNGWPDAHFIMDTSRNGVQPTKQQAWGDWCNVIGTGFGVQPTTNTGDPLEDAFVWVKPGGESDGTSNSSATRYDFHCGYSGALQPAPEAGTWFQAYFVQLLTNANPALV

SEQ ID NO: 25210 - protein, 529 aa, Penicillium funiculosum
MSALNSFNMYKSALILGSLLATAGAQQIGTYTAETHPSLSWSTCKSGGSCTTNSGAITLDANWRWVHGVNTSTNCYTGNTWNSAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSANNANTGIGNHGACCAELDIWEANSISEALTPHPCDTPGLSVCTTDACGGTYSSDRYAGTCDPDGCDFNPYRLGVTDFYGSGKTVDTTKPFTVVTQFVTNDGTSTGSLSEIRRYYVQNGVVIPQPSSKISGISGNVINSDYCAAEISTFGGTASFNKHGGLTNMAAGMEAGMVLVMSLWDDYAVNMLWLDSTYPTNATGTPGAARGTCATTSGDPKTVESQSGSSYVTFSDIRVGPFNSTFSGGSSTGGSTTTTASRTTTTSASSTSTSSTSTGTGVAGHWGQCGGQGWTGPTTCVSGTTCTVVNPYYSQCL

SEQ ID NO: 25211 - protein, 407 aa, Penicillium funiculosum
MTLVKSILLALAAGHVAQAQLNTAAKAAGLLYFGTAVDNPDLSDSKYLVNLETADFGQITPANAMKWQPTEPSQGSYTFTQGDQIASLAKSNNDYLRCHNLVWYNQLPSYITSGSWTNATLIAALKEHINGVVTHYKGQCYAWDVVNEALNEDGTYRQNVFYQHIGEAYIPIAFAAAAAADPNAKLYYNDYNIEYAGAKATGAQGIVKLIQAAGGRIDGVGLQSHFIVGQTPSLATQKANMAAFTALGVDVAITELDIRMTLPDTSALQTQQSTDYQTTTTACVQTKGCVGITLWDYTDKYSWVPGTFSGQGDACPWDSNYNKKPAYYGILAGLQSGSGSSSSTSSTTLITTTTPTASSSTTSATTTSATSGAAHWGQCGGIGWSGPTICVSPYTCQVLNPYYSQCL

SEQ ID NO: 25212 - protein, 282 aa, Penicillium funiculosum
MGISSILLSALIAGGALALPAAEPVSFDIRDENITLARRAEAINYNQDYIASGANVQYSPNMAAGSFSINYNTQGDFVVGLGWQPGDANPITYSGSFSASGVGILAVYGWSTNPLVEYYVMEVHDGYQTAGTHKGTVTTDGGTYDIWEHQQVNQPSILGTSTFNQYISIRQSPRTSGTVTVQNHFNAWAQAGMNLGTLNYQVMAVESWSGSGSGQISLSKGTGGGSTTTTPTGPTSTSTAPSSGGTGAAQWGQCGGIGWTGPTTCVAPYTCKYENAYYSQCQ

SEQ ID NO: 25213 - protein, 345 aa, Penicillium funiculosum
MVKSYIIGAFVLELASVVLGQQSLWGQCGGTGWTGPTTCVSGACCQEQNPYYSQCIQGNCSPASSTSSTSSTKTTTTSASSTTTSTSASGTSLSSGCGKALSLKSGTYTTTVAGQQRQYTLTLPSNYNPNKAYQLIFGYHWLGGTMGNVVSGSYYGIQPLAGDNAIFVAPQGLNNGWGNTNGDDIIFTDQMLSTLENALCIDETQIYSMGWSYGGAMSYALACARPDVFRAVAVMSGANLSGCSPGTQPVAYYGQHGVSDTVLPFSLGEGIRDTFVKDDHCTPTNPPAPAAGSGTHIKTEYSGCDSEHPVWWIAFDGPHEPLATDAGASSSWTPGQIWSFFSLFH

SEQ ID NO: 25214 - protein, 529 aa, Penicillium funiculosum
MSALNSFNMYKSALILGSLLATAGAQQIGTYTAETHPSLSWSTCKSGGSCTTNSGAITLDANWRWVHGVNTSTNCYTGNTWNTAICDTDASCAQDCALDGADYSGTYGITTSGNSLRLNFVTGSNVGSRTYLMADNTHYQIFDLLNQEFTFTVDVSNLPCGLNGALYFVTMDADGGVSKYPNNKAGAQYGVGYCDSQCPRDLKFIAGQANVEGWTPSTNNSNTGIGNHGSCCAELDIWEANSISEALTPHPCDTPGLTVCTADDCGGTYSSNRYAGTCDPDGCDFNPYRLGVTDFYGSGKTVDTTKPFTVVTQFVTDDGTSSGSLSEIRRYYVQNGVVIPQPSSKISGISGNVINSDFCAAELSAFGETASFTNHGGLKNMGSALEAGMVLVMSLWDDYSVNMLWLDSTYPANETGTPGAARGSCPTTSGNPKTVESQSGSSYVVFSDIKVGPFNSTFSGGTSTGGSTTTTASGTTSTKASTTSTSSTSTGTGVAAHWGQCGGQGWTGPTTCASGTTCTVVNPYYSQCL

SEQ ID NO: 25215 - protein, 353 aa, Penicillium funiculosum
MAIPLVLVLAWLLPVVLAASLTQVNNFGDNPGSLQMYIYVPNKLASKPAIIVAMHPCGGSATEYYGMYDYHSPADQYGYILIYPSATRDYNCFDAYSSASLTHNGGSDSLSIVNMVKYVISTYGADSSKVYMTGSSSGAIMTNVLAGAYPDVFAAGSAFSGMPYACLYGAGAADPIMSNQTCSQGQIQHTGQQWAAYVHNGYPGYTGQYPRLQMWHGTADNVISYADLGQEISQWTTIMGLSFTGNQTNTPLSGYTKMVYGDGSKFQAYSAAGVGHFVPTDVSVVLDWFGITSGTTTTTTPTTTPTTSTSPSSTGGCTAAHWAQCGGIGYSGCTACASPYTCQKANDYYSQCL

SEQ ID NO: 25216 - protein, 540 aa, Penicillium glabrum
MAAEISYRVYKNFLFFSTLLAAAQAQQVGTLTTETHPSLTWQKCTSAGSCTTVSGSVVIDSNWRWVHSTSGSTNCYTGNTWDTTLCPSDTACAVNCALDGADYSSTYGVTTSGSSVQLNFVTQNSNGANVGSRLYLLEDASTYQIFDLLNQEFTFDVDVSNLPCGLNGALYFVDMDADGGMAKYSTNKAGAKYGTGYCDAQCPRDLKFIDGEGNSDGWVASSNNANTGLGNHGSCCAEMDIWEANSVSTALTAHPCDTPGQTMCTGDDCGGTYSSNRYAGTCDPDGCDINPYRNGDTSFYGAGKTVDTTKPFTVVTQFVTDDGTSSGTLSEIKRYYVQNGVVIPQPASKVSGVSGNSITADYCTAENTAFDGVGGFAKHGGMEGVSAALADGMVLVLSLWDDYYADMLWLDSTYPTNDTTTTPGAARGSCDISSGVPATIESSDASAHVIFSNIKIGPFNSTFSGTSSSGSTTTSKTTTTSKTTTTSKTTTTTSKTTTTAASTTGAAHYSQCGGIGWTGATTCASPYTCQVQNAYYSQCL

SEQ ID NO: 25217 - protein, 376 aa, Penicillium griseoroseum
MASSLKLGLIALLGATAVNAAPAAEPVLGTSLLTSRASCTFSGSSGAAEAIKSKTSCSTITLSNVEVPAGTTLDLTGLKSGTTVIFEGTTTFGYKEWEGPLVSVSGTSITVQGASGAQLNGDGARWWDGKGTNGGKTKPKFFYAHSLTNSKIENIYIKNSPVQVFSINGAKELTLSGITVDTADGDSNGGHNTDAFDVGSSNGVYITSPIVHNQDDCLAVNSGTNVHFTGAQCTGGHGISIGSVGGRSDNTVDGVTVESCTIKDSDNGVRIKTVYGATGTVQGVTYKDITLSGIAKYGIVIEQDYENGSPTGTPTSGVPITDLTLDNVHGTVASSGVDTYILCASGACSDWSWSGVSITGGQTSKKCKGIPSGASC

SEQ ID NO: 25218 - protein, 369 aa, Penicillium griseoroseum
MRTSFVTMLALGAAAVSGAPASAPVTDLVERGSSSCTFTSAAAAKAGKSSCSTIVLDNIKVPAGETLDLSKLKSGTKVIFKGETTLGYKEWTGPLIRFSGDNINVSGASGHVVNGGGPSWWDGKGTNGGKKKPKFFYAHGLDNSNISGLNVKNTPVQGFSVQADHLVLDHITIDNSEGDSKGGHHTDAFDVGSSTYITISNANIKNQDDCLAINSGEHITFTGGTCSGGHGISIGSVGVRDNNIVKDVTISDSSVVNSDNGVRVKTIYKATGAVSDVTFSNIKLSNIAKYGIVIEQDYQNGSPTGKPTTGVPITGLKVEKVTGTVKSSGTDVYILCGNGSCKNWTWTGNSVTGGKKSSKCSGVPSGASC

SEQ ID NO: 25219 - protein, 376 aa, Penicillium griseoroseum
MASSLKLGLIALLGATAVNAAPAAEPVLGTSLLTSRASCTFSGSSGAAEAIKSKTSCSTITLSNVEVPAGTTLDLTGLKSGTTVIFEGTTTFGYKEWEGPLVSVSGTSITVQGASGAQLNGDGARWWDGKGTNGGKTKPKFFYAHSLTNSKIENIYIKNSPVQVFSINGAKELTLSGITVDTADGDSNGGHNTDAFDVGSSNGVYITSPIVHNQDDCLAVNSGTNVHFTGAQCTGGHGISIGSVGGRSDNTVDGVTVESCTIKDSDNGVRIKTVYGATGAVQGVTYKDITLSGIAKYGIVIEQDYENGSPTGTPTSGVPITDLTLDNVHGTVASSGVDTYILCASGACSDWSWSGVSITGGQTSKKCKGIPSGASC

SEQ ID NO: 25220 - protein, 371 aa, Penicillium janthinellum
MPSYLRNLVWATLAAGLVSAAPTPSRVSDLTKKSSSTCTFSSAASASASKSSCSTIVLSNIEVPAGKTLDLTDLKDGTKVIFEGTTTFGYKEWSGPLIKISGSDITVEAADGAVINADGSRWWDGEGTNGGKTKPKFFYAHSLDDSTISGLNIKNTPVQAFSIQSDNLIIDGVTIDNSDGDENGGHNTDGFDISESTGVTIRNAVVKNQDDCIAINSGQNIYFTGGTCSGGHGLSIGSVGGRDDNTVKNVTITDSTVTDSANGVRIKTVYDATGSVSDVTFSDITVSGITDYGIVIEQDYENGSPTGTPTSGVPITDLTVKGITGSVESDAVEVYILCGDDACSDWTWSGVDITSGQTSSKCENVPSGASC

SEQ ID NO: 25221 - protein, 394 aa, Penicillium janthinellum
MVVFSKITVVLAGLATVASAVPTGTSRKSTFTVNQKARPVAQAKAINLPGMYASALSKYGAAVPASVKAAAESGTAVTTPEANDVEYLTPVNVGGTTLNLDFDTGSADLWVFSSELSSSESTGHSLYKPSSNATKLAGYSWSITYGDQSSASGDVYKDFVVVGGVKASPQAVEAASQISQQFVNDKNNDGLLGLAFSSINTVKPKSQTTFFDTVKGQLDSPLFAVTLKHNAPGTYDFGFVDKNKYTGSLTYAQVDSSQGFWSFTADGYKIGSKSGGSIQGIADTGTTLLLLPDNVVSDYYGQVSGAQQDSSAGGYTVPCSAQLPDFTVTIGSYNAVVPGSLINYAPLQSGSSTCFGGIQSNSGLGFSIFGDIFLKSQYVVFDANGPRLGFAPQA

SEQ ID NO: 25222 - protein, 537 aa, Penicillium janthinellum
  MOD_RES (48)..(48): Any amino acid
  MOD_RES (64)..(64): Any amino acid
MKGSISYQIYKGALLLSALLNSVSAQQVGTLTAETHPALTWSKCTAGXCSQVSGSVVIDANWPXVHSTSGSTNCYTGNTWDATLCPDDVTCAANCAVDGARRQHLRVTTSGNSLRINFVTTASQKNIGSRLYLLENDTTYQKFNLLNQEFTFDVDVSNLPCGLNGALYFVDMDADGGMAKYPTNKAGAKYGTGYCDSQCPRDLKFINGQANVDGWTPSKNDVNSGIGNHGSCCAEMDIWEANSISNAVTPHPCDTPSQTMCTGQRCGGTYSTDRYGGTCDPDGCDFNPYRMGVTNFYGPGETIDTKSPFTVVTQFLTNDGTSTGTLSEIKRFYVQGGKVIGNPQSTIVGVSGNSITDSWCNAQKSAFGDTNEFSKHGGMAGMGAGLADGMVLVMSLWDDHASDMLWLDSTYPTNATSTTPGAKRGTCDISRRPNTVESTYPNAYVIYSNIKTGPLNSTFTGGTTSSSSTTTTTSKSTSTSSSSKTTTTVTTTTTSSGSSGTGARDWAQCGGNGWTGPTTCVSPYTCTKQNDWYSQCL

SEQ ID NO: 25223 - protein, 410 aa, Penicillium janthinellum
MMAQDKRTLLALLALGGSALGQQTAWGQCGGQGWTGATTCVSGYYCSFQNNWYSQCLPGAASTTSTSTTTTTVYSTTLKTTTTSSTSSAPTGKVRFAGVNIAGFDFGVVTSGTQDLSQVVDESVDGVNQMSHFVNADTFNIFRLPTGWQFIVNNNLGGSLDSNNFGKYEQVGSGLSLSGAYCIVDIHNYARWNGGVIGQGGPTDDQFISLWTQLATHYKSNSRVIFGIMNEPHDLNIATWAATVQKTVTAIRNTGATSQMILLPGTDYTSAANFIENGSGAALLPVTNPDGSTTNLIFDVHKYLDSDNSGTHAECVTNNADAFNNLATWLRSNKRQALLSETGGGNVQSCATYMCQQLDILNANSDVYLGWTSWSAGGFQASWNYVLTEVPVNGVDQYLVQQCFVPKWKN

SEQ ID NO: 25224 - protein, 394 aa, Penicillium janthinellum
MVSFTQLQLAFLGLSALGAAVPVTGTSEKKTFSLNQVKVAGTKTKNPAEHYANALRKYGAEVPSHVLAAAAATGSVTTSPTEFDSEYLTPIDVGGTTMNLDIDTGSSDLWVFSKELPSSETSGHAVYSPSSQSQLLNGYSWSISYGDGSSASGNVYLDYVTVGGVTASSQAVEAAETISSEFQQDPSDGLMGLAFSSINTVQPESQSTFFDNVQSNLASPVFCADLKYEAPGVYDFGFIDSSKHTGSVTYTPVDNSQGFWGFTASGYAVGSGSTVSTSISGIADTGTTLLLLPSSIVKKYYAQVKGSSNSATYGGYVFPCSATLPKFTVVINGYKAVIAAQYLNYSPVETGSSTCFGGIQSDTGIGFSIFGDIFLKSQYVVFDASGPRLGFAPQ

SEQ ID NO: 25225 - protein, 272 aa, Penicillium marneffei
MAPITQETVDGLKDIIHKLESRVADLESRLVHGSPASNSKSLAEQFRIILIGPPGAGKGTQAPRLKEKYCVCHLATGDMLRSQVAKKTPLGKEAKKIMDQGGLVSDEIMVNMIKSELETNSECKNGFILDGFPRTVAQAERLDDMLSARNEKLQHAVELQIDDALLVARITGRLVHPASGRSYHKIFNPPKQDMKDDITGEPLIQRSDDNAATLEKRLATYHAQTSPVVDYYKKTGIWCGIDASQEPGQVWKSLLGVFQPSSSILSKVGLSK

SEQ ID NO: 25226 - protein, 633 aa, Penicillium marneffei
  strain ATCC 18224 / CBS 334.59 / QM 7333
MATVRICVCGDEGTGKSSLITSLVKGVFVTNKIQPVLPQITIPPTIGTPENVTTTTVVDTSALPQERANLAREIRKSNVILLVYSDHYSYERVALFWLPHFRSLGVNVPVVLCANKADLATDTTDAQVIDEEMLPVMAEFKEIDSCIRSSARQHRNVNEAFFLCQKAVTHPIAPLFDSKESVLKPAAVAALQRIFYLCDKDRDGFLSDKEIEDFQLKCFGKPLSEEDLVHIKETISKAYPDAVTPAGITSRGFLHLNKLYAEKGRHETVWIILRSFQYTDNLSLQETYLHPKFEVPPFSSAELSPEGYRFLVDLFLLSDKDNDGGLNDSELASLFAPTPGLPSSWTDDSFPSSTVRDEAGHVTLQGWLAQWSMTTFTSPKTTLEYLAYLGFESSDRSNPSTTAALKVTKPRKRRRRPGRVGRNVVLCHVLGAAGAGKSSLLDAFLSRGFSNTYHPTIQPRTAVNTVELPGGKQCYLILDELGELEPALLENQSKLLDQCDVIAYTYDSSDPDSFAYITKIRAKYPHLEELPSIFLALKADLDRTTQRAECQPHEYTARLGLPAPPLHVSATWSSIQEVFVHIAEAAMDPSTTFPRTEEDLESKWMSWGIALGAVVCAGAAAVAIWHRVHNSSP

SEQ ID NO: 25227 - protein, 425 aa, Penicillium marneffei
  strain ATCC 18224 / CBS 334.59 / QM 7333
MYWLRNLLPLTICSTAFAAAASKGGVWQKGKVCNVTALGGKRDDVPNILEAFSRCGKDGTIVFPEDQNYWIATRLNPIVSNVVIDWRGVWTFSDALDYWRNHSYPITFQNHHAGFVLTGDHITIEGHGTGQIYGNGNAWYNVEQGVTQPGRPMPFVFWNVSEVLVEDFTVKDPPLWSLNIMNGTNMVFNNITCNATAVNAPYGTNWVQNTDGFDTMDANNIELNGFTYQGGDDCVAIKPRSYNVRVSNVACHGGNGIAIGSLGQYLEDASVKNVVIDNVDIIGYNKDMHNAAYIKTYMGGRVLQRSYESAGLPNGGGWGTVENILFSNFNVQGASAGPAITQDTGDNGTFKGTSLIAISNVAFVNFTGYLNGVSRAASVSCSNVHPCYNIDFQNVDLLPSQNATAYGNVTCSYIESGGVRGLSGC

SEQ ID NO: 25228 - protein, 477 aa, Penicillium marneffei
  strain ATCC 18224 / CBS 334.59 / QM 7333
MLEFMDYVQLAFAEATRWNQDNSYSALTATAESLLDFHVPERLQVRLSSLSTPHFATSYTLGTVGLIDGSVSYLFSTVPLNNTPSQSGLIPLRRLVRGYRQIEAPVPPRRNWGWDAIPSPNSLQNIDGAENNDDVVRKATLLHATLHLPPPSTLNALFLRRISPTTQITASLVSTQAPPLVKSAPSAALLAQISHDTGTFSNEYLFSTDNALFGWRGLWNIGLEPAPGKASTDKVSLLSAGAEAYYSPISSLVGLSTGLKFTTLPAASRTPSSSSSGSTPNPISSFPYTLTLTLTPLTGSLSTTYSARASPNLAFSSRFGFNVYSWESEMVAGCEIWRKSPRTEPVEVDDGLEWARRKMGIVKDLAAEKISSLSSSNNPQAIEEDEGDSVIKIRVDQSWNVRLLWEGRVKSLLVTAGVSLGPGSFTALSSIPSSPTSSSAPVAAAGTGSSQSSGGGAAPTSRPSYWQGVGVSILYSS

SEQ ID NO: 25229 - protein, 271 aa, Penicillium marneffei
  strain ATCC 18224 / CBS 334.59 / QM 7333
MKLVEAASLLALITLPLAAFADVEFIEPGAGSTVNSGDMLTAYWKDSGDSPSLVEFHDYDLFLCAGGPEIEYSEDLALLVPNGLFDRGNSVSFQIRPDLGPEYPDAYFLKMISRGSNNVTVVNYSERFSVTGMTGTFSELVQYGLSLTANDTESHQDLKLRKRQVVAAIAPAIVPAKDLYDVPYPEQSKGLTKYAPMGKRPATTITAKSGPPQFPTSAYSIARTFLPVPTWQTTLTASRTWTDSLIENPATPAPHPKNDMQKFLKRWADDE

SEQ ID NO: 25230 - protein, 208 aa, Penicillium marneffei
  strain ATCC 18224 / CBS 334.59 / QM 7333
MVFLTEGIPSLSRSDLTLGLNTQMPSMKPRNIPSNFSADIHPSSFLKMISRGSNNVTVVNYSERFSVTGMTGTFSELVQYGLSLTANDTESHQDLKLRKRQVVAAIAPAIVPAKDLYDVPYPEQSKGLTKYAPMGKRPATTITAKSGPPQFPTSAYSIARTFLPVPTWQTTLTASRTWTDSLIENPATPAPHPKNDMQKFLKRWADDE

SEQ ID NO: 25231 - protein, 385 aa, Penicillium marneffei
  strain ATCC 18224 / CBS 334.59 / QM 7333
MLWAVPLLLVIPAVTAQSPLYGQCGGQGWAGATTCVSGSCCTYSNAWYSQCLPCSNGGSTTTTTSTTLKTTTTKPASTSKTVSPTSCPLPSQYKWTSSGSLANPASGYLSLKDFTHVPYNGKHLVYASNVNSGGSYGSMNFALFSDWSQMGSATQTQMSQGAVAPDLIYFAPKDVWVLGYEWCQWAFCYLTSTNPTDAKGWSSPQPLYEGTFSGTGPIDPAIIADTEKVYLFFAGDNGNIYRASMPIGNFPASFGSSAEIILTDSTYNLFEAVEVYSIQGQNLYLMIVECIGSNGRYFRSFTATSLGGTWTAQASTESNPFAGYSNSGAAWSKDISSGDLIRSSADQTKPVDPCNLQLLYQGRNPNSNDSYNDLPYRPGLLTLVH

SEQ ID NO: 25232 - protein, 421 aa, Penicillium marneffei
  strain ATCC 18224 / CBS 334.59 / QM 7333
MFLLDGCFIFHQTDGSGMSGLKCKHDLLQCAHIVSSTALPPSKTIEKRAICTPGGYGNASKDDTPAIASAIATCGKGGSIVIPSGTTYNLRSTLDFAGCFGCELQLKGTLKVSNDYQCWSDYKAIILVSDITGATITSTTGAGVIDGNGQDAYDAFAADSLLSRPTLVYIIGSSDITMSGFRVKDPPNVFFSNTGSSRNIEYASLTMIASSKSTNAPKNTDGFDVGTSTFTTIHNVYVSNQDDCITFKPGANYATVDNVTCAGTNHGVSIGSLGESGDNTVTNIYVTNLSASGCSKAAGIKLYASGPDYGTATVHNVTYQGVTVDDCDYGLQIQSCYNSNSSYCAEYPTTASLTDVYFKDFSGTTSGKHGSVVANLDCSADMTCDVYVENFSIKPPSGTAEVLCANFDGSPGVTCTPGASG

SEQ ID NO: 25233 - protein, 305 aa, Penicillium marneffei
  strain ATCC 18224 / CBS 334.59 / QM 7333
MPSLPVLIDTTPDFDFAPAQDATQKRTLLLAPPSIAAHEEKLRDIFATFDRSVTDLQMLDRLSAGFVTLPASAYDLVLVLTDTNGARRNEALGLLTRDVFNVLTPAMKPSAQLKLQDGPFQATEGREAILAGLVENNGAFEKPQYQEAAVPLRFGLKKKNKVAPEPVKVESVGFVDNYDDDELIDEDDLLAEEDLGRPVQQPAECKPDIAKKRRRACKDCTCGLAAQLEAEDAERREKANAELNVLKLKTDELNDEVDFTVQGKTGSCNSCSLGDAFRCEGCPFIGLPAFKPGEEVRIMNDMAQL

SEQ ID NO: 25234 - protein, 489 aa, Penicillium marneffei
  strain ATCC 18224 / CBS 334.59 / QM 7333
MSIDLNWEAATSGPDGEQLAERIRCFIHDKFQQVPLPRFIRSVNVHSFEFGSIAPELEIKDICDPFVDFYEESDSEDEDEGHEDIQSDASSDRAAADKRGMRYRHDNNGHDEHGTNHHDHLRTSQWVTGEIDGHHQSAQSPLRSPIGLGDHLNAQFRSTTPNILPGVTSNLGYHLMMGNLSGTQTPLVAVAGGGTPFGTGWPDAVMHGGSQLAGQPHGRGRGREENNNNNLDTGSPSRPSTANTNPTQLSHGQSAAGSSSNNTSNDPTVIYNDHASSTTATAHGLHEGREKQAPTSIIDQESPPSPTPHMRERRPEDFQVICRVKYAGDVKLSLTAEILLDYPMPSFVGLPLKLNITGITFDGVAVVAYIRRRAHLCFLSPEDADALLGDEEEDINHQQRQQQQQQHPYPTTNTSESINNNNPETHPPQPRRRFGSLLQQIRVDSEIGRKENGKQALKNVGKVERFVLDQVRRIFEDEFVFPSFWTFLV

SEQ ID NO: 25235 - protein, 244 aa, Penicillium marneffei
  strain ATCC 18224 / CBS 334.59 / QM 7333
MRHLPFYFLLLHALFASSQDLPQTLTHPPPTPTTPHATLEQRAGTVIIVTVTVTPSTVPITPSYTNPVIFENDILNQTNYYRRQHNASTLIWNETLAAYAKQWAEPCDWKHSGGPYGENLAEGYTNVTSAIDAWAIESKEYKYSPPAGFSEKTGHFTQLIWKATTDVGCGVADCSANDDDNTRGKAVGWFLVCEYWPPGNVVGDHNEYFKDNVKPVVSLGVRLKVHGFGVWLMFGFAEAFLQLL

SEQ ID NO: 25236 - protein, 414 aa, Penicillium marneffei
  strain ATCC 18224 / CBS 334.59 / QM 7333
MKSYLTIFTLAGAAIAQVSAWGQCGGIDYTGSTTCASGYSCVFVNEWYSQCQPRGSATTSSPPSTTSSMPTSTGSLAAVRYLGRVNPATNELTWPGTGLSFTFTGSSAVIDFHEVNGTNSVGLIIDGGEPTVISNVDGTSISTPAGLSQGRHTVQLRKRSEALFGTIVVGKVTTDGPSSAEKTPPRKIEFIGDSITVGYGLDGTLPCTNTAALEDNPKTYAALAANALGADYSVVAWSGIGITRNYVSTAPDPSPIMPERYTRYGANDADNSYTFPSDWTPDAVVINLGTNDFGYLAYNASGQAYDAREPLNATTYTNAMVSFVQSIQKHYANAKFFLMTSPMLSDSFPTAEDAQHTTMSKALQAAISQIGANAHLVDWPTQGSEVGCDYHPNAATHAAQGVVLTSAISTVMGW

SEQ ID NO: 25237 - protein, 254 aa, Penicillium marneffei
  strain ATCC 18224 / CBS 334.59 / QM 7333
MRPSSYLSLLLLSLSSSLALTHAIPLPLEQRNTVLNEFLTALLNHLPNINVAINDATSIITNLDNLLAKLIGATTTQNQFRSGGPCAEYTLIWARGTSEPGNMGVLVGPPLVWALQDVVGTSGLTIQGVNHYSASVAGYLEGGDPSGSSNMASLISEAYSSCPNTKLIAAGYSQGCQVTHNAISQLDATTAAWIDKVLLFGDPDNGQAIPNVDSANVYTACHNGDNICDNGDLILVPHLTYAENVVAAAAFATA

SEQ ID NO: 25238 - protein, 434 aa, Penicillium marneffei
  strain ATCC 18224 / CBS 334.59 / QM 7333
MRFTSTLQLLLAATTVLAVPSIDERSPSISRNKQVGPKCAFKPLPETAKRNKVCKVKTHGNGKDDSDYILAALKSCNNGGKVVFDKDYTIGTALDIQWLKHIDLDITGTIQFTNDTNYWINNAFQIVFQNSTTFFQLGGEDVNIYGGGTIDGNGQVWYDMFAVNATLQRPILMGIIGLEGGSIGPLKLRHSPSWYHIVANSSNVVFDGLDISGYSTSVHVAKNTDGWDTYRSDNIVIQNSVINNGDDCVSFKPNSTNILVQNLHCNGSHGISVGSLGQYPGEVDIVENILVYNISMFNASDGARIKVWPGINSELEASLQGGGGQGSVRNVTYDTMSIHNVDWAIELTQCYGQSNQTLCDEYPSKLTITDIHFKNFSGVTSTKKGKNIATLVCSSPNVCSDIYAENINVVSPSGYNQAICTNVDDSLLSLNCTA

SEQ ID NO: 25239 - protein, 999 aa, Penicillium marneffei
  strain ATCC 18224 / CBS 334.59 / QM 7333
MFFFRFLTTVLLLFNAKLLVAQSSNTSSPVHWDKYSLSINGERLFVFAGEFHYIRLPVPELWLDVFQKLKANGFNAISVYFYWNHHSASEGVYDFETGGHNVQRLFDYAKQAGVYIIARPGPYANGELSAGGYALWAANGRLGGERTRDSQYYDLWSPWMTKIGKIIAANQITEGGPVILVQHENELQETTHRANNTLVLYMEQITQILDAAGIVVPSTHNEKGMRSMSWSMDYEDVGGAVNIYGLDSYPGGLSCTNPNAGFNLIRTYYQWFQNYSYTQPEYLAEFQGGYFTPWGGVFYDDCASMLQPEYADVFYKNNIGNRVTLQSLYMAYGGTNWGHIAAPVVYTSYDYSAPLRETREIRDKLKQTKLLGLFTRVSPDLLQTEMEGNGTSYTTGANIFTWALRNPETNAGFYVVAQDDSSSTTDVVFDLEVETSAGSVNITNIGLDGRQSKIITTDYKVGDTTLLYCSADILTYATLDVDVLALYLNKGQTGTFVLANAASHLKYTVYGNSTVTSSNSSQGTIYTYTQGQGISAIKFSNRFLVYLLDKYTAWDFFAPPLQLSDPNVKPNEHIFVIGPYLVREATIKGRTLELTGDNQNTTSIEIYHGNPFITSITWNGKHLSTKRTAYGSLTATIPGAEAITITLPKLTSWKSHDMIPEIDPEYDDSNWVVCNKTTSFNAIAPLSLPVLYSGDYGYHAGPKIYRGRFGSTNATGVTVTAQNGNAAGWSAWLNGIYIGGVTGDPSIEATSAVLKFNSSTTLKQEGSENVLTVLVDYTGHDEDNVKPARAQNPRGLLGVIFEGSTSTNFTSWKLQGNAGGEKNIDALRGPMNEGGFYGERLGWHLPGFEPSTKSGWDTRAPSDGVDGGSHRFYITEFTLDLGPNSHALDVPIGIHLNASSTSGPAVAYVWLNGYKFAHYLPHIGPQTVFPFQPGVLNIQGSEGHKRKNTLAVSLWALTDQPAALDVVELVAYGKYTSSFDFARDWSYLQPRWVDRSKYA

SEQ ID NO: 25240 - protein, 451 aa, Penicillium marneffei
  strain ATCC 18224 / CBS 334.59 / QM 7333
MKVSSLLPSVLLLVGATRASPHPAQPPQQQPLNNIIEESNTQTNPPNKHDLEHVIDTSPLLSLHRDLVKFESISGNEADVGDFLIQYLQARDFKVEKQIVVPKGPKGQGERFNIYAYPNSTPEPRVLLSSHMDTVPPYIPYSLDLPSSNGSTTDSLNWRDNILIAGRGSVDAKASVASQILAVLEYLQLHPEAPLGLLFVVGEEVDGIGMQYFSQSELNTSPPTVHTVIFGEPTELALVSGHKGSLFFKISAKGKAAHSGYPWLGQSAVSALLPALVKLDTLADIPVEDGGIPGSEKLGKSTINIGRIDAGIASNVVPASAEASVNIRLAYHDVEKVKEIVTKAVDEATNGDENVTIEWGNKGKGHAPIDFDTDVDGFKVMTVNYATDAWYLKFHEGSGGSPEGRVHTYLYGPGSIFVAHGADEAITVRDLEDAVSGYKKLIEAAFERNKV

SEQ ID NO: 25241 - protein, 823 aa, Penicillium marneffei
  strain ATCC 18224 / CBS 334.59 / QM 7333
MDTAFILLLASTMPIVSAQSASWSAAYSKASASLSKLSQNDKIGMVTGIGWGKGPCVGNTAAPSGISFPSLCIQDSPLGVRYANPVTAFPAGTNAGMTWDRTLINQRGAAIGAESKGLGVHVQLGPVAGPLGKIAQGGRGWEGFATDPYLSGVAMIETITGMQSSGTQACAKHYIGNEQELNRESMSANIDDRTLHELYLWPFADAVRANVASVMCSYNQINGTFSCEDEESMTRILKTELGFPGYIMTDWNAQHTTANSANSGLDMTMPGSDYSNTPSSVFWGQNLAKAISSGQVAQSRLDDMVIRVLAAWYLVGQDQGFPAVAFNSWSGGQASVNVTSNHNQVAHAVARDSIVLLKNTNGTLPLNKPTSIAIIGTDAQTNPSGPNACTDHGCDTGTLAMGWGSGTCQFPYLTDPLTAIKSQAASDGTTITTSISDDSSAGASAAQSAEYAIVFINSDSGEGYITVEGVAGDRNNLDPWHSGNALVQAVAAVNKKTIVVIHSVGPVILETILAQPNVVAVVWAGLPGQESGSALADILYGRTAPSGKLTYTIAKQASDYGTAVVSGNDNYPEGLFVDYRHFDKSNIQPRYEFGYGLSYTTFAYTNLAVTITVSAGPTTGQTAPGGPSDLFGSVGTVTVQVANTGSVAGAEVAQLYIGLPSSAPSSPPKQLRGFEKLSLAAGASGTATFDLTRRDLSYWDVSQQKWVVPSGAFTLYVGASSRDIRLQGTFTPGGGSTTSTIISSKTSSTISTSVTSTSVATSTSITSSSTTSKTTTTSSTTSAAGPTQTAYGQCGGQGWTGPTTCPSGWTCKVSNQWYSQCLQ

SEQ ID NO: 25242 - protein, 565 aa, Penicillium marneffei
  strain ATCC 18224 / CBS 334.59 / QM 7333
MAFNFNWSPLMADAGFYTRAQDLLTAALNKSPKPPIIVDDIKVTELNLGSIPPDLEILEVGDLAEDRFRGIFKMSYNGDAFLTLKTRVQANPLNTFLVTRPSFASPKPLAAASGLTIPLQITLSEFRLSGFVVLVFSKQKGITVVFRNDPLESLKVSSTFDSISFVRDYLQKAIEGQLRALFMDELPAIIHRLSLRLWVPEYRDRESESVNTLDLSSESGPGQDPLASPPQDPVDASGNALNPSEVASLSLDSGVEIHNLFSHKNLLRLAALTDSQRTLSLFTPSIKDVVYRAWTASAELGESNTLTSPTSPVLSRTHSHIGSLHSFVDNASTISMQSGGSSNFSGFGSYLRPGRHSRSHTKKRKKRVVDLRRPKTTDDVDSVSGDSVFSSENATSAPTIFSSPAHFSEEKNDDPVTPPLGPQNDLHLPTIHERRRISQGDQTLRRSNLSMSEAAQPSSSRSAQMIAETWPDPDATPRNTIRLPSNDRASNRFTAVSLPSSAIQYTPTVPINNNNPREQVWLSKMAAELARRMQEQKIDPSGSRPFPDFWDDHSREEIPPPAYGH

SEQ ID NO: 25243 - protein, 536 aa, Penicillium marneffei
  strain ATCC 18224 / CBS 334.59 / QM 7333
MSALNSFTMYKSAIILGSLLATAGAQQIGTLTTETHPPLTWSTCKSGGSCTSNSGSIVLDANWRWVHSVNSSTNCYTGNTWNTNICDTDASCAQDCALDGADYSGTYGITTSGNSLRLNFVTSSNVGSRTYLMADNTHYQMFDLLNQEFTFTVDVSNLPCGLNGALYFVTMDADGGISKYPNNKAGAQYGVGYCDSQCPRDLKFIAGQANIEGWAPSSKNNNTGIGNHGSCCSELDIWEANSFSEALTPHPCDTPGLTVCTGDNCGGTYSNNRYAGTCDPDGCDFNPYRLGVTDFYGSGKTIDTTKPFTVVTQFVTNDGTSTGTLSEIRRYYVQNGVVHPQPSSKISGVSGNVINSDFCAAEISTFGETASFTNHGGLPKMSAGISAGMVLVMSLWDDYDVNMLWLDSTYPTNATGTPGAARGSCATTSGDPKTLESQSGSSYVIYSDIKVGPFNSTFSGTGSTTGSTTTTTTKPSTSMSSTSTTTKTSTSTASTSTGTGVAAHWGQCGGQGWTGPTACASGFTCTVVNPYYSQCL

SEQ ID NO: 25244 - protein, 375 aa, Penicillium marneffei
  strain ATCC 18224 / CBS 334.59 / QM 7333
MHSFIGLAGLAFFSSVVLAVPAPAVTTPATLENRATSCTFSGSNGAASASKSKTSCSTIVLSNVAVPSGTTLDLTGLNSGTKVIFEGTTTFGYKEWTGPLVSVSGTRITVEGASGAVLDGDGARWWDGQGSNGGKTKPKFFYAHNLKSSTISNIKVLNSPVQVFSINGAETLTLDSITIDNSAGDSTGAHNTDAFDVGSSNGVTISNAIVQNQDDCLAVNSGTNIIFTGGTCSGGHGLSIGSVGGRSDNTVQTVHIENSTVKNSQNGVRIKTVYGATGSVSGVTYKGITLSGITKYGIVIEQDYENGSPTGTPTTGVPITGLTIDGVTGSVTSSATDVYILCGSGSCSGWTWEGVNITGGKRSSSCKNVPSGASC

SEQ ID NO: 25245 - protein, 303 aa, Penicillium marneffei
  strain ATCC 18224 / CBS 334.59 / QM 7333
MKGSLFVGALCVLGAAASPLNKRVLVTDIEVTVVTVTVTETPGAATTSVPASTISVAATTNPVAAAANVNTDFPLPPWTETETETAIVVPSSTPSTPTFVAPEPTIVAPEPSITADPTTAVVETTSTSTSVTPAGTDAAYQAKILDSHNIHRSNHSAPALAWNETLAQSALALASTCDYHHDTSLGPAAGYGQNIAFGVGCDNVDQIITNMMYNEEMMYYQGLYGEANPDMTNFENWGHFSQIVWLDTTTVGCATVTCSPLAESGSSMSLPFTVCNYYPAGNYGGEYGDNVLAPLGNPMVVAP

SEQ ID NO: 25246 - protein, 833 aa, Penicillium marneffei
  strain ATCC 18224 / CBS 334.59 / QM 7333
MLPDENGIDGWLRYAPLPSEFASQFKQHRSIIALSNDDSSPVLTAAKEVQDGLNKILKQEVKISHNFVPNRQTEDAATIVIGTIHEFSQAGGDVTHIPPLKEDGFWLDEDKNGNVQILGQNERGALYGAFEFLMLLAQGRPCPSSHISNPSAPIRWVNQWDNLDGSIERGYAGPSIFFKDIVVQEDLTRVSQYARLMASVGLNGIIVNNVNSHHDLLSPINLEGLGRIANAMRPWGVRIGVALFFDTPKTLAGLPTSDPLDPEVIAFWDRITAQLYQHVPDLIGYLIKANSEGQPGPLTYGRTLAEGANLFAAALKRHGDGVLIYRAFVYNHHLDESNWKNDRANAAVEYFKDMDTLFADNVLVQIKYGPIDFQVREPTSPLFAHLRRTPAIIEFQVAQEYLGQQSHVCYLPPLWKTILDFDLRIDGEPSPVHKILSGERFDWKRSGYAAVVNVGSDSTWLGSHLAMSNLYAYGRYAWDPISDAENVIRDWTRLTFAINPTVVDTVTSISMESWPTYENYTGNLGIQTLCEITKTCHYGPRPDSMDGNGWGQWTRADAHAIGMDRTVATGTGYARQYPAEIAQLYEKIESTPDELLLWFHHVPYTQRLKSGKTVIQHFYDAHYEGAANAQTFAPRWEALRGLVDQARFEHVLFRLKYQAGHSLVWRDSVNNFYMDKCGIADEHGRVGHYPWRIEAESMDLTGYTVVPITPFEAASGGKAIITTSNDQPGSAKCKVPFKTGVYNVAVNYYDHLGGTSKYKLLVGGRLIGEWVGDLGTILLHDFSDLRDGHSATRINFDSVQVTKGDLLEIIGTPDGTELAPVDYVSFLPRGIID

SEQ ID NO: 25247 - protein, 395 aa, Penicillium marneffei
  strain ATCC 18224 / CBS 334.59 / QM 7333
MKPTTTIVTSAILAATSIQAQQTGYGQCGGQNWTGATTCVSGWTCTYLNNWYSQCLPASSTLTATTSSKTSTTSTTVKTTTSVTSSPTSTGKLKWFGVDESCAEFGTAMPGTWGVDFTFANTATIGELINQGFNIFRVPFAMERMAHGSITAALDTAYLTNYSVAINYITQHGAYAVIDPHNYGRYNGNIITDTTAFQTFWSNLATAFKGNSKVIFDTNNEYHDMDETLVFNLNQAAINGIRGAGATTQYIFAEGNSWTGAWTWNTTNDSLKGLSDPENLLVYEMHQYLDSDGSGTNAACVSSTIGVERVQGATSWLKANRKLGVLGEYAGGPNSVCQAAVTGMLDHLVANNDVWLGAVFWAAGPWWPSSTWSNFEPPSGQAYVYYDQILKAYTP

SEQ ID NO: 25248 - protein, 1009 aa, Penicillium marneffei
  strain ATCC 18224 / CBS 334.59 / QM 7333
MAQLFTKIIVYFLLFASPLLANQWPLHNNSLNDVVQWDHYSFEINGQRLFVFAGEWHYWRIPVPELWIDILEKIKAAGFTAFGIYVNWAYHAPNNYTVDFATGAHDITPILKMAKDVGLYVLLRPGPYINAEVNAGGFPLWVTTGEYGSLRNDDSRYTAAWEPYFTKISEIASEYQITKGGNVVTYQIENEFGDQWTGSPSRRVQYEPAAKYMELLEANARRNGIDIPLVANEPNMRAISWGKDWSNSSANVDVVGLDSYPSCWTCDLSVCTGTTGEYIAYQVIDYYGYFQETQPTMPSFFAEFQGGSYNPWGGPVGGCPEDIGPDFANLFYRWNIGQRVTAINLYMLYGGTNWGAIAAPVVASSYDYSSPISENRTIGAKYYETKLLTMFTRAARDLIVTDLIGNGTQYSTNPAIQTHVIRNPITNGTFYVTLHTISSSSTDETFQLHVNTSAGAFSIPRYGNSIRLNGHQSKIIVTDFQFGTHKLLYSTAEVLTYTVLDGIPTLALWVPTGESGEFSVLGGKWASVLRCEWCSDIQFHPEQDQTSNPTVSRLTVSFTQGQGMSVIKLDTGLRVVLLDRESAYYFWAPALNSDPSVPEDQSVLVQGPHLVRSAKIVGSTIRLTGDSAQTSPIEVFAPKQVRIIFWNDKELKTSKTSYDSLQASLPQPAYVKLPLLGPWKYNGSLPEKAQDYKDTSAAWISADHMKTSNPSPPATFPVLYADEYGFHNSIRIWRGYFTGNATGVVLKVQGGYAFGFSGWLNGKLLGSYLGNASVEHSHLTLPFNVSHVSTSSDNVLVIVHDDTGHDETTGALNPRGILEATLLSDNSSSKFSHWRVAGTAGGETNIDPMRGPYNEGGLYAERMGWHLPGFNDNAWSDAGSKLNFTGADIKFYRTTVPLNIPKGVDVSISFELSACGTTNAFRSQLFVNGYQMGRFNPWVGNQIEFPVPPGILDYTGDNTIGLSLWAQTEDGACAIVDWKINYVLGSSLDVTFNGEYLRPGWTSERLQYS

SEQ ID NO: 25249 - protein, 795 aa, Penicillium marneffei
  strain ATCC 18224 / CBS 334.59 / QM 7333
MLGLIALSFIAYLAVTQAFPREPVPSKHIPCGHSNGCSPDPWAKLYPSPGAVVVDNSANPYPGSFSTVQAGVNALNSTATRPQSLFIFPGTYREQVYIPKLKSNLTVQGHTHNSKGYEQNTVTITYNLALINTTNDDLTATLRLWNPNTKVYNLNVVNTFGHIPKNGQNLAVSAEATGQGYYGCQLIGYQDTLLAETGLQLYAKSLIVGAVDFIFGQAALAWFENIDIRTIAAGSVTASGRSSATNPSWYVINRSNVSAINNTIPAGVNYLGRPWGSFARVVFQETYLGNIIAPPGWSQWSTSTPNIGNVTLAEFNNYGPGSALQQGSRAKFSEQLTQPISIRSILGEHFENEWWVDTAYLDNNDVTTGASTWTTTTIPTSGSTFASSSISISSSSAPSTISTAATFTSSVTFSSALTLTTVSSVSVPLISPSVTTSTPMAASSATSCICTDYSQISSAVTSCTNIVLSNIAAPNGSAIDLSGLQAGTTVTFDGSTTFGFTNSSSFNPMIISGVGITITANPGAIIDGNGQAYWDGLGSNGGVPKPDHFIVVKRVTANSVVKNLYIQNWPTHLFSISSSSDVVFQDLVLNNTAGNAPNALSSGLAAAHNSDGFDLSSSNNIVVERTLVYNQDDCVAITSGDNVTVSNVECHGGHGLSIGSVGGKSNNNVTNIRFADSSVINSQNGCRIKTNYNTTGYIANITYSNIVIRDVSIYGVDVQQDYLNGGPTGTPTNGVFIEDVLFQNVTGTATSSAQDYYVLCGDGSCSNFTFTDVAITGGSRSSSCNYPKSGCPLAS

SEQ ID NO: 25250 - protein, 461 aa, Penicillium marneffei
  strain ATCC 18224 / CBS 334.59 / QM 7333
MLRYLSIVAATAVLTGVEAQQSVWGQCGGQGYTGATSCAAGSTCSTQNPYYAQCIPATATSTTLVKTTSSTSVGTTSAPTTTTTKATTTKASTTATTAAASGNPFSGYQLYANPYYSSEVHTLAIPSLTGTLAAAATKAAEIPSFVWLDTAAKVPTMGTYLANIEAANKAGATPPIAGIFVVYDLPDRDCAAAASNGEYTVANNGVANYKAYIDSIVAQLKAHPDVHTILIIEPDSLANMVTNLSTAKCTEAQPAYYECVNYALINLNLPNVAMYIDAGHAGWLGWSANLSPAAQLFATVYKNASSPAALRGLVTNVANYNAWSISSAPSYTSGDSNYDEQLYVNALSPLLTSNGWPNAHFIMDTSRNGVQPTQQKAWGDWCNLIGTGFGVAPTTNTGDPLEDAFVWVKPGGESDGTSNSSATRYDYHCGNSDSLQPAPEAGSWFQAYFVQLLTNANPPLV

SEQ ID NO: 25251 - protein, 417 aa, Penicillium marneffei
  strain ATCC 18224 / CBS 334.59 / QM 7333
MHSLGVLVSLTLLAASALAGPINLTKRRTSTGETVVYWGQNGGGVIEATDLATYCSISSGIDIIVLAFLYQYGNGVTVPGGGFGQTCYILAGSGTAQSCSAVASAITTCQNNGVKILLSLGGASGGYSLTSQTEAKAIGDYLWQAYGNPSSITVPRPFGNAIVNGWDFDIENASGSSYYPYLIAALRSNFASDSASKYYISGAPQCPIPEPNMGSMIANSTFDMLFIQFYNNNNYTNPCALGINGDAPLNYLEWVSFISTSKSLDAKLFIGVPASTLAANGGESGSIYYATPEQLNIIVGDTRGNTSFGGVMMWSAGYSDSNVNDGCTYAQEVSKILYEGEICSGSYDVTRTLTPVAPTPSFTGTATGTSTATPTATGTPVPEWGQCGGIGYTGSTVCASGLICVYVSPYWSSCQAK

SEQ ID NO: 25252 - protein, 338 aa, Penicillium marneffei
  strain ATCC 18224 / CBS 334.59 / QM 7333
MKAFYLSLWALAGSASAYLATTTRYYDGQEGACGCGSSSGLSSWQLGISNGVYTAAGSQALFDTNDSSWCGGGCGKCYNLTSTGTSACNGCGEGGVAGESIIVMVTNLCPYNGNEVWCPSVGAKNNYGYSYHFDIMAESEVFGDNVVVNFEPVACPGQAALDWGTCVCHGQTDTDTTPAGMAAAAAAESAGTVATSSSSSSSSTSTVKTSTTLVAVPTSPVKEVASSSTSSTSTVKSIPTVVAESSPAAVVEPTSTAISTPQGAATTSTTSVTQYTTVTEIATVWVTPNPSATTCSSSAVQTLYGQCGGINWTGATTCVSGSTCKVQNPYYYQCVSSA

SEQ ID NO: 25253 - protein, 407 aa, Penicillium marneffei
  strain ATCC 18224 / CBS 334.59 / QM 7333
MTAVKSLLLALAVGQIAQAQLDTAAKAAGLLYFGTAVDNPDLSDSQYLATLQTADFGQITPANGMKWQPTEPTQGTYTFSDGDQIASLAKSNNDYLRCHTLAWYNQLPSYITSGSWTNQTLIAALQEHIKGVVTHYKGQCYAWDVVNEALNEDGTYRQNVFYQHIGEAYIPIAFAAAAAADPNAKLYYNDYNIEYAGAKATGAQGIVKLVKAAGGRIDGVGFQSHFIVGQTPSLAAQKANLASFTALGVDVAITELDIRMTLPDTSALQAQQSTDYQTTTTACVQTKGCVGITIWDFTDKYSWVPGTFSGQGDACPWDSNYNKKPAYYGILAGLKSGSGSPSSSSTLITTTKPTTTSTAPPTTTTSSSPSTGAAHWGQCGGIGWNGPTTCVSPYACQVFNPYYSQCL

SEQ ID NO: 25254 - protein, 240 aa, Penicillium marneffei
  strain ATCC 18224 / CBS 334.59 / QM 7333
MKLGYLALLPALRYYDGQEGACGCGTSSGLDSWQLGISSGVYTAAGSQAFFDTAGATWCGAGCGKCYNLTSTGNPPCNGCGAGGAAGKSIIVMVTNLCPYNGNQQWCPEVGSTNQYGYSYHFDIMAQSEIFGDNVVVNFEPVACPGQATSDWETCVCHGQTATDVTPAGLTNGGGSGSSSATSSTYTSTTSLPSTSTSTSAGATQTVYGQCGGSGWTGATTCAAGSTCHQANQWYSQCLP

SEQ ID NO: 25255 - protein, 289 aa, Penicillium marneffei
  strain ATCC 18224 / CBS 334.59 / QM 7333
MVAFSTLLAAFAAFVPSLAAPAPAVPIERDVALSERGPHDFILGAENRLGRRSAINYNQDYTTGGSVNYSPSSTGFSVNWSNANDFVVGVGWQTGTTSPITFGGSFSVSGGTGLLTVYGWTTNPLVEYYVMEDYSNPPTQGTIKGTFTSDGSTYTVWENTRTNEPSIVGTATFNQYISIRSSTRTSGTVTIQNHFQEWASLGMNLGTMNYQVMAVEGWSSSGSASQSVSNTGSGSTNGTTGTGGGNGGGNGGGSVAQWGQCGGQGWTGATACVSPYKCTVINPYYSQCL

SEQ ID NO: 25256 - protein, 288 aa, Penicillium marneffei
  strain ATCC 18224 / CBS 334.59 / QM 7333
MLSRALALSALVGGVLSVPIVEKRACPNIHVFGARETTASPGYGSSDTVVNDVLNAYPGSTAEAIVYPACGGQSSCGGASYSSSVAQGIAAVASAVNSFHSQCPNTEIVLVGYSQGGEIMDVALCGGGDSNQGYTNTAVQLSASAVTMVKAAIFMGDPLFRAGLPYEVGTCTAGGFDERPAGFSCPSASLIQSYCDASDPYCCNGNNSATHQGYGAEYGNQALTFIKGKLSGTSNPGNGTTGGNGGSGGSGGTVAQWGQCGGQGWTGATGCVSPYTCTVINPYYSQCL

SEQ ID NO: 25257 - protein, 356 aa, Penicillium marneffei
  strain ATCC 18224 / CBS 334.59 / QM 7333
MAIPLVLALAWFLPLVLAASLTQVNSFGDNPGSLQMYIYVPSTLASKPAVIVAMHPCGGSATQYYGMYDYHSPADQYGYILIYPSATRDYNCFDAYSSASLTHNGGSDSLSIVNMVKYVISTYGADPSKIYMTGSSSGAIMTNVLAGAYPDVFAAGSVFSGMPYACLYGAGAADPRMSNQTCSQGQIQHTGQQWAAFVHNGYPGYTGQYPRLQVWHGTADNVISYADLGEEVSQWSTVMGLSFTGNQTNTPLSGYTKMIYGDGSQFQAYSAAGVGHFVPTDVSAVLDWFGITGGTTTTTTKTMPSTSTTPPTTTSSTGGCAAAHWAQCGGIGYTGCTTCASPYTCQKMNDYYSQCL

SEQ ID NO: 25258 - protein, 847 aa, Penicillium marneffei
  strain ATCC 18224 / CBS 334.59 / QM 7333
MTFGVGGPSLLTVCLLATSVSSAVLQAYTWKNVKTGGGGGFTPSIVFNPSVPGVAYARTDIGGPYRLNQDDTWTPLLDSVNNSNWHNWGIDALATDPVDTKRLYLAVGMYTNDWDPNPGSILRSTDSGTTWQETVLPFKVGGNMPGRGVGERLAVDPNKNSIVYFGARSGHGLWKSTDYGVTWSNVTSFTWTGTYFQNASSSYTADPVGIAWVTFDTTSGTKGSLTPRIFVGVVDTGKSVFKSEDGGVTWAWVSGEPMYGFLPHKGILSPVEKTLYISYSNGAGPYDGTNGTVHKYNISTGVWTDISPTPMASTNYGYGGLAVDLQVPGTVMVAALNCWWPDELIWRSLDSGATWSPIWAWNGYPNLNYYYNYDISNAPWLQDNTSTAQFPVSVGWMVEALAIDPFDSNHWLYGTGATIYGGHDLLKWDSNHNVTVKSLAVGIEEMAVLGLISPPGGPPLLSAVGDDGGFYHSDLDKAPNQYFHDPTYSSTNGIDYAGNKPSYIVRSGSSSTLPTVSISTDFGLTWSADYAASSSTVPGSVAISADGDTVLLTSTTGSPLISKYSSSFSTVSGLPSSAVIASDKSNNTVFYGGHAGNFYTSTDGGVSFTKTVSLGSSAAVNTIRAHPSIAGDVWASTDTGLWHSTNSGSTFTQIGSSCTAGWSFGFGKAATTGSYPVIFGFFTIDGVTALFKTEDIGVNWQMISDATHGFGSSSANVVNGDMSNYGRVFVGTNGRGIWYGEPSGSLPSSTASGTKTSATGITSSTSSITKSTSATITTSSIKSTSSSTTRTSSVVTTTTSGTSATAAPYGQCGGSEYTGPTVCPSGWTCTFYNDYYSQCKIYHSVAL

SEQ ID NO: 25259 - protein, 844 aa, Penicillium marneffei
  strain ATCC 18224 / CBS 334.59 / QM 7333
MRALPFLLLTSLFGHALAEDGLNGWLRYAPLPASLASHFPHDFPSSIVALNSSVNSPVYTAAQELQKGFQGILHKPIDIVNSTKDHSHSSSIVVGTADAYTEAFGTGTNWGDLIEDGFWLHTSKDSVQIIGQNERGALYGTFEYLSMLAQGNFSDVAYTSNPHAHIRWVNQWDNLDGSIERGYGGASIFFKNDVVVANLTRATEYARLLASIGLNAVVVNNVNANSSLLTPENIQGLGRIADVFRPYGVQLGISLNFATPQQIGGLNTYDPLDQGVIKFWTNITDQLYKAVPDMAGYLVKADSEGQAGPLVYNRTLSQGANLFANALKPHGGILMYRAFVYNQLNESNWKADRANAAVEFFKDLDGEFEDNVIVQIKYGPIDFQVREPASPLFANLLNTNTAIELQIAQEYLGQQCHLVYLPPLWKTILDFDLRVESKQSRVSDIVSGERFNRSLGGFAGVVNVGTNTTWLGSHLAMSNLYAYGQLAWNPARDPADIIQDWTRLTFELDQHVVDTITEMSMESWPAYESYSGNLGIQTLTDILYTHFGPNPASQDNNGWGQWTRADHTSIGMDRTVSNGTGYSGQYPPEISSMYENIETTPDDLLLWFHHVPYTQKLQSGKTVIQHFYDAHYTGAATAQTFPTKWESLKNRIDKERYNHVLYRLAYQAGHSIVWRDAISEFYHNLSAIPDEAGRVGTKNHPWRIEAENMDLTGYIPYTVNPFETASNATAIVTASNTTAGTASTRINFQTGKYDIAVNYYDVTGGVSHWKLFINDKQIGEWDGDHEFTLGHAPSVHLDGHSASRVTFRGISVKKGDLLKIWGQPDGIEQAALDYVVFLPKGVVD

SEQ ID NO: 25260 - protein, 397 aa, Penicillium marneffei
  strain ATCC 18224 / CBS 334.59 / QM 7333
MQISTALISLGLLASSVVAAPHRLKARAPGGEVVVYWGQNAAAASENNDLSTYCTSSSGIDIVVLAFLYEYGNGITIPSGVIGQDCSISTSGQGSNCGNLARQISTCQSHGVKVILSLGGAVGAYSLTSQAEAETIGQHLWDAYGNTSGGSIPRPFGSVFVNGWDFDIEASSGNQYYQYMISKLRSNFASDSAHTYYITGAPQCPVPEPNMGQIITAAQFDYLWIQFYNNPYCSYPNTLNYHDWVSYVSGTPSAHAKLFLGVPASELGSTGTQSGAVYYQSPSVLASTVASFDTSSNWGGIMMWDAAFSDANMVNGCTYAQQASSILKTGSPCGGTGTTPPPPTTTSTSPTTSPTSPATGTPVAQWGQCGGQGYTGSTVCASPYHCVTESIWWASCQ

SEQ ID NO: 25261 - protein, 446 aa, Penicillium marneffei
  strain ATCC 18224 / CBS 334.59 / QM 7333
MSITIWQYFRNQAAMKTTILLASAILGHSVSAQIVGAYGQCGGVNYSGSTACVSGYVCIFLNPYYSQCVPGTATTTTSSTLTTTTSKTTSSTSKTTTTSAPTSTGFSKVNGLNFTIDGKTNYFVGTNTYWLAFLNNKSDVDLVLSDIAASGMKILRVWGFNDVNTVPSPGTVYFQLLANGTATINTGADGLEKLDYVVSSAEAHGIKLIIPFVNNWSDYGGMAAYVTAFGGSQTTWYTNTAAQVAYQAYIKAVVSRYRTSPAIFAWELGNEPRCKGCNTSVLTDWAKTTSAYIKSLDANHMVTTGIEGFGLDAGSDGSYPYTYSEGTNFTALLSIPDIDFGTIHLYPNSWGEALSWGSSWVSTHGAACASIGKPCILEEFGATSDQCANEAPWQATSLNTKGIGADMFWQYGDTLSTGQSPNDGNTIYYGTNTFTCIVTNHVAAIR

SEQ ID NO: 25262 - protein, 498 aa, Penicillium marneffei
  strain ATCC 18224 / CBS 334.59 / QM 7333
MMSHVATRPLALAAIAALFHQVASQQAPTPDNTVSLPTWKCTSSGGCVQQSTSIVVDWVYHWIHTVNGSTSCTTSSGLNSALCGTEKECYTNCEISPATYDGLGIRASGNALTLNQYVTSNGTTNSVSPRVYLLDPAGKNYEMLQLLGQEISFDVDVSNLPCGENGALYLSEMDATGGRSQYNPAGASYGSGYCDAQCGTGSWFNGSINTGSLGSCCNEMDLWEANSQATALTPHPCSVDGPYGCSGSACGSTGVCDKNGCGFNPYALGDHNYYGSGYTVDTSKPFTVTTQFVTSDGTKTGALTEIRRSYVQNGKVIANAVASSSSGVSGANSITESFCTTMDSEAGTLGGLRTMGEALGRGMVLIFSIWNDAGGSMNWLDSGNSGPCSSTAGVPSTIQANDPSTSVTFSNIKWGDIGSTGPSPGGSSSSSSSSSKSSSTTISITHSTTSSSATTTTTSTGATQTHWGQCGGTGYSGPTACAPPYTCKAQNPYYSQCL

SEQ ID NO: 25263 - protein, 608 aa, Penicillium minioluteum
MATMLKLLALTLAISESAIGAVMHPPGNSHPGTHMGTTNNTHCGADFCTWWHDSGEINTQTPVQPGNVRQSHKYSVQVSLAGTNNFHDSFVYESIPRNGNGRIYAPTDPPNSNTLDSSVDDGISIEPSIGLNMAWSQFEYSHDVDVKILATDGSSLGSPSDVVIRPVSISYAISQSDDGGIVIRVPADANGRKFSVEFKTDLYTFLSDGNEYVTSGGSVVGVEPTNALVIFASPFLPSGMIPHMTPDNTQTMTPGPINNGDWGAKSILYFPPGVYWMNQDQSGNSGKLGSNHIRLNSNTYWVYLAPGAYVKGAIEYFTKQNFYATGHGILSGENYVYQANAGDNYIAVKSDSTSLRMWWHNNLGGGQTWYCVGPTINAPPFNTMDFNGNSGISSQISDYKQVGAFFFQTDGPEIYPNSVVHDVFWHVNDDAIKIYYSGASVSRATIWKCHNDPIIQMGWTSRDISGVTIDTLNVIHTRYIKSETVVPSAIIGASPFYASGMSPDSRKSISMTVSNVVCEGLCPSLFRITPLQNYKNFVVKNVAFPDGLQTNSIGTGESIIPAASGLTMGLNISNWTVGGQKVTMENFQANSLGQFNIDGSYWGEWQIS

SEQ ID NO: 25264 - protein, 398 aa, Penicillium nordicum
MGFLKLFTTSLATLAVVNAGKLLTASDAHAVIPSSYIVVMNDGVSNAEFKTHRDWAANVHARITSRNSAESGPGKHFDINGMKGYSASFDDRIVKDIASDPAVKYVEPDMVVNATENVVQPNAPSWGLPRISSKKPGATDYVYDSTAGQGIVIYGVDTGIDIEHPDFEGRAEWGTNTADNDNTDGNGHGTHTASTAAGSKFGVAKKASVVAVKVLGGDGSGTNSQVISGMDWAVKDAKSRGVTGKSVMNMSLGGAVSQAMNDAAANVVKSGVFLSVAAGNEAQDASNSSPASAPIVCTVAASTSSDGSASFTNFGSVVDLYAPGEAITAAFPGGGSKTLSGTSMAAPHVAGAAAYLMALEGVTSDKACARIVELAISSISSAPSDTTSKLLYNGINAK

SEQ ID NO: 25265 - protein, 384 aa, Penicillium occitanis
MTRLLVGSVVLAVLATCAIAKPVAEPAITPAPNLLDKRATSCTNSGSSGACSASASQKSCSTIILCNVAIPSGKTLDLSSLPDDTTVIFEGQTTWGYEEWDGPLLQISGTGITVEGASGAYLNPDGARWWDGEGSNGGKTKPKFFYAHDLTDSTITNLHIQNTPVQAVSINGCDGLTITDMTIDNSAGDTEGGHNTDGFDIGSSTNVVITGANVYNQDDCVAVNSGTDITFSGGVCSGGHGLSIGSVGGRSDNTVDTVKFENSEVKSSVNGIRIKATEGDTGTITGVTYSGITLSSISKYGIIIEQNYDGGDLDGGTASSGIPITDLTIENISGSGAVSSSGYNIVITCGSGACSSWTWEDVVVTGGKDYGSCTNVPSVASCST

SEQ ID NO: 25266 - protein, 529 aa, Penicillium occitanis; identical to SEQ ID NO: 25210

SEQ ID NO: 25267 - protein, 380 aa, Penicillium olsonii
MIAGSKLLMLGLFGALAVHALPEPAKAQVTAAPKLEERATSCTFSGSAGASSASKSKTACATIVLSAVAVPSGTTLDLTGLNDGTTVIFEGETTFGYKEWSGPLVSVSGTDITVKGASGATLNGDGSRWWDGKGSNGGKTKPKFFYAHKMFSSTISDIHIVNSPVQVFSINGATDLTLSGITVDNRDGDTDEGGHNTDAFDVGSSTGITITGATVYNQDDCLAVNSGTDITFTGGLCSGGHGLSIGSVGGRSNNDVANVIIENSQIQDSTNGVRIKTVYEATGSVKNVTYKDITLSGITKYGIVIEQDYENGSPTGTPTDGVPITDLTLDGVKGTVASSGTNVYILCAEGACSDWTWDGVSVSGGKTSSACENVPSSASC

SEQ ID NO: 25268 - protein, 370 aa, Penicillium olsonii
MRTSILSMLALGAAAVSAAPAAAAAPAELVERGSSCTFTSASAAKAGKKSCSSIVLDNIKVPAGETLDLSNLKSGTKVTFKGETTFGYKEWKGPLIRFSGKNIEVNGASGHVINGGGASWWDGKGTNGGKTKPKFFYAHSLDDSTITGLNVKNTPVQGFSVQADNLVLDHITIDNTDGDKTNGGHNTDAFDVGESTYITISNANIKNQDDCLAINSGENIIFTGGTCSGGHGLSIGSVGGRDDNTVKNVTISDSTVSNSDNGIRIKTIYKAKGEVADVTFSNIELSNIAKYGIVIEQDYENGSPTGKPTTGVPITGLTVEKVTGSVKSSGTDVYILCGSGSCSDWTWSGNKVSGGKTSSKCKNVPSGASC

SEQ ID NO: 25269 - protein, 151 aa, Penicillium oxalicum
MSLWDDHNSNMLWLDSTYPTTASSTTLGAKRGSCDISSGAPNDVESQNANSYVVFSNIKAGPIGSTFDSGSTGGGNGSGSTTTTKGSTTTTKAPTTTTTTSKATTTTAASGGNGGGAAHWAQCGGVGYTGPTTCASPYTCTKQNEYYSQCL

SEQ ID NO: 25270 - protein, 545 aa, Penicillium oxalicum
MKGSISYQIYKGALLLSSLLASVSAQGAGTLTAESHPALTWQKCSAGGSCTPVSGSVVIDANWRWVHDKNGKNCYTGNTWDATLCPDDKTCAANCAVDGASYASTYGVTTSGNSLRINFVTQASQKNIGSRLYLLENDTTYQKFNLLNQEFTFDVDVSNLPCGLNGALYFVDMDADGGMAKYPTNKAGAKYGTGYCDSQCPRDLKFINGIANVEGWTPSSNDPNSGVGGHGTCCAEMDIWEANSISEALTPHPCDTPGQTMCEGNACGGTYSNDRYAGTCDPDGCDFNLYRQGVTNFYGPGMTVDTKSPFTVVTQFLTDDGTSTGTLSEIKRFYVQNGKVIGQPQSTVAGVSGNSITDSFCKAQKAAFGDTDDFTKHGALAGMGAAFEEGMVLVMSLWDDHNSNMLWLDSTYPTTASSTTLGAKRGSCDISSGAPNDVESQNANSYVVFSNIKAGPIGSTFNSGSTGGGNGSGSTTTTKGSTTTTKAPTTTTTTSKATTTTAASGGNGGGAAHWAQCGGVGYTGPTTCASPYTCTKQNEYYSQCL

SEQ ID NO: 25271 - protein, 477 aa, Penicillium oxalicum
MSFTRRQFLAAALALLPLAQAQQPAVANPANPSLKTYKCSKSGGCVAQDTSVVLDWNYHWIHTANGYDSCTISSGVDPTLCPDATTCSKNCVIEPANYTSSGVATSGDSLTLHQYVKSDGTYNNASPRVYLLGPDGDYVLMKLLGQELTFDVDLSTLPCGENGALYLSEMSGSGGRNANNKGGAAYGSGYCDAQCPLETWKNGTLVPGGQAYCCNEMDILEGNSAANSYTPHPCSSDDCDKGGCGFNPYAQGKTNYWAPGGTVDTSKPFTINTQFITNDGTTTGTLTEIRRQYIQNGKIIANAKSSAGVDSIKEAWCESVDGAAATFGGLTTMGKALGRGMVLIFSIWNDVSGNMNWLDSGSNGPCSSTEGNPTNIIAQNPDTHVVFSNIRWGDIGSTFNAPGGSGSSSSTTTSKATTTVATTKATSTTTKISTTTTAGGATQTQWGQCGGQGYTGPTACVSGTTCKAQNPYYSQCL

SEQ ID NO: 25272 - protein, 310 aa, Penicillium oxalicum; identical to SEQ ID NO: 25204

SEQ ID NO: 25273 - protein, 499 aa, Penicillium oxalicum
MAQLSFLTLAVLGLSGTVAAQSSCASAWAQCGGSNFNGPTCCVSGSSCSVLNPYYSQCVPGTQVPGSGSGSSSTRSSSTTTAGGTGPSTTATAGGGAAGTSKYTTSTSFPAATATQPAYPSADPSSCGAWTLVDNVCCPEYCLSNNKSESCTSSCSGGCGTPPSSMCKSGTMWGEQLEVGTDEDWHYSRSTHFGLTSGGACGFGLYGLCTKGSKTASWTDPMLGSTCDAFCTAYPLLCKDPSDVNLRGNFAAPNGDYYTQFWPSLIGALPGSPDNYLSCGECFELIRTRADGTEYQVGDSGYTDPIYLEVVDSCPCSANSKWCCGSGADHCGEIDFKYGCPLPEGSHHMDLSDIAMGRLQGNGSLTDGVIPIRYRRVPCPKPGNAYVWLRDGGSEYYFALSVVNTNGVGSITTVEVKGKGSNSWVALKRDPNYTSSRPQERYGAWVVPQGKGPFSLPVGIRVTSPDGQQIVNENAITSFTAPAGSVEGFYYIDLGVQFT

SEQ ID NO: 25274 - protein, 477 aa, Penicillium oxalicum
MSFTRRQCLAAALALLPLAQDQQPAVANPANPSLKTYKCSKSGGCVAQDTSVVLDWNYHWIHTANGYDSCTISSGVYPTLCPDATTCSTNCVIEPANYTSSGVATSGDSLTLYQYVKSDGTYNNASPRVYLLGPDGDYVLMKLLGQELTFDVDLSTLPCGENGALYLSEMSGSGGRNANNKGGAAYGSGYCDAQCPLETWKNGTLVPGGQAYCCNEMDILEGNSAANSYTPHPCSSDDCDKGGCGFNPYAQGKTNYWAPGGTVDTSKPFTINTQFITNDGTTTGTLTEIRRQYIQNGKIIANAKSSAGVDSIKEAWCESVDGAATTFGGLTTMGKALGRGMVLIFSIWNDVSGNMNWLDSGSNGPCSSTEGNPTNIIAQNPDTHVVFSNIRWGDIGSTFNAHGGSGSSSSTTTSKATTTVATTKATSTSTKISTTTTAGGATKTQWGQCGGQGYTGPTACVSGTTCKAQNPYYSQCL

SEQ ID NO: 25275 - protein, 546 aa, Penicillium oxalicum; identical to SEQ ID NO: 25201

SEQ ID NO: 25276 - protein, 495 aa, Penicillium purpurogenum
MATRSFTFAAITALLHQAAAQQAPTPDNLASLPTWKCTTSGGCIQQSTSIVVDWVYHWIHTVNGTSCTTSSGLDPTLCGTEEECYTNCEISPATYDSLGIQTSRDALTLNQYITSDGTTTNASPRVYLLDPASEDYEMLQLLGQEISFDVDVSNLPCGENGALHLSEMDATGGRSQYNPAGASYGSGYCDAQCGTSTWFNGSVNSNDLGSCCNEMDLWEANSEATALTPHPCSVDGPYGCTGDACGSTGVCDKNGCGFNPYALGDQSYYGPGLTVDTSKPFTVTTQFVTSDNTTTGTLTEICRSYIQNGKVIANAVASSSSGFSGASSITESFCTTMDSEAGTLGGLPTMGEALGRGMVLIFSLWNDASGYMNWLDSGSSGPCSSTAGIPSTIEANDPGTSVTFSNIKWGDIGSTGSGTGGSSSSSSSSSSVSPKTTSTTTTSATTKTSATTTTTSTGATQTHYGQCGGMYYTGITACASPYTCQVQNAYYSQCL

SEQ ID NO: 25277 - protein, 529 aa, Penicillium purpurogenum
MSALNSFNMYKSALVLGSLLATAGAQQIGTYNAEIHPSLSWSTCKSGGSCTTNAGSITLDANWRWVHGINTTNNCYTNNTWNTAICDTDASCAQDCALDGADYVNTYGITTSGNSLRLNLVTGSNVGSRTYLMADNTHYEIFDLLNQEFTFTVDVSNLPCGLSGALYFVAMDADGGVSKYPNNKAGAEYGVGYCDSQCPRDLKFIGGQANIEGWIPSTNNSNTGIGNHGSCCAELDIWEANSISEALTPHPCDTPAQTICTTDACGGTYSTDRYAGTCDPDGCDFNPYRLGVTDFYGSGKTVDTTKPFTVVTQFVTDDGTSSGSLSEIRRYYVQNGVVIPQPSSKISGISGNVIDSDFCAAELSTFGETTSFTDHGGLSKMGSALETGMVLVMSLWDDYSVDMLWLDSTYPTNETGTPGAARGSCPTTSGDPKTVEAQSGSSYVIYSDIKVGPFNSTFSGTGPTTGTTTTTTTKTSSTSSTSTTSSSTSTGTGVAAQYAQCGGQGWTGPTTCASGYTCTVLNAYYSQCL

SEQ ID NO: 25278 - protein, 234 aa, Penicillium purpurogenum
MHSKFFAASLLGLGAAAIPLEGVMEKRSCPAIHVFGARETTASPGYGSSSTVVNGVLSAYPGSTAEAINYPACGGQSSCGGASYSSSVAQGIAAVASAVNSFNSQCPSTKIVLVGYSQGGEIMDVALCGGGDPNQGYTNTAVQLSSSAVNMVKAAIFMGDPMFRAGLSYEVGTCAAGGFDQRPAGFSCPSAAKIKSYCDASDPYCCNGSNAATHQGYGSEYGSQALAFVKSKLG

SEQ ID NO: 25279 - protein, 382 aa, Penicillium purpurogenum
MKSLSFSFLVTLFLYLTLSSARTLGKDVNKRVTAGSLQQVTGFGDNASGTLMYIYVPKNLATNPGIVVAIHYCTGTAQAYYTGSPYAQLAEQYGFIVIYPQSPYSGTCWDVSSQAALTHNGGGDSNSIANMVTWTISQYNANTAKVFVTGSSSGAMMTNVMAATYPELFAAATVYSGVGAGCFYSSSNQADAWNSSCATGSVISTPAVWGGIAKNMYSGYSGSRPRMQIYHGSADTTLYPQNYYETCKQWAGVFGYNYDSPQSTLANTPDANYQTTNWGPNLQGIYATGVGHTVPIHGAKDMEWFGFSGSGSSSTTTASATKTSTTSTTSTKTTSSTSSTTTSSTGVAAHWGQCGGSGWTGPTVCESGYTCTYSNAWYSQCL

SEQ ID NO: 25280 - protein, 397 aa, Penicillium roqueforti
MVVFSQVTVALTCFSAIASAAAVRQEPPQGFTVNQVQKAVPGTRTVNLPGLYANALVKYGATVPATVHAAAVSGSAITTPEADDVEYLTPVTIGSSTLNLDFDTGSADLWVFSSELTSSQQSGHDVYNVGSLGTKLSGASWSISYGDGSSASGDVYKDTVTVGGVKATGQAVEAAKKISSQFLQDKNNDGLLGMAFSSINTVSPTPQKTFFDTVKSSLGEPLFAVTLQGTGRPWHLRFGYIDSDKYTGTLAYADVDDSDGFWSFTADSYKIGTGAAGKSITGIADTGTTLLLLDSSIVTGLLQEGYPGSQNSSSAGGYIFPCSATLPDFTVTINGYDAVVPGKYINFAPVSTGSSSCYGGIQSNSGIGFSIFGDIFLKSQYVVFDSEGPRLGFAAQA

SEQ ID NO: 25281 - protein, 435 aa, Penicillium simplicissimum
MLTSLSLTALALLPSANALVRKDGVGRLPALGWNSWNAFGCDVDSTKIMTAANEMVHLGLKDLGYEYVNIDDCWSVKNTRNSTTQRIIPDTQKFPDGISGVADQVHQLGLKIGIYSSAGETTCAGYPASLGYEKVDAEAFAEWGIDYLKYDNCGVPSNWTDQYSSCVPDGSNEPANGTCPGLSNPAPAGYDWTKSNTFTRYTMMRDALLGQTRTILYSLCDWGQADVNTWGNETGNSWRMSGDISANWARIAQIANENTFRMNYVGFWGHPDPDMLEVGNGDLTAAENRAHFALWAIMKSPLIIGTALDGISDANLAVLKNKYLIEFNQDPIIGRSAHPYKWGYNPDWTFDPAHPAEYWSGPSSTLKGTLVLMLNSENSTSTRTAVWKEIPELKGHNAYRVTDAWSGKDLGCVKKQYSASLASHDVAVLVVKEAC

SEQ ID NO: 25282 - protein, 302 aa, Penicillium simplicissimum
QASVSIDAKFKAHGKKYLGTIGDQYTLTKNTKNPAIIKADFGQLTPENSMKWDATEPNRGQFTFSGSDYLVNFAQSNGKLIRGHTLVWHSQLPGWVSSITDKNTLISVLKNHITTVMTRYKGKIYAWDVLNEIFNEDGSLRNSVFYNVIGEDYVRIAFETARSVDPNAKLYINDYNLDSAGYSKVNGMVSHVKKWLAAGIPIDGIGSQTHLGAGAGSAVAGALNALASAGTKEIAITELDIAGASSTDYVNVVNACLNQAKCVGITVWGVADPDSWRSSSSPLLFDGNYNPKAAYNAIANAL

SEQ ID NO: 25283 - protein, 270 aa, Penicillium sp.
WGALGHATVAYVAQHYVSPEAASWAQGILGSSSSSYLASIASWADEYRLTSAGKWSASLHFIDAEDNPPTNCNVDYERDCGSSGCSISAIANYTQRVSDSSLSSENHAEALRFLVHFIGDMTQPLHDEAYAVGGNKINVTFDGYHDNLHSDWDTYMPQKLIGGHALSDAESWAKTLVQNIESGNYTAQATGWIKGDNISEPITTATRWASDANALVCTVVMPHGAAALQTGDLYPTYYDSVIDTIELQIAKGGYRLANWINEIHGSEIAK

SEQ ID NO: 25284 - protein, 1011 aa, Penicillium sp.
MKLLSSWVVAALAAQAAGAAISHKLDGFTIREHADPAKRALLQKYVTWDEHSIFVNGERLMIFSGEVHPYRLPVASLYIDIFEKVKALGFNCVSFYVDWALLEGNPGHYSAEGIFDLQPFFDAAKEAGIYLLARPGPYINAEVSGGGFPGWLQRVDGILRTSDEAYLKATDNYASNIAATIAKAQITNGGPIILYQPENEYSGACCGYNGFPDGSYMQYIEDHARDAGIVVPFISNDAWAAGHNAPGTGAGAVDIYGHDSYPLGFDCANPSTWPSGNLPTYFHTSHEQQSPSTPYSLVEFQGGAFDPWGGVGFAKCAALLNHEFERVFYKNDFSFGVAFLNLYMIFGGTNWGNLGHPGGYTSYDYGSAISESRNITREKYSELKLLGNFAKVSPGYLVANPGDLSTSTYTNTADLTVTPLLGSNSSASSFFVIRHSDYSSQASVEYKLTVPTSAGNLTIPQLGGSLTLSGRDSKIHVTDYDVAGTNILYSTAEVFTWKKFNNEKVLVLYGGPGEHHEFAVSGASSSSVVEGSSSGISSKKVGKALVVAWDVSTARRIVQVGSLKVFLLDRNSAYNYWVPQVPTKGTAPGYSNQETTASSIIVKAGYLVRSAYLDGNDLHIQADFNATTPIEVVGAPSGAKNLVINGKKTQTKVDKNGIWSASVAYTAPKVQLPSLKSLKWKSVDTLPEAKNTYDDSAWTSADHAYTNNSAHSLQTPTSLFASDYGYHTGALLFRGHFTANGKEKTFFVQTKGGTAYGHSIWINETYVGSWAGTSINDNNNATYTLPTLQSGKNYVITVVIDNMGLDEDWTIGSEDMKNPRGIIQYSLSGQEASAISWKLTGNLGGENYRDTVRGPLNEGGLYAERQGFHQPQPPTQKWDSSSPFTGLTKPGIRFYSTSFDLDLPSGYDIPLYFNFGNSTSTPAAYRVQLYVNGYQYGKYVNNIGPQTSFPVPEGILNYHGTNWLALSLWAQEDNGAKLDSFELINTTPVLTSLGEVKSVNQPKYQARKGAY

SEQ ID NO: 25285 - protein, 495 aa, Penicillium sp. C7
MATRPLAFAAIAALIHQAASQQAPTPDNLASLPTWKCTTSGGCVQQSTSIVVDWVYHWIHTVNGSTSCTTSSGLDSTLCGTEEECYTNCEISPATYDGLGIKTSGNALTLNQYVTSNGTTSNASPRVYLLDPAGKNYEMLQLLGQEISFDVDASNLPCGENGALYLSEMDATGGRSQYNPAGASYGSGYCDAQCGSSSWFNGSINSAGLGSCCNEMDLWEANGEATALTPHPCSVDGPYGCSGSACGSTGVCDKNGCGFNPYALGDQSYYGPGLTVDTSKPFTVTTQFVTNDGTKTGTLTEIRRSYTQNGKVIANAVASASSGFSGQSSITESFCTAMDSEAGTLGGLTTMGEALGRGMVLIFSIWNDAGGYMNWLDSGSSGPCSSTAGIPSTIQANDPGTSVTFSNIKWGDIGSTGSGTGGSSSSSSSTSTSPKTTSTTTTSATTKTSATTTTTSTGATQTHYGQCGGMSYTGPTVCASPYTCQVQNPYYSQCL

SEQ ID NO: 25286 - protein, 379 aa, Penicillium sp. CGMCC 1669
MLLSTHSIVLGLLGSTSLALASPAAEPAEGNRLIPRGSACTYSGVNGAAAAIAGKAGCSSITLNNVAVPAGTTLDLTGLAAGTKVIFEGTTTFGHKQWVGPLISISGTNIAVSGAAGHVIDGQGARWWDGKGSNTKTNIKPKFFLAHNLKGASTITGLNIKDTPVQVFSIDSSSGLTISGVTIDNRNGDKGSLGHNTDGFDIGDSDHITITGATVYNQDDCLAINSGTNIIFSGGYCSGGHGLSIGSVGGRSNNVVDTVHISSTQVVNSQNGVRVKAVAGATGSIKGVTYQDITLSGITSQGVTIRQDYTNSGYTGNPTTQVPITGLTLNNVHGTVTSSGTDITVECGSAASCSGWTWTKVAVSGGKADLCKNAPANTC

SEQ ID NO: 25287 - protein, 367 aa, Penicillium sp. fj2; identical to SEQ ID NO: 25205

SEQ ID NO: 25288 - protein, 854 aa, Phanerochaete chrysosporium
ASPQAYTWKNVKIGGGGGFIPGIVFNPSQKGLAYARTDIGGAYKLNADDTWSPLLDFADDARWNYWGVDALATDPVDPNRLYLATGMYTNSWDPNNGQILISTDQGKTFTPSVLPFKVGGNMPGRGMGERLAVDPNSNNILFFGARSGNGLWKSTNFGQTWTKVSSLPNVGTYKPDPTDTTGLNSDEAGVSFVTFDSTSGTSGTATPRIFVGVGTNTASNLFMSNDAGATWSALPGTNSSWMPHKGVLSPAEKALYISTSDGTGPYDGTLGAVYKYDITAGTMTDITPVSGGDLYFGFGGLAVDLQKPGTVMVAALNCWWPDGNVFRTTDGGSTWTRLWDWAAYPTMNRYYTYDDSLAPWLGPEGTASSIVTQIGWMMEALAIDPFDSNHWLYGTGATIYGGHDLLKWDTTRNVTLKSLADGIEETSVQALLSPPVGPTLLSGVLDEEGFVHTDLTKAPSAEFQPSTASGITGLDYAGQNPKTIVRVGNGDASDGKQIAISNDSGNTWALDYGSPDGVSGGKVAISAAGDTVLWSSSGNGVQVSQYTNPFSAVSSLPAGAAIASDKVVNSIFYAGSGNQFYLSTDGGKTFAKQATLGTSSSVSTVIVHPAVTGDVWVSTDKGLFHSTNNGTSFSAISGVSQAWSISFGAPASTGGYPALFAIANIGGVGYFRSDDAGTNWVQINDAAHGFGSASANVIAGDPRIYGRVYVGTNGRGIFYGDTAGTAPPTTASASSTSAVHSSTSTTSSVHSTTSTTSSVRSSTSTTSSVRSSTSTSVSSHSTSASSTSSAPSSTASLQVAYGQCGGTGWTGPTACVGKLYTACACLSKTHGLFPRQLGLSAQTSILVSTGNLCL

SEQ ID NO: 25289 - protein, 290 aa, Phanerochaete chrysosporium
MVSFNSLLVAVSAATCALAFPFEFHNGTHVFPRQSTPAGTGTNNGYFYSFWTDGGGSVTYNNGPAGEYSVTWSNADNFVAGKGWNPGSAQAISFTANYQPNGNSYLSVYGWSTNPLVEYYILEDFGTYNPAVSLTHKGTLTSDGATYDVYEGTRVNEPSIQGTATFNQYWSIRSSKRSSGTVTTANHFAAWKQLGLPLGTFNYQIVATEGYQSSGSSTVTVNPAGGVTSPIAPTGPSSVSTTPSGPSSSPSPVGTCSALYGQCGGQGWTGPTCCSSGTCKFSNNWYSQCL

SEQ ID NO: 25290 - protein, 399 aa, Phanerochaete chrysosporium
MFKFSASLAALAALVPFVAAQSPEWGQCGGIGWTGPTTCVAGTTCVESNPYYSQCLPGAASVAPPPPSGTSSAGGSTPSSSAKLHTLAKAAGKLYFGTATDNNELTDTAYTAILDDNTMFGQITPANSMKWDATEPQQGVFTFSGGDQIATLAKTNGMLLRGHNCVWYNQLPSWVSSGSFTAAQLTSIIQNHCSTLVTHYKGQVYAWDVVNEPFNDDGTWRTDVFYNTLGTSYVQIALEAARAADPNAKLYINEYNIEFAGAKATSLLNLVKSLKAADVPLDGIGFQCHLIVGEFSGPGLQTQLSTFAAQGVEVAITELDIRMTLPSTPALLAQQQTDYNSVITACMNVESCIGVTVWDWTDKYSWVPNTFSGQGAACPWDQNFVKKPAFNGIAAGFSA

SEQ ID NO: 25291 - protein, 399 aa, Phanerochaete chrysosporium
MFKFSASLAALAALVPFVAAQSPEWGQCGGIGWTGPTTCVAGTTCVESNPYYSQCLPGAASVAPPPPSGTSSAGGSTPSSSAKLHTLAKAAGKLYFGTATDNNELTDTAYTAILDDNTMFGQITPANSMKWDATEPQQGVFTFSGGDQIATLAKTNGMLLRGHNCVWYNQLPSWVSSGSFTAAQLTSIIQNHCSTLVTHYKGQVYAWDVVNEPFNDDGTWRTDVFYNTLGTSYVQIALEAARAADPNAKLYINEYNIEFAGAKATSLLNLVKSLKAADVPLDGIGFQCHFIVGEFSGPGLQTQLSTFAAQGVEVAITELDIRMTLPSTPALLAQQQTDYNSVITACMNVESCIGVTVWDWTDKYSWVPNTFSGQGAACPWDQNFVKKPAFNGIAAGFSA

SEQ ID NO: 25292 - protein, 367 aa, Phanerochaete chrysosporium
MFKLAVALASLATLAAAQVPVWGQCGGIGHSGSTVCAAGNVCTEYSAYYSQCIPGTNSAPPPPASPPPTTTVSVPTTSSVTGTAPTGLSSIPASTLFQFSNFGTNPNGVTMYVYKPKNVQPKPALIVASHYCSGTAQAYYTGSKFAQLAETYGYVVIYPSSPHSGTCWDVSSDETLMHNGGSDSLSIANAARFAISNWGVDPNRVFAVGTSSGAMMTSVLAGAYPDIFKAGIVDSGVAFGCFAVPGQPDDSWNSQCSQGQMILTGQQWAQKVYNAYPGYTGARPKMQVWHGTIDTTLYPQNFWEEIKQWTTVFGYPSNPISNVTESYLPRGYSNATYGPNFQAILAQNVGHTVPLFEQQYLQFLGIA

SEQ ID NO: 25293 - protein, 439 aa, Phanerochaete chrysosporium
QASEWGQCGGIGWTGPTTCVSGTTCTVLNPYYSQCLPGSAVTTTSVITSHSSSVSSVSSHSGSSTSTSSPTGPTGTNPPPPSANNPWTGFQIFLSPYYANEVAAAAKQITDPTLSSKAASVANIPTFTWLDSVAKIPDLGTYLASASALGKSTGTKQLVQIVIYDLPDRDCAAKASNGEFSIANNGQANYENYIDQIVAQIQQFPDVRVVAVIEPDSLANLVTNLNVQKCANAKTTYLACVNYALTNLAKVGVYMYMDAGHAGWLGWPANLSPAAQLFTQVWQNAGKSPFIKGLATNVANYNALQAASPDPITQGNPNYDEIHYINALAPLLQQAGWDATFIVDQGRSGVQNIRQQWGDWCNIKGAGFGTRPTTNTGSQFIDSIVWVKPGGECDGTSNSSSPRYDSTCSLPDAAQPAPEAGTWFQAYFQTLVSAANPPL

SEQ ID NO: 25294 - protein, 32 aa, Phanerochaete chrysosporium
WGQCGGIGYTGPTVCASGFTCHVLNPYYSQCY

SEQ ID NO: 25295 - protein, 32 aa, Phanerochaete chrysosporium
WGQCGGQGYTGPTVCAAPYTCTVSNPYYSQCI

SEQ ID NO: 25296 - protein, 32 aa, Phanerochaete chrysosporium
WGQCGGQGWTGATVCASPFNCVVLNPYYSQCQ

SEQ ID NO: 25297 - protein, 823 aa, Phanerochaete chrysosporium
MGLTLVVLLHLALGLLTGVQAQSGLYQQCGGIGWTGATTCVSGATCTVLNPYYSQCLPGAATTSVSSSHSSSSSVSSHSSSASSSSISSTSTSPPAPSQTVANVSPEWAAAYVKAQAAVAKLSVTDMVNLATGVQWQKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGEVAFETITGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETLSSGTTYFGQNLVNAVNSGQVSQARVKDMATRILAAWYLLGQDQNFPAVNFNSWNSGQGQHVNVSGNHASLIRTIGAASQILLKNVNSALPLKKPKTIGIIGNGAGSNPNGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPASAKSAPQNLKGFDSVFLPAGASTTVSFELSRYSFSVWDVVSQSWQIPAGVTGISVGASSRDLRLKGSITN

SEQ ID NO: 25298 - protein, 516 aa, Phanerochaete chrysosporium
MFRTATLLAFTMAAMVFGQQVGTNTARSHPALTSQKCTKSGGCSNLNTKIVLDANWRWLHSTSGYTNCYTGNQWDATLCPDGKTCAANCALDGADYTGTYGITASGSSLKLQFVTGSNVGSRVYLMADDTHYQMFQLLNQEFTFDVDMSNLPCGLNGALYLSAMDADGGMAKYPTNKAGAKYGTGYCDSQCPRDIKFINGEANVEGWNATSANAGTGNYGTCCTEMDIWEANNDAAAYTPHPCTTNAQTRCSGSDCTRDTGLCDADGCDFNSFRMGDQTFLGKGLTVDTSKPFTVVTQFITNDGTSAGTLTEIRRLYVQNGKVIQNSSVKIPGIDPVNSITDNFCSQQKTAFGDTNYFAQHGGLKQVGEALRTGMVLALSIWDDYAANMLWLDSNYPTNKDPSTPGVARGTCATTSGVPAQIEAQSPNAYVVFSNIKFGDLNTTYTGTVSSSSVSSSHSSTSTSSSHSSSSTPPTQPTGVTVPQWGQCGGIGYTGSTTCASPYTCHVLNPYYSQCY

SEQ ID NO: 25299 - protein, 382 aa, Phanerochaete chrysosporium
MAFGSLLAFVALAAITRAAPTAESAVCPDGTRVTNAACCAFIPLAQDLQETLFQGDCGEDAHEVIRLTFHDAIAISQSLGPQAGGGADGSMLHFPTIEPNFSANSGIDDSVNNLLPFMQKHDTISAADLVQFAGAVALSNCPGAPRLEFMAGRPNTTIPAVEGLIPEPQDSVTKILQRFEDAGNFSPFEVVSLLASHTVARADKVDETIDAAPFDSTPFTFDTQVFLEVLLKGTGFPGSNNNTGEVMSPLPLGSGSDTGEMRLQSDFALARDERTACFWQSFVNEQEFMAASFKAAMAKLAILGHSRSSLIDCSDVVPVPKPAVNKPATFPATKGPKDLDTLTCKALKFPTLTSDPGATETLIPHCSNGGMSCPGVQFDGPA

SEQ ID NO: 25300 - protein, 380 aa, Phanerochaete chrysosporium
MAFASSLLALVALAAVTSAAPATTQATCPDGTKVNNAACCAFIPLAQDLQETIFQNDCGEDAHEVIRLTFHDAIAISQSKGPSAGGADGSMLLFPTIEPNFSANNGIDDSVNNLIPFMQKHNTISAGDIVQFTGAVALTNCPGAPQLEFLARRPNKTIPAIDGLIPEPQDSVTSILERFKDAGNFSPFEVVSLLASHSVARADKVDETIDAAPFDTTPFVFDTQIFLEVLLKGVGFPGTRTTRGEVASPLPLTSGSDTGELRLQSDFALARDERTACIWQGFVNEQALMASFKAAMRKLAVLGQHRNTLIDCSDVVPAPKPAVNKPASFPATTGPQDLELSCNTKPFPSLSVDAGAQQTLIPHCSDGDMTCQSVQFNGPA

SEQ ID NO: 25301 - protein, 773 aa, Phanerochaete chrysosporium
MLGRSLLALLPFVGLAFSQSASQFTDPTTGFQFTGITDPVHDVTYGFVFPPLATSGAQSTEFIGEVVAPIASKWIGIALGGAMNNDLLLVAWANGNQIVSSTRWATGYVQPTAYTGTATLTTLPETTINSTHWKWVFRCQGCTEWNNGGGIDVTSQGVLAWAFSNVAVDDPSDPQSTFSEHTDFGFFGIDYSTAHSANYQNYLNGDSGNPTTTSTKPTSTSSSVTTGPTVSATPYDYIIVGAGPGGIIAADRLSEAGKKVLLLERGGPSTKQTGGTYVAPWATSSGLTKFDIPGLFESLFTDSNPFWWCKDITVFAGCLVGGGTSVNGALYWYPNDGDFSSSVGWPSSWTNHAPYTSKLSSRLPSTDHPSTDGQRYLEQSFNVVSQLLKGQGYNQATINDNPNYKDHVFGYSAFDFLNGKRAGPVATYLQTALARPNFTFKTNVMVSNVVRNGSQILGVQTNDPTLGPNGFIPVTPKGRVILSAGAFGTSRILFQSGIGPTDMIQTVQSNPTAAAALPPQNQWINLPVGMNAQDNPSINLVFTHPSIDAYENWADVWSNPRPADAAQYLANQSGVFAGASPKLNFWRAYSGSDGFTRYAQGTVRPGAASVNSSLPYNASQIFTITVYLSTGIQSRGRIGIDAALRGTVLTPPWLVNPVDKTVLLQALHDVVSNIGSIPGLTMITPDVTQTLEEYVDAYDPATMNSNHWVSSTTIGSSPQSAVVDSNVKVFGTNNLFIVDAGIIPHLPTGNPQGTLMSAAEQAAAKILALAGGP

SEQ ID NO: 25302 - protein, 504 aa, Phanerochaete chrysosporium
MRTALALILALAAFSAVSAQQAGTITAETHPTLTIQQCTQSGGCAPLTTKVVLDVNWRWIHSTTGYTNCYSGNTWDAILCPDPVTCAANCALDGADYTGTFGILPSGTSVTLRPVDGLGLRLFLLADDSHYQMFQLLNKEFTFDVEMPNMRCGSSGAIHLTAMDADGGLAKYPGNQAGAKYGTGFCSAQCPKGVKFINGQANVEGWLGTTATTGTGFFGSCCTDIALWEANDNSASFAPHPCTTNSQTRCSGSDCTADSGLCDADGCNFNSFRMGNTTFFGAGMSVDTTKLFTVVTQFITSDNTSMGALVEIHRLYIQNGQVIQNSVVNIPGINPATSITDDLCAQENAAFGGTSSFAQHGGLAQVGEALRSGMVLALSIVNSAADTLWLDSNYPADADPSAPGVARGTCPQDSASIPEAPTPSVVFSNIKLGDIGTTFGAGSALFSGRSPPGPVPGSAPASSATATAPPFGSQCGGLGYAGPTGVCPSPYTCQALNIYYSQCI

SEQ ID NO: 25303 - protein, 460 aa, Phanerochaete chrysosporium
MKSTAFFAALVTLLPAYVAGQASEWGQCGGIGWTGPTTCVSGTTCTVLNPYYSQCLPGSAVTTTSVITSHSSSVSSVSSHSGSSTSTSSPTGPTGTNPPPPPSANNPWTGFQIFLSPYYANEVAAAAKQITDPTLSSKAASVANIPTFTWLDSVAKIPDLGTYLASASALGKSTGTKQLVQIVIYDLPDRDCAAKASNGEFSIANNGQANYENYIDQIVAQIQQFPDVRVVAVIEPDSLANLVTNLNVQKCANAKTTYLACVNYALTNLAKVGVYMYMDAGHAGWLGWPANLSPAAQLFTQVWQNAGKSPFIKGLATNVANYNALQAASPDPITQGNPNYDEIHYINALAPLLQQAGWDATFIVDQGRSGVQNIRQQWGDWCNIKGAGFGTRPTTNTGSQFIDSIVWVKPGGECDGTSNSSSPRYDSTCSLPDAAQPAPEAGTWFQAYFQTLVSAANPPL

SEQ ID NO: 25304 - protein, 378 aa, Phanerochaete chrysosporium
MAFKSLIAFVALAAAVRAAPTAVCPDGTRVSHAACCAFIPLAQDLQETIFQNECGEDAHEVIRLTFHDAIAISRSQGPKAGGGADGSMLLFPTVEPNFSANNGIDDSVNNLIPFMQKHNTISAADLVQFAGAVALSNCPGAPRLEFLAGRPNKTIAAVDGLIPEPQDSVTKILQRFEDAGGFTPFEVVSLLASHSVARADKVDQTIDAAPFDSTPFTFDTQVFLEVLLKGVGFPGSANNTGEVASPLPLGSGSDTGEMRLQSDFALAHDPRTACIWQGFVNEQAFMAASFRAAMSKLAVLGHNRNSLIDCSDVVPVPKPATGQPAMFPASTGPQDLELSCPSERFPTLTTQPGASQSLIAHCPDGSMSCPGVQFNGPA

SEQ ID NO: 25305 - protein, 511 aa, Phanerochaete chrysosporium
MFRAAALLAFTCLAMVSGQQAGTNTAENHPQLQSQQCTTSGGCKPLSTKVVLDSNWRWVHSTSGYTNCYTGNEWNTSLCPDGKTCAANCALDGADYSGTYGITSTGTALTLKFVTGSNVGSRVYLMADDTHYQLLKLLNQEFTFDVDMSNLPCGLNGALYLSAMDADGGMSKYPGNKAGAKYGTGYCDSQCPKDIKFINGEANVGNWTETGSNTGTGSYGTCCSEMDIWEANNDAAAFTPHPCTTTGQTRCSGDDCARNTGLCDHGDGCDFNSFRMGDKTFLGKGMTVDTSKPFTDVTQFLTNDNTSTGTLSEIRRIYIQNGKVIQNSVANIPGVDPVNSITDNFCAQQKTAFGDTNWFAQKGGLKQMGEALGNGMVLALSIWDDHAANMLWLDSDYPTDKDPSAPGVARGTCATTSGVPSDVESQVPNSQVVFSNIKFGDIGSTFSGTSSPNPPGGSTTSSPVTTSPTPPPTGPTVPQWGQCGGIGYSGSTTCASPYTCHVLNPYYSQCY

SEQ ID NO: 25306 - protein, 455 aa, Phanerochaete chrysosporium
MLRASLLAAICAAGLPAWAAVPMWGQCGGMTYTGDTVCATGTTCVYLNEWFSQCILDAPTSTLPSTSSRPTSVASSSVAASSTASASSPSSTGFVTVSGQKFMLDGEEFTVVGENAYWIGLFDYGVADVDKAYQDIVNAGSTVVRTLGFNDVTPADIAEYPVYYQSWSNGTGTINLGPNGLQNFDQVVARAKAHGLRLLVTLTNNWSDYGGMDVYVQQILGSTYHDLFYTDPQVIAAFKKYINGFVSRYVDEPTILAWELANEPRCAGSTGVTTGNCTNPTITQWIAEISAYIKSIDPNHLVGVGDEGFINDPGNPSYPYQYVEGTLGIDFEANLQIPTIDFGTFHMYPESWGQTNDPSAVGWGNQWITDHAAMGRSAGKPVIMEEFGVTIADQALTYAEWYDTVISTGLAGDLIWQAGSHLSGGDTPNDGYAEYPDGDVYPIIQQHAAALKARG

SEQ ID NO: 25307 - protein, 460 aa, Phanerochaete chrysosporium
MLKIGFLALAFALSPLAQAQTTVSAWGQCGGINYTGSTTCASGSACVYLNDYYYQCIPGATASTPAHSSTITSVSSHTVSSTSSSVVSSSTPSSPPPPSSFGFVTTSGQKFMLNGQEFTVVGENSYWVGLMGYSTANINKAVQDIANAGSTVVRTWGFNEVTPSTQQNYPIYYQSWSGATPTVNTGANGLQNFDQIVASAKANGLRLIVALTNNWSDYGGMDVYVKQILGSANHDLFYTNAQVIAAFKNYVKTFVGRYVNEPTIMAWELSNEPRCAGSTGTTTGTCTTATVTNWISEISAYIKSIDPNHLVAVGDEGFFNEPGNPSYPYQGGEGIDFNVNLNISTIDFGTFHLYPESWGQSSNPSSSVWGSQWISDHATSQKSANKPVIMEEFGVTSDQTDVYKAWFSTVLSSGLSGDLIWQAGSHLSTGDTPQDGYAEYPDGVVYPIIQQHAAALKARG

SEQ ID NO: 25308 - protein, 277 aa, Phanerochaete chrysosporium
MAFTKSLLTILTAAGLALAQSSSQFCDSSSGICFQGYTDPDFDVTVGFVLPPISTPPSDEFIVQLVAPVSNGYTGISVGGTMADSLLFTLWPYNNELILGPRWTSGYVLPTAYAGPQITLLPSSSINSTHIKATFRCQNCTIWEGGSLGSGDLTSFQVVAYVVATTTKPSDPADVDSVIQEHDDFNFFGLDLSMAHSDSYSSYIGGSVTTSAPTSTTTHPTSTSHSSTVISTTSSAPSATQTEWGQCGGTGFTGPTVCASGLTCVAVSPPYYYQCQA

SEQ ID NO: 25309 - protein, 386 aa, Phanerochaete chrysosporium
MLKYASIALALATLGVAQQQQWGQCGGIGWTGATTCVAGSVCSVLNPYYSQCIPGAATVTSSSAPSTPTPPAGALPRLGGVNTAGYDFSVATDGSFTGTGVSPPVSQFSHFSSQGANLYRIPFAWQLMTPTLGGTISQSFLSRYDQTVQAALNSGPNVFVIIDLHNYARWNGGIIAQGGPTDAQFQSIWTQLAQKYGSNQRVIFGIMNEPHDIPSISTWVNSVQGAVNAIRAAGATNYLLLPGSSWSSAQAFPTEAGPLLVKVTDPLGGTSKLIFDVHKYLDSDNSGTHPDCTTDNVQVLQTLVQFLQANGNRQAILSETGGGNTSSCESLLANELAYVKSAYPTLAGFSVWAAGAFDTTYVLTVTPNADGSDQPLWVDAVKPNLP

SEQ ID NO: 25310 - protein, 277 aa, Phanerochaete chrysosporium
MAFTKSLLTILTAAGLALAQSSTQFCDSSSGICFQGYTDPDFDVTVGFVLPPISTPPSDEFIVQLVAPVSNGYTGISVGGTMADSLLFTLWPYNNELILGPRWTSGYVLPTAYAGPQITLLPSSSINSTHIKATFRCQNCTIWEGGSLGSGDLTSFQVVAYVVATTTKPSDPADVDSVIQEHDDFNFFGLDLSMAHSDSYSSYIGGSVTTSAPASTTTHPTSTSHSSTVISTTSSAPSATQTEWGQCGGTGFTGPTVCASGLTCVAVSPPYYYQCQV

SEQ ID NO: 25311 - protein, 621 aa, Phanerochaete chrysosporium [sequence omitted]

SEQ ID NO: 25312 - protein, 540 aa, Phanerochaete chrysosporium
MFRAAALLAFTCLAMVSGQQAGTNTAENHPQLQSQQCTTSGGCKPLSTKVVLDSNWRWVHSTSGYTNCYTGNEWDTSLCPDGKTCAANCALDGADYSGTYGITSTGTALTLKFVTGSNVGSRVYLMADDTHYQLLKLLNQEFTFDVDMSNLPCGLNGALYLSAMDADGGMSKYPGNKAGAKYGTGYCDSQCPKDIKFINGEANVGNWTETGSNTGTGSYGTCCSEMDIWEANNDAAAFTPHPCTTTGQTRCSGDDCARNTGLCDGDGCDFNSFRMGDKTFLGKGMTVDTSKPFTVVTQFLTNDNTSTGTLSEIRRIYIQNGKVIQNSVANIPGVDPVNSITDNFCAQQKTAFGDTNWFAQKGGLKQMGEALGNGMVLALSIWDDHAANMLWLDSDYPTDKDPSAPGVARGTCATTSGVPSDVESQVPNSQVVFSNIKFGDIGSTFSGTSSPNPPGGSTTSSPVTTSPTPPPTGPTVPQWGQCGGIGYSGSTTCASPYTCHVLNPCESILSLQRSSNADQYLQTTRSATKRRLDTALQPRK

SEQ ID NO: 25313 - protein, 510 aa, Phanerochaete chrysosporium
MFRAAALLAFTCLAMVSGQQAGTNTAENHPQLQSQQCTTSGGCKPLSTKVVLDSNWRWVHSTSGYTNCYTGNEWDTSLCPDGKTCAANCALDGADYSGTYGITSTGTALTLKFVTGSNVGSRVYLMADDTHYQLLKLLNQEFTFDVDMSNLPCGLNGALYLSAMDADGGMSKYPGNKAGAKYGTGYCDSQCPKDIKFINGEANVGNWTETGSNTGTGSYGTCCSEMDIWEANNDAAAFTPHPCTTTGQTRCSGDDCARNTGLCDGDGCDFNSFRMGDKTFLGKGMTVDTSKPFTVVTQFLTNDNTSTGTLSEIRRIYIQNGKVIQNSVANIPGVDPVNSITDNFCAQQKTAFGDTNWFAQKGGLKQMGEALGNGMVLALSIWDDHAANMLWLDSDYPTDKDPSAPGVARGTCATTSGVPSDVESQVPNSQVVFSNIKFGDIGSTFSGTSSPNPPGGSTTSSPVTTSPTPPPTGPTVPQWGQCGGIGYSGSTTCASPYTCHVLNPYYSQCY

SEQ ID NO: 25314 - protein, 329 aa, Phanerochaete chrysosporium
MTPLKLQAASLVLLAASLRSVEGHGQVHSVITNYATYPAADAYQAVDPTSPLRKLNTYGPANFTSPENTCGPGGNTPVTPMAKADAGSLVTFDWQDWNSVHPGPVMTYIAECTGGCANFKGDTGNVWVKIDQDGYNPSRGDLAWGEEVIRLEGSKYSVTIPAGLKPGQYLLRHEILGLHVASQANGAQFYPNCLQVEIVNGGNVELPEGIPLPGSYDPYDPGILVQLYKITPTTPNYTIPGGPVLLPGGSGDWAQDVFGTGSVSSSAPAPPPTSFSTSTPLSTISSAPTSSVVLVAKYGQCGGLTYTGPTTCVSGTTCTALNDYYSQCL

SEQ ID NO: 25315 - protein, 802 aa, Phanerochaete chrysosporium
QSGLYQQCGGIGWTGATTCVSGATCTVLNPYYSQCLPGAATTSVSSSHSSSSSVSSHSSSASSSSISSTSTSPPAPSQTVANVSPEWAAAYVKAQAAVAKLSVTDMVNLATGVQWEKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGELAFETITGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETTNSGTTYFGQNLVNAVNSGQVSQARIKDMATRILAAWYLLGQDQNFPAVNFNSWNSGQGQHVNVSGNHASLIRTIGAASQILLKNVNGALPLKKPKTIGIIGNGAGSNPSGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPTSAKSAPQNLKGFDSGFLPAGASTTVSFELSRYSFSVWDVVSQSWQIPAGVTGISVGASSRDLRLKGSITN

SEQ ID NO: 25316 - protein, 290 aa, Phanerochaete chrysosporium
MVSFNSLLVAVSAATCALAFPFEFHNGTHVFPRQSTPAGTGTNNGYFYSFWTDGGGSVTYNNGPAGEYSVTWSNADNFVAGKGWNPGSAQAISFTANYQPNGNSYLSVYGWSTNPLVEYYILEDFGTYNPAVSLTHKGTLTSDGATYDVYEGTRVNEPSIQGTATFNQYWSIRSSKRSSGTVTTANHFAAWKQLGLPLGTFNYQIVATEGYQSSGSSTVTVNPAGGVTSPTAPTGPSSVSTTPSGPSSSPSPVGSCAALYGQCGGQGWTGPTCCSSGTCKFSNNWYSQCL

SEQ ID NO: 25317 - protein, 290 aa, Phanerochaete chrysosporium
MVSFNSLLVAVSAATCALAFPFEFHNGTHVFPRQSTPAGTGTNNGYFYSFWTDGGGSVTYNNGPAGEYSVTWSNADNFVAGKGWNPGSAQAISFTANYQPNGNSYLSVYGWSTNPLVEYYILEDFGTYNPAVSLTHKGTLTSDGATYDVYEGTRVNEPSIQGTATFNQYWSIRSSKRSSGTVTTANHFAAWKQLGLPLGTFNYQIVATEGYQSSGSSTVTVNPAGGVTSPTAPTGPSSVSTTPSGPSSSPSPVGSCAALYGQCGGQGWTGPTCCSSGTCKFSNDWYSQCL

SEQ ID NO: 25318 - protein, 408 aa, Phanerochaete chrysosporium
MKLSASFAALALLLPFVQAQSPVWGQCGGIGWTGPTTCTAGNVCQEYSAYYSQCIPASQATSVTSVSTAPNPPPTSHTSTSSAPSGASTSTAKLNTLAKAKGKLYFGTATDNGELSDTAYTAILDDNTMFGQITPANSMKWDATEPQQGQFTFSGGDQIANLAKSNGMLLRGHNCVWYNQLPSWVSNGKFTAAQLTSIIQNHCSTLVTHYKGQVYAWDVVNEPFNDDGSWRTDVFYNTLGTSYVQIALEAARAADPDAKLYINEYNIEYAGAKATSLLNLVKTLKAASVPLDGIGFQSHFIVGQVPTGLQSQLTTFAAQGVEVAITELDIRMTLPSTPALLAQQKTDYSNVIKACASVEACVGVTVWDWTDKYSWVPNTFSGQGAACPWDQNFVRKPAYDGIAIGFGN

SEQ ID NO: 25319 - protein, 408 aa, Phanerochaete chrysosporium
MKLSASFAALAVLLPFVQAQSPVWGQCGGIGWTGPTTCTAGNVCQEYSAYYSQCIPASQATSVTSVSTAPNPPPTSHTSTSSAPSGASTSTAKLNTLAKAKGKLYFGTATDNGELSDTAYTAILDDNTMFGQITPANSMKWDATEPQQGQFTFSGGDQIANLAKSNGMLLRGHNCVWYNQLPSWVSNGKFTAAQLTSIIQNHCSTLVTHYKGQVYAWDVVNEPFNDDGSWRTDVFYNTLGTSYVQIALEAARAADPDAKLYINEYNIEYAGAKATSLLNLVKTLKAASVPLDGIGFQSHFIVGQVPTGLQSQLTTFAAQGVEVAITELDIRMTLPSTPALLAQQKTDYSNVIKACASVEACVGVTVWDWTDKYSWVPNTFSGQGAACPWDQNFVRKPAYDGIAIGFGN

SEQ ID NO: 25320 - protein, 20 aa, Phanerochaete chrysosporium
  MOD_RES (3)..(3): Any amino acid
  MOD_RES (8)..(8): Any amino acid
  MOD_RES (11)..(11): Any amino acid
  MOD_RES (14)..(16): Any amino acid
AVXHPGTXVSXAAXXXFIPL

SEQ ID NO: 25321 - protein, 823 aa, Phanerochaete chrysosporium
MGLTLVVLLHLALGLLTGVQAQSGLYQQCGGIGWTGATTCVSGATCTVLNPYYSQCLPGAATTSVSSSHSSSSSVSSHSSSESSSSISSTSTSPPAPSQTVANVSPEWAAAYVKAQAAVAKLSVTDMVNLATGVQWQKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGEVAFETISGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETLSSGTTYFGQNLVNAVNSGQVSQARVKDMATRILAAWYLLGQDQNFPAVNFNSWNSGQGQHVNVSGNHASLIRTIGAASQILLKNANGALPLKKPKTIGIIGNGAGSNPNGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPASAKSAPQNLKGFDSVFLPAGASTTVSFELSRYSFSVWDVVSQSWQIPAGVTGISVGASSRDLRLKGSITN

SEQ ID NO: 25322 - protein, 295 aa, Pichia pastoris
  strain ATCC 76273 / CBS 7435 / CECT 11047 / NRRL Y-11430 / Wegner 21-1
MRLLHISLLSIISVLTKANAECCYTNTHTTTEVWYTTVYARDVSEETSSTLAGGSATVSSEVSSTIESSVATSATTESSSETSGSTSGSTSATESSTGSSSLATSSSITSSESSTITQTTGQESTSPTPSSSETGSSTTTPYDISPTASSDFDAFKYQILDEHNIKRALHGVDGLEWDEEVYAAAQAYADAYTCDGTLVHSGNSLYGENLAYGYSTRGTVDAWYSEIEYYDFNNPGYTPGVGHFTQVVWKSTTKLGCAFKYCNDYYGAYVVCNYSPPGNYVNEGYFEANVLPLVD

SEQ ID NO: 25323 - protein, 1618 aa, Pichia pastoris
  strain ATCC 76273 / CBS 7435 / CECT 11047 / NRRL Y-11430 / Wegner 21-1
MLSLTKLFIGIILGAFVAAEQSDVEPACYARQWENTFPPSNIYVSSATWVRDNVYDVTLRYEAESLHLRSLGELKVIGLNSPVSGTKVVYSRNSKIYEINDPSSWSTTIRVNAKDSADGCHVEMYPFQIQVEWCQAGADTDECSSWPYPSVYDYDIGCDNMQDGVSRKHHAVYRWLKHSVSGCSAASTVAAISSQTTSSSQTSTSSQSSSSTAISSVTTQTTQTTTSGVPIWGQCGGNGHSGSTSCAEGVCVYVNDWYYQCQPGASTTTTSQASSSQVFSQLTTTEESISSEESIGLTSTVETTSSAEVVESTTSGNQAIPTIEFDVEIEFPAAEITEEETTETEEQVPLHGKCGGIGHTGSTTCANGICTYVNDWYYECLPREAESEEEVPLYGQCGGINYSGATKCAEGVCTYVNDWYYQCLIGPATGTPQSTSSTDSQSVSESSAAEDSTPTEEAEESAEESTSTEDAEESTEDFATTEEVEESTSTEDAEESTSTEEAEESTSTEDAEESTSTEEAEESTEESTSTDEVEESTSTEEVEESTEESTSTDEVEESTSTEEVEESTEESTSTEDAEESTSTEEAEESTEESTSTDEVDESTSTEEAEESTEESTSTDEVEESTSTEEVEESIEESTSTEEPEESTEELTSTEEAEESTSTDEVDESTEESTSTEEAEESTEESTSTDEVEESTSTEEVEESTEESTSTEDAEESTSTEEAEESTEESTSTDEVEESTSTEEVEESTEESTSTEDAEESTSTEEAEESTEESTSTDEVEESTSTEEVEESTEESTSTDEVEESTSTEEVEESTEESTSTDEVEESTSTEEVEESTEESTSTEDAEESTSTEEAEESTEESTSTDEVDESTSTEEAEESTEESTSTEDAEESTSTEEAEESTEESTSTEETEESTEELTSTEEAEESTEEPTSTDEVDESTSTDDVDESTSTEGTEQFSSTDVPQGRPGFENPTEEVESSSTEEFEEPTSTDETDESTEEATSTEEAEESISTDDVEQSTSVEEAEESTEESTSTEALEESTSTGDFENISAVDEELEESTEESTSTEEVEESTSTEDAEESTSTEEAEESTEESTSTEDAEESTSTEEAEESTEESTSTEDAEESTSSDEVEESTSTEEVEESTEESTSTEDAEESTSTEEAEESTEESTSTEDAEESTSTEDAEESTSTEYVEESTSIPSSTSEPSLSTSISPSSSSSFETATVTTDVSTTVLTTTDCGEQTCYKSLIITGVTEKTITTSGRTTVITTYCPLPTETVIPTPVVVTSTIYADETITETTCYVTGAIEKTVTVGGSPTVVTVHTTLPIEAIKPTPVTVTSTIYADETVTKTTCYETGAIEKTYTIGGSSTIVTIHTPLSTVQPTPVTVTSTIYADETVTKTTCYVTGAIEKTYTVGGSASVATVYTPLPTEPSKTSIVTLTSVISNSGSHPLTTSIVTGAVEKTITVDGTASIVTVHTPIASVYSSAHEHSKVTKAITPSTTTIIRDVCDSHSCTQATIETGVVSKTITIGQSVTTVVPSYVPLEHEQQEVHTTAATPVDSSVHSQSGSPVPPAITTQSYSAQASSVPVASYYEGSANNLVFSVASGVAALIVNALFL

SEQ ID NO: 25324 - protein, 365 aa, Pichia pastoris
  strain ATCC 76273 / CBS 7435 / CECT 11047 / NRRL Y-11430 / Wegner 21-1
MDIEDENHAKNISQWLEDNALSADSEYKQMSSDLEDSTMRFHNNQDQNEPGQEEAYGKMQQEAYNAHAAQIDDFIDIEGLEGGDNNALAYNDMLPTTSDLNFTPLLSPNASSILTPSLPSQTYSFTPLTSPMIDAIPNLRTKRTSVESDHKYTGHKDSLRSSRGTDIPPPMKKTKTPSSTPAFGPVTSRRSSPLLQPKKGSNNTTPVLISNNNSSFNQDFALPESSLPGPVTPLDLMGFKVQKQQSEDKGKSKSADKKATHKLAEQGRRNRMNNAIQELDAILPLEMRKYVTTPSKATTVELACQYIQSLLERIGELEKPPQSSPNDKTTNDSTLPANASPEDQADNNYNPANDTDSISPLEFEK

SEQ ID NO: 25325 - protein, 264 aa, Pichia pastoris
  strain ATCC 76273 / CBS 7435 / CECT 11047 / NRRL Y-11430 / Wegner 21-1
MFWLLVLSLISQALAVVEFTSPEGGETFSVSGSTVTIPIEFKDDESFPSIADASNLVISLCTGPNGDISCSEIETTPPADLLSGSTYEYDASVLATFGRSGSYYLQIYSKYSGGYAIVYSDRFSLQSMTGTLTPSGSGSPPANDISMSNAQNAEISKSFTVPYTLQTGRTRYAPMQTQPSGTVSATGWTRRYPTSSVSYYSTLVPSPAVYSTITPGWDYSYTSAVNFATPAPYPSQNGGWYAASRRISRPFIQATTALQRRWAY

SEQ ID NO: 25326 - protein, 629 aa, Pichia pastoris
  strain ATCC 76273 / CBS 7435 / CECT 11047 / NRRL Y-11430 / Wegner 21-1
MNEIRVVVCGDEGVGKSSLITSLLKEKFVENIQHLLPPVSIPRDYSSSPYTPDITILVDTDSSDIATLQKEIRQADVIWLVYSDNYSYERISLYWLNMFRSLGVNLPVVLCNNKCDLENSGPEEREQAIIDEMIPILKEFKEVESCIRCSAKLNYNVVQASYLCQRAVTYPISPLYDYKEGELKSQAILALKRVFYLSDKDHDEVLNDHELEVLQTKCFHKTIDINELQKIKSTVEGICAVGTFHGLTEEGFLALCKYYAQTGRHETIWGILRTFHYTDSLSLSDKVLYPRLDVNVHSSVELSPIGYEFLVNLFVLSDTDNDGGLSDQELDNLFKPTPGIPELWKDSNFPRTVVCNEQGYVTLQGWLAQWCMTTFLDYKVTLAYLGYLGFESPRGSVAALRVTKPRKTRTKDGKSYRCATNDRTVFNCFVLGAPKSGKTSLLEAFLERNFHETYSPTIKPRMVVNSVEVKGGKQCYLILEELGELTPAVLENQTRLNQCDILCYTYDSADPDSFQELVDLREKYPKLDELPVVFVALKADLDRQQQRCKHQPDSYTKSLLIQPPLHISFSWGSSLNELFIQLVETAVNPKLSTPGIEQDQENDSINSIAIVASVISGVILASIWYYRGK

SEQ ID NO: 25327 - protein, 593 aa, Pichia pastoris
  strain ATCC 76273 / CBS 7435 / CECT 11047 / NRRL Y-11430 / Wegner 21-1
MTVEIYVKNPRVYLGLDEFDGVSDGDKELEKLASLRERRKLVLPDPNNIVGHEELINWLTEAEFSTIDELNKVSHSENDRYINQILWLRYLSVKGKQDQYDVKIVDTFGITFPKANETNYTFELLLQEIARLRLKEDKELYTLLYEYSTKTFQSIPILSSLIDILLRGENNTNELIRTFKVYESIITEYEQVHGLNSSPYVVLFLEKLASLTSRLIKEEGSHELILNFIKTLKLKFEDFTEKFQVPFKFYALDSIHIDPIFCDPVFVSRISPVISSLIQSCEYLCQNSLDAPDLKKNLEQSVKFHHFFIQLNPKLPVSLGLVKTLVKLNQIQSATKIMKKTLQTDATNFKYINFMIVLLVASREYSTATKLINSTLLYIEQDSELSKAENDDIINLKILEILVIEKIHSPQVALNYLNDLFETYHKFYGQPGNASPLLDKIWLLASVLYENNKLYDEASNCLNEMAKPDLSRKAWLNIAQNKYQEAHDQIESVLTPIPSSFSPQARFSAILGLSHLAYNHPETFKSQKDIKSVQARCHTNLQRLRSDYTFSNHHHVYHFLSLSYEKLGDQVSLQEVLSYTVNLPDIILDLDEL

SEQ ID NO: 25328 - protein, 314 aa, Pichia pastoris
  strain ATCC 76273 / CBS 7435 / CECT 11047 / NRRL Y-11430 / Wegner 21-1
MDEDDEYLYGSDDEQPQQIGAPETKTASSEKSSTAVKTETGPVSDDEDDNDNSDYSDSDSDIDIVIGALEPSTQPAASTTASSAVPEDNPGENDDAATQVPSAAGKLRIATGSLDVDKVGEYDGKPITQLELQDLKEKPWRLPGSDLADYFNYGFDEFSWSYYCSKQDKTRKEFNPAKLMNELLPAGGFPPSGMPPMPGMPGMPPMPGFMPGMPGMPPMQGMQGMQGMPPMQGMPSMPSMPSMPGMPPMFNNNPANGSSSSSAQQQQAPKRPVNERDSADRERERNRERDRERDAYRDRDRDRDRDRDRRRRRN

SEQ ID NO: 25329 - protein, 313 aa, Pichia pastoris
  strain ATCC 76273 / CBS 7435 / CECT 11047 / NRRL Y-11430 / Wegner 21-1
MKLSTNLILAIAAASAVVSAAPVAPAEEAANHLHKRAYYTDTTKTHTFTEVVTVYRTLKPGESIPTDSPSHGGKSTKKGKGSTTHSGAPGATSGAPTDDTTSTSGSVGLPTSATSVTSSTSSASTTSSGTSATSTGTGTSTSTSTGTGTGTTGTGTTSSSTSSSATSTPTGSIDAISQTLLDTHNDKRALHGVPDLTWSTELADYAQGYADSYTCGSSLEHTGGPYGENLASGYSPAGSVEAWYNEISDYDFSNPGYSAGTGHFTQVVWKSTTQLGCGYKECSTDRYYIICEYAPRGNIVSAGYFEDNVLPPV

SEQ ID NO: 25330 - protein, 614 aa, Pichia pastoris
  strain ATCC 76273 / CBS 7435 / CECT 11047 / NRRL Y-11430 / Wegner 21-1
MSTLTLLAVLLSLQNSALAAQAETASLYHQCGGANWEGATQCISGAYCQSQNPYYYQCVATSWGYYTNTSISSTATLPSSSTTVSPTSSVVPTGLVSPLYGQCGGQNWNGATSCAQGSYCKYMNNYYFQCVPEADGNPAEISTFSENGEIIVTAIEAPTWAQCGGHGYYGPTKCQVGTSCRELNAWYYQCIPDDHTDASTTTLDPTSSFVSTTSLSTLPASSETTIVTPTSIAAEQVPLWGQCGGIGYTGSTICEQGSCVYLNDWYYQCLISDQGTASTTSATTSITSFNVSSSSETTVIAPTSISTEDVPLWGQCGGIGYTGSTTCSQGSCVYLNDWYFQCLPEEETTSSTSSSSSSSSSSTSSASSTSSTSSTSSTSSTSSSTSSSSIPTSTSSSGDFETIPNGFSGTGRTTRYWDCCKPSCSWPGKSNSVTGPVRSCGVSGNVLDANAQSGCIGGEAFTCDEQQPWSINDDLAYGFAAASLAGGSEDSSCCTCMKLTFTSSSIAGKTMIVQLTNTGADLGSNHFDIALPGGGLGIFTEGCSSQFGSGYQWGNQYGGISSLAECDGLPSELQPGCQFRFGWFENADNPSVEFEQVSCPPEITSITGCARTDE

SEQ ID NO: 25331 - protein, 416 aa, Pichia pastoris
  strain ATCC 76273 / CBS 7435 / CECT 11047 / NRRL Y-11430 / Wegner 21-1
MFKKLLPLVLLKAKVFADDTDWHASPVTFRIVNIRPEPPYNGTGTRVGYWSVQDGVIVDTGLAIEFFLNDTVLQGNGSNSKLEVTSPGGRLTFNEENEGTTGFSIVLNDSAELLLNGAAPTVWICQSGDTSEIHIYDESPGDDCEQYHVALESEQFSSIPEDPCDNPEYADECDDAGGSGGGSSGGNDGGSGGGSGGGSGGGSGGGSGGGSGGGSGGGSGGGSGGGSGGGSGGGSGGGSGGGSGGGSGGGSGGGSGGGSGGGNDGGSGGGNDGGNDGGSGGGSGGGSGGGSGGGSGGGSGGGSGGGNDGGSGGGNDGGNDGGSGGGSGGSSGGGDDEDDTSTTTSGSTTSSPATSPTTSTTSATGTSTPTSAPGTTTSAPTTTSSPEATNAGGAVNLVGPNGLSGLIGGVAIALLI

SEQ ID NO: 25332 - protein, 333 aa, Pichia pastoris
  strain ATCC 76273 / CBS 7435 / CECT 11047 / NRRL Y-11430 / Wegner 21-1
MFKTLLLPLVLWEARVLAENEDELGIPFHIVNTLPEDEYYNSTASRYIDTLWGTQANAIAVAGYYYEQLIIQEVLFTLTTDGILQGNDSDSKVEVTSPGGRLTYREENEGTPGFSLDLNDPPALLLDGATPTIWICPSGNTPEVHIYDESPGDDCLEYLVSVQPLEPGTIDPPGDGDDGPGDGDDGPGDGDDGPGDGDGDDGPGDGDDGPGDGDDSPGDGDDGPGGGSGGGSGGGSGGGSGGGSGDGSGGGDDEDDTTTTTSSSTTSSPATSPTTSTTSATGTSTPTSTPGTTTSAPTTTSSPEATNAGGAANLVGPNGLPGLIGGVAIALLI

SEQ ID NO: 25333 - protein, 445 aa, Pichia pastoris
  strain GS115 / ATCC 20864
MLEYMEYLEQCFAKNSQWDYNNLYEHVLDSSASILQFKIPHGFKFSVSSSSSPYNYNSISFENRGKGRLNGSLAYFYTTQELSNYKTSKNIPLQDVIDSYRLVNIPKNDRSYTDNEESKRPWLLYGRMYLPSQSMEAMAIKRLTANTQLMLKGVNILNPTPTPFNNKLTSLSFYLQSNYYKWSREAIFLSSDALFGLRFLYNFGNSTNPQCTPSIDSNNISTLSLGTELWYGAMNMTPGLSTTLRYTSFSVTGNPLTFTLACNPILGSVSTTYSIKTNVFTTLCSKFDFNFYSYESDLTIGCDLWRFGNNEDVPDSNPTPLPSKERELFIPLHDHQLVFPEQEKAKTISNEPKDYESDLLLKFLEIQGIKTARQSVATINNFTQKIKNAPFTSALKLNTSLKNHTVNLMWEGKYNDFLLSTGCSLNLDLKRPNVDGFGLQIQYSS

SEQ ID NO: 25334 - protein, 295 aa, Pichia pastoris; identical to SEQ ID NO: 25322
  strain GS115 / ATCC 20864

SEQ ID NO: 25335 - protein, 341 aa, Pichia pastoris
  strain GS115 / ATCC 20864
MNTLLLLHPTIVTEPQAVEAAKDSLAQKLGTDKSNISQHIIDRVATGQVSLRPSYYNHIQYLAPPEANVKKLPVKCYEIIFEALQSNGVFEGTIPPESATDGILQGFLVESDTKWVKPSTLGSVVSLKRPAGQNKTKSSAFKKEMPFFKKLSSPPTLTDSSEADEDEESQLNEKLKGSKLIYFDESSDDEIIDEDELLRDDDGALKGPVVVPVKCALPNGKRRKKACKDCTCGLKELEENEQNERLDAQASILSKLATSANAEAEKIEERLRRKQASKEGEEVKFTEQEVTEIDFTIQGKTGGCGSCALGDAFRCDGCPYLGLPPFKPGQAISIEGLGADI

SEQ ID NO: 25336 - protein, 489 aa, Pichia pastoris
  strain GS115 / ATCC 20864
MSFNINWDSIQKESLSAWTAELLNDALNSGKRPNVLCTDIQIEDLSFGTIPPDFEILEIGDLSSDSFRGIFKFNYDGDASITLRTKVQANPLKIYEDNLLDQFEDDQRELGEFIKPRFVMATDILEIPLNLKLSQIKLSSIIIIVFSRSKGLTLVFKNDPLESISVSSTFDRIKPLARFLQNKIETQISELFKEFLPSVLYKFSQKYTTENFADFHRELLHTQHPERNTENRVTLQDIDPEAPLIISPGSLMRLTTLSSSRQTLTLGGKISADKLNPDIITKNYFNELIPKTYNKFQLKADKVADIAQNIHSIKNLQSRIFWKNSKNNDKPHRRVVCLGDKDKSKEKCKQVESESLYRRSVYSQGSIFNDGASDVSTLTESTEVEQEAPNTEFPKLQAVDLKPDMSVETIIQNSSQEKHRKVKPIDDIGLIGRRKERLRELLKYDVVDFSMPPMPGSPTKFFNTNIFHDSNHINNGNLPIRVAPPPYQC

SEQ ID NO: 25337 - protein, 1416 aa, Pichia pastoris
  strain GS115 / ATCC 20864
MLSLTKLFIGIILGAFVAAEQSDVEPACYARQWENTFPPSNIYVSSATWVRDNVYDVTLRYEAESLHLRSLGELKVIGLNSPVSGTKVVYSRNSKIYEINDPSSWSTTIRVNAKDSADGCHVEMYPFQIQVEWCQAGADTDECSSWPYPSVYDYDIGCDNMQDGVSRKHHAVYRWLKHSVSGCSAASTVAAISSQTTSSSQTSTSSQSSSSTAISSVTTQTTQTTTSGVPIWGQCGGNGHSGSTSCAEGVCVYVNDWYYQCQPGASTTTTSQASSSQVFSQLTTTEESISSEESIGLTSTVETTSSAEVVESTTSGNQAIPTIEFDVEIEFPAAEITEEETTETEEQVPLHGKCGGIGHTGSTTCANGICTYVNDWYYECLPREAESEEEVPLYGQCGGINYSGATKCAEGVCTYVNDWYYQCLIGPATGTPQSTSSTDSQSVSESSAAEDSTPTEEAEESAEESTSTEDAEESTEDFATTEEVEESTSTEDAEESTSTEEAEESTSTEDAEESTSTEEAEESTEESTSTDEVEESTSTEEVEESTEESTSTEDAEESTSTEEAEESTEESTSTDEVEESTSTEEVEESTEESTSTDEVEESTSTEEVEESTEESTSTDEVEESTSTEEVEESTEESTSTEDAEESTSTEEAEESTEESTSTDEVDESTSTEEAEESTEESTSTEDAEESTSTEEAEESTEESTSTEETEESTEELTSTEEAEESTEEPTSTDEVDESTSTDDVDESTSTEGTEQFSSTDVPQGRPGFENPTEEVESSSTEEFEEPTSTDETDESTEEATSTEEAEESISTDDVEQSTSVEEAEESTEESTSTEALEESTSTGDFENISAVDEELEESTEESTSTEEVEESTSTEDAEESTSTEEAEESTEESTSTEDAEESTSTEEAEESTEESTSTEDAEESTSSDEVEESTSTEEVEESTEESTSTEDAEESTSTEEAEESTEESTSTEDAEESTSTEDAEESTSTEYVEESTSIPSSTSEPSLSTSISPSSSSSFETATVTTDVSTTVLTTTDCGEQTCYKSLIITGVTEKTITTSGRTTVITTYCPLPTETVIPTPVVVTSTIYADETITETTCYVTGAIEKTVTVGGSPTVVTVHTTLPIEAIKPTPVTVTSTIYADETVTKTTCYETGAIEKTYTIGGSSTIVTIHTPLSTVQPTPVTVTSTIYADETVTKTTCYVTGAIEKTYTVGGSASVATVYTPLPTEPSKTSIVTLTSVISNSGSHPLTTSIVTGAVEKTITVDGTASIVTVHTPIASVYSSAHEHSKVTKAITPSTTTIIRDVCDSHSCTQATIETGVVSKTITIGQSVTTVVPSYVPLEHEQQEVHTTAATPVDSSVHSQSGSPVPPAITTQSYSAQASSVPVASYYEGSANNLVFSVASGVAALIVNALFL

SEQ ID NO: 25338 - protein, 313 aa, Pichia pastoris; identical to SEQ ID NO: 25329
  strain GS115 / ATCC 20864

SEQ ID NO: 25339 - protein, 269 aa, Pichia pastoris
  strain GS115 / ATCC 20864
MSLEVNWEQIASSEAIREQLVDWLNDQLKAVEVPKYLADIHVTSLSLGSKAPEITIRDIGKPFDDFYDIEEERAGTGEGDEDDGRVAPTSTPMKHQTSGSSDQTDASNPISPSTSHDHENDMQFVTEIKYDSDICVEVAAQLLMNYPAEKFISLPVRLKLSDLLIHTLAVVAYVNHRVFISLLCDISENEDTDNTESHSGNLRALSSKTASRIDVVKRLKVESELGSYEPDNGSILRSVGKIETFLVDTIRNLLVQEVGWPNWIEFQGV

SEQ ID NO: 25340 - protein, 606 aa, Pichia pastoris
  strain GS115 / ATCC 20864
MSHELFSLNFKQLMTVEIYVKNPRVYLGLDEFDGVSDGDKELEKLASLRERRKLVLPDPNNIVGHEELINWLTEAEFSTIDELNKVSHSENDRYINQILWLRYLSVKGKQDQYDVKIVDTFGITFPKANETNYTFELLLQEIARLRLKEDKELYTLLYEYSTKTFQSIPILSSLIDILLRGENNTNELIRTFKVYESIITEYEQVHGLNSSPYVVLFLEKLASLTSRLIKEEGSHELILNFIKTLKLKFEDFTEKFQVPFKFYALDSIHIDPIFCDPVFVSRISPVISSLIQSCEYLCQNSLDAPDLKKNLEQSVKFHHFFIQLNPKLPVSLGLVKTLVKLNQIQSATKIMKKTLQTDATNFKYINFMIVLLVASREYSTATKLINSTLLYIEQDSELSKAENDDIINLKILEILVIEKIHSPQVALNYLNDLFETYHKFYGQPGNASPLLDKIWLLASVLYENNKLYDEASNCLNEMAKPDLSRKAWLNIAQNKYQEAHDQIESVLTPIPSSFSPQARFSAILGLSHLAYNHPETFKSQKDIKSVQARCHTNLQRLRSDYTFSNHHHVYHFLSLSYEKLGDQVSLQEVLSYTVNLPDIILDLDEL

SEQ ID NO: 25341 - protein, 629 aa, Pichia pastoris; identical to SEQ ID NO: 25326
  strain GS115 / ATCC 20864

SEQ ID NO: 25342 - protein, 264 aa, Pichia pastoris; identical to SEQ ID NO: 25325
  strain GS115 / ATCC 20864

SEQ ID NO: 25343 - protein, 614 aa, Pichia pastoris; identical to SEQ ID NO: 25330
  strain GS115 / ATCC 20864

SEQ ID NO: 25344 - protein, 179 aa, Rhizopus javanicus
  MOD_RES (42)..(43): Any amino acid
  MOD_RES (60)..(60): Any amino acid
  MOD_RES (69)..(69): Any amino acid
  MOD_RES (71)..(71): Any amino acid
  MOD_RES (73)..(73): Any amino acid
DDNLVGGMTLDLPSDAPPISLSSSTNSAGGKVVAATTGKIIXXFTSLLSDTNGYVLRSDXQKTIYLVFXGXNXFDLYQREPRLSPKNLSIFTVGGPRVGNPTFAYYVESTGIPFQRDIVPHVPPQSFGFLHPGVESWIKSGTSNVQICTSEIETDCSNSIVPFTSILDHLSYFDINEGS

SEQ ID NO: 25345 - protein, 392 aa, Rhizopus niveus
MVSFISISQGVSLCLLVSSMMLGSSAVPVSGKSGSSNTAVSASDNAALPPLISSRCAPPSNKGSKSDLQAEPYNMQKNTEWYESHGGNLTSIGKRDDNLVGGMTLDLPSDAPPISLSSSTNSASDGGKVVAATTAQIQEFTKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTAHPTYKVIVTGHSLGGAQALLAGMDLYQREPRLSPKNLSIFTVGGPRVGNPTFAYYVESTGIPFQRTVHKRDIVPHVPPQSFGFLHPGVESWIKSGTSNVQICTSEIETKDCSNSIVPFTSILDHLSYFDINEGSCL

SEQ ID NO: 25346 - protein, 540 aa, Rhizopus oligosporus
MLARTFLGMAISAFLASTGVQAAWSSNGPNVMYYWGQNSAGGSNTQASLGTYCESGQVDAVLLSFLHVFNVGGTPEINLSSACAGTYFPNTQLLSCPAVGADIKKCQDKGVKVILSLGGAAGVYGFTSDAQGQQFAQTIWNLFGGGSSDTRPFGDAVIDGVDLDIEGGASTGYAAFVNALRQKFSSNFLIGAAPQCPFPDAILGSVLNSASFDYVNVQFYNNYCSATGSSFNFDTWDNWAKTTSPNKNVKIMFTIPGSPTAAGSGYVPMSTLQTIVPSLASEYSSYGGVSVWDASQAWNNGDFSSQLYSLVHSGGSTPPPSSSTIKTTTKATTTSTKTTTTAAPTATSAPGSCPVANQSCSTQNQYACTADGKYAVCDHGKWVVSSCPSGTVCIPTTDGTSIYCGYATGSGSTCPSASALEIAAASFGSKNGPVPRPYKASKVAAQLAVTSTDKNSFEAVINARRTTLTPFEKSVTIEFTTPSNIKFTESDMGPVRQVGNKVRIQAKNDYNESMTLVVKVKGSINSGVFVAPSTSAWKFK

SEQ ID NO: 25347 - protein, 542 aa, Rhizopus oligosporus
MLTRTFLGMAISAFLASTGVQAAWSSHGPNVMYYWGQNSAGGSNTQASLGTYCESGQVDAVLLSFLHVFNVGGIPEINLSSACAGTYFPNTQLLSCPAVGADIKKCQDKGVKVILSLGGAAGVYGFTSDAQGQQFAQTIWNLFGGGNSDTRPFGDAVIDGVDLDIEGGSSTGYVAFVNALRQKFSSNFLIGAAPQCPFPDAILGSVLNSASFDYVNVQFYNNYCSATGSSFNFDTWDNWAKTTSPNKNVKIMFTVPGSSTAAGSGYVPMSTLQTIVPSLASKYSSYGGVSVWDASQAWNNGGFNSQLYSLVHSGGSTPPPPSSSSATKTTTKTTATSTKTTTTTAPTATSTPGSCPVANQPCSTQNQYACTADGKYAVCDHGKWVASSCPSNTVCIPTTDGASIYCGYATGSGSTCPSVSALEITAASLGSKNGPVPRPYKASKVAAQLAVTSTDKNSFEAVINARRTTLTPFEKSVTIEFTTPSNIKFTESDMGPVRQVGNKVRIQAKNDYNESMTLVVKVKGSINSGVFVAPSTSAWNFK

SEQ ID NO: 25348 - protein, 392 aa, Rhizopus oryzae; identical to SEQ ID NO: 25345

SEQ ID NO: 25349 - protein, 383 aa, Rhizopus oryzae
MVQFLSLSSSVAAFFLLSLGIHDVAAAANCVVAPSSGDAAANIVSAFNSCNNGGTVTFTKGVTYNLNSVVTIQGLKHVNVNFAGTINLPARSSSFKNLDHYIELKGDNVQVFGGGTVNGNGQAWYDAQDHTAPTVFRFSLTNSKVSGINIINAPRAHLGVTNSQNLVLDNITLKTVSTSKNLAKNTDALDVSSSQGIIFQNSHLTVGDDCLAVNAGVTNITLNNVNCVGGHGFSVGSLGKGGATENVNLVRILNSSCTNCQNGVRIKTWPGGKGKVSDVKYIGLSLVNVDNPIIITTHYCDQNQESYCNGNDASSLSITGVTISGITGSVSSAGNPIVDIDCSTNTPCTDFTISGVTVNKASNTKKNVCINLQGSSGFPICSQ

SEQ ID NO: 25350 - protein, 366 aa, Rhizopus oryzae
MKFITITSSALLALALGTEMASAAKCSKLYGQCGGKDWNGPTCCESGSTCKVSNDYYSQCLAPESNGNKSSECSKLYGQCGGKDWNGPTCCESGSTCKVSNDYYSQCLAPESNGNKTSESAHKTTTTTAPAKEITTTAKASNSSNSSGKYSIVSGGASGNGVTTRYWDCCKASCSWPGKANVSSPVKSCNKDGVTALSDSNVQSGCNGGNSYMCNDNQPWAVNDNLAYGFAAAAISGGGESRWCCSCFELTFTSTSVAGKKMVIQVTNTGGDLGSSTGAHFDLQMPGGGVGIFNGCSKQWGAPNDGWGSRYGGISSASDCSSLPSALQAGCKWRFNWFKNADNPSMTYKEVTCPKEITAKTGCSRK

SEQ ID NO: 25351 - protein, 360 aa, Rhizopus oryzae
MKFLTIASSAILALAVGTEMAHAAECSKAYYQCGGKNWDGPTCCESGSTCVDYPDNPFYSQCVPNENLTSTNKSSHKTTTTESAKKTTTTKGSKKTTTTEASKKTTTTEASKKTTTTEASKKTTTTTKKASTSTSSSSSSASTNYSAVSGGASGNGETTRYWDCCKPSCSWPGKADVTSPVGSCNKDGKTLADNNTQNGCVGGSSYTCNDNQPWVVSDDLAYGFAAASISGGSEATWCCACFELTFTSTAVKGKKMVVQVTNTGSDLGSNTGAHFDLQMPGGGVGIYNGCATQWGAPTDGWGARYGGVSSASDCSNLPSALQAGCKWRFGWFKNADNPTMTYKQVTCPKAITAKSGCSRK

SEQ ID NO: 25352 - protein, 338 aa, Rhizopus oryzae
MKFITIASSALLALALGTEMASAAECSKLYGQCGGKNWNGPTCCESGSTCKVSNDYYSQCLPSGSSGNKSSESAHKKTTTAAHKKTTTAAHKKTTTAPAKKTTTVAKASTPSNSSSSSSGKYSAVSGGASGNGVTTRYWDCCKASCSWPGKANVSSPVKSCNKDGVTALSDSNAQSGCNGGNSYMCNDNQPWAVNDNLAYGFAAAAISGGGESRWCCSCFELTFTSTSVAGKKMVVQVTNTGGDLGSSTGAHFDLQMPGGGVGIFNGCSSQWGAPNDGWGSRYGGISSASDCSSLPSALQAGCKWRFNWFKNADNPSMTYKEVTCPKEITAKTGCSRK

SEQ ID NO: 25353 - protein, 28 aa, Rhizopus stolonifer
IDPVNVKKLQCDGDTYKCTADLDFGDGR

SEQ ID NO: 25354 - protein, 109 aa, Rhodococcus equi
  strain 103S
MAKFDIKRTIGTVAATAALVAAPFALSTGTANAASGNWDAVAQCESSGNWAANTGNGFYGGLQFTASTWQSFGGSGMAHQNSREEQIRVAENVLAGQGRGAWPVCGQYL

SEQ ID NO: 25355 - protein, 202 aa, Rhodococcus equi
  strain 103S
MSAPQQFPHPQQPGYTPPPPAKKNWFGRHKVLTSLGVAVVAIIAIVAATGGSGDGPTREDREAGAAVERPSDARIGTPVRDGKFEFVVHGVEAGVPTVGTNEYLTEKAQGQFVLVRMTVRNIGDREQSFTTSAQKMVDAQGRQYSVDDMATFTLDQGVPFEQINPGNSVDATIVFDVPAGTVPAVLEVHDSVFSGGESILLQ

SEQ ID NO: 25356 - protein, 210 aa, Rhodococcus equi
  strain 103S
MSGRHRKPTTTGRTVAKVAVTGAIMGVGGVAFAGTANAAPDSDWDRLAQCEASGNWGINTGNGYQGGLQFSPSTWTGHGGGQFAATADKATREQQIVVAERVLASQGWGAWPSCSSKLGLSSAPSQRSVPATPAPAPVTPAPVATTPAAPAAPSAVQAAFAGIDALLDAAANNGIVIHQDVLNAYDAAKSFDFNQVAMQNIAGIANQSQS

SEQ ID NO: 25357 - protein, 249 aa, Rhodococcus equi
  strain 103S
MHANRRSLLRHFRRRSFTRSATAVVAGSAALLLAGAVGTAGAAVTQQENTSAHTVSFDGWDLTVEQTGQSINSVQPLSGNQFTRDLFASQRALATVSGNGGSPYTGGTLEVGYQIGYQADVSNGAVITGNAGVTPGAVFIPEVSENLILTADPEVPAVVELFNGQALELGVETPVEGNLSTQIAPGTIATVPVQKKECKSTQCAITLRDVHLEVNHALGTVSVRSYAIFTASTDIADDVVVSYGPPVIV

SEQ ID NO: 25358 - protein, 375 aa, Rhodococcus equi
  strain 103S
MSPFARINTARSPLLYVVVAALFATLLVGGGLVVTQHKTITLDVDGDQISLSTLRSEVGSVLDNAGYPIGEHDVVAPSVDAKLSDGDTVVLRRAREIVLTVDGERRTVWSTALTVDDAMRQLNFAGDAYASASRGQRIPLDGIEFDVVNAKAVRISDNGAPHADVRVAAPTVGALLDVTNVPLEQADTVVPAPETPLTDGLEIVVTRNRTETRTETQPIQAPENRVDDPGLEQGKTTVENPGTPGERTVTVTVTTVNGAETDRRELSSVVVREPAPAVVRVGTKPKPSAPAVASGSVWDSLAQCEATGNWAISNGNGFYGGLQFSQSTWAAYGGTQYAPTADRASREQQIAVAEKVQAAQGWGAWPSCSSKLGLR

SEQ ID NO: 25359 - protein, 375 aa, Rhodococcus equi
  strain 103S
MSPLSKINSSRSPLMYGVVAATLVTLTVGGGVAVAQHKTVTVDVDGELITVGTMSSKVDGALAAAGYSVGEHDVVAPASDSDLDDGDTVVLRRGREVALTVDGRQRTVWTTALTVDEALNQFRLAGDVHVSANRSQRLPLEGSDLDVLSPRTVKLIDGTSAPVDVRLAAPTVGDFLAAHGTPLEQADTVEPAAETPLADGMEVAVTRGRVETRVLTEPVAPPEQRIEDPSMNMSRTVVENPGTAGVADVTYEVTTVNGVETGRKPVASTVTVPAQPKVVRVGAKPGTEVPPVQNGATWDALAQCEATGNWAINTGNGFYGGVQFDQNTWERQGGLKYAPRADLATREEQIAIASRTQQTQGWGAWPSCTSKLGLR

SEQ ID NO: 25360 - protein, 428 aa, Rhodococcus equi
  strain 103S
MAIIEQVGAREILDSRGNPTVEVEVLLEDGSFARAAVPSGASTGEHEAVELRDGGDRYLGKGVQKAVESVLGEIAPAIIGLDATEQRTVDQALLDADGTPDKSRLGANALLGASLAVARAGAESSGLELFRYVGGPNAHVLPVPMMNILNGGAHADTGVDVQEFMVAPIGAPTFKESLRWGAEVYHSLKSVLKAKGLSTGLGDEGGFAPDVAGTKEALDLISEAVAKTGLKLGTDIALALDVAATEFYTDGTGYKFEGKIRTAEEMGAFYAELLTQFPLVSIEDPLSEDDWAGWVALTEQIGNKIQLVGDDLFVTNPERLEEGIAKGAANALLVKVNQIGTLTETLDAVDLAHRSGYKTMMSHRSGETEDTTIADLAVAVGSGQIKTGAPARSERVAKYNQLLRIEESLGDAARYAGELAFPRFAFEA

SEQ ID NO: 25361 - protein, 195 aa, Rhodococcus equi
  strain 103S
MTSFTIKRAMGAVVATGAVVAIPLALGTGTASAAGSHDWSGVAECESSGNWSANTGNGYYGGLQFSQSTWEAYGGTGSASNASQAEQIRVAENVLDGQGVGAWPVCGQYLTGGSTATGSVESIAQEAPAQVTAPAPVQQQVAEWAQTVPAGVGNYVVQLGDTLSQIAQNHGVSLANLVAQVQNPDLIFPGQTLSI

SEQ ID NO: 25362 - protein, 134 aa, Rhodococcus equi
  strain 103S
MRDRTVGALRAAPAGTLTISTERTPSMPKSITRLLGGLAASTAAVAAPLVVSTGTAHAASGDWDAVAQCESGGNWSANTGNGYYGGLQFSAGTWSAHGGSGLPHNNSREEQIRVAEGVLASSGPGAWPSCGQYL

SEQ ID NO: 25363 - protein, 102 aa, Rhodococcus equi
  strain 103S
MFSHSRAASRAARSAIAVICSAVVGSGALVLGAGTAAAQETPPGPAILGVELDEEDGRPTVEIDYVNLQGERREIDVDLQTGRITEDEPDDEATAPASTLPG

SEQ ID NO: 25364 - protein, 183 aa, Rhodococcus equi
  strain 103S
MTNTSFTKRALGWAAVTGALVAVPFAAGTATASAATHNWDGVAQCESGGNWGINTGNGYYGGLQFSQSTWTANGGTGSPHTASKEEQIRVAENTLASQGPGAWPTCGQYLTTAEPAPIAEPAPAPAEAPAPAPMQAPSAADLVDQAVRLAGDAAAQHGYGDQFQQLLDTHGGAVTDVKAALTR

SEQ ID NO: 25365 - protein, 205 aa, Rhodococcus equi
  strain 103S
MLRQNGSTSRTRTATLAITGAALVALAGCGGNDDGWQDPTSTTGTTTGTTTGAGTGTPDAAPGTQALARAGATAVAAVPEGVLVSIEAEHDRTWEAQVVTPDGIEHHVDVSADGATVLGTPRIEEEDEADRAKHRDRVQAATLDYNAATAVLLTEVPGGAVTELDLDSANGTTVWEADVIDESGTKHEVTVDAATGTVLANTTGR

SEQ ID NO: 25366 - protein, 228 aa, Rhodococcus equi
  strain 103S
MRVFQGAAAGRVRTAAVVGAALVALVGCGNDDGGAATTTSAAAATSTSAKASTTSASGASGASEASGASGNTATSPTSASAATGAPSLAPGWNAKVFEHAGRTALAAVPGSSLVSIEENSDGSWVVDLINADGVAVEVGISPDGDRVIAGPSVTGEPTPGTDVAELDYTAATGVVLTEVPGGRITDLQLVVEKGGTYVWEADVVDASGARRAVDVDAVSGRVLQNAPR

SEQ ID NO: 25367 - protein, 86 aa, Saccharomyces cerevisiae
MRFPSIFTAVLFAASSALAAPVNTTTEDETAQIPAEAVIGYSDLEGDFDVAVLPFSNSTNNGLLFINTTIASIAAKEEGVSLDKRF

SEQ ID NO: 25368 - protein, 471 aa, Saccharomyces cerevisiae
MFAFYFLTACISLKGVFGVSPSYNGLGLTPQMGWDNWNTFACDVSEQLLLDTADRISDLGLKDMGYKYIILDDCWSSGRDSDGFLVADEQKFPNGMGHVADHLHNNSFLFGMYSSAGEYTCAGYPGSLGREEEDAQFFANNRVDYLKYDNCYNKGQFGTPEISYHRYKAMSDALNKTGRPIFYSLCNWGQDLTFYWGSGIANSWRMSGDVTAEFTRPDSRCPCDGDEYDCKYAGFHCSIMNILNKAAPMGQNAGVGGWNDLDNLEVGVGNLTDDEEKAHFSMWAMVKSPLIIGANVNNLKASSYSIYSQASVIAINQDSNGIPATRVWRYYVSDTDEYGQGEIQMWSGPLDNGDQVVALLNGGSVSRPMNTTLEEIFFDSNLGSKKLTSTWDIYDLWANRVDNSTASAILGRNKTATGILYNATEQSYKDGLSKNDTRLFGQKIGSLSPNAILNTTVPAHGIAFYRLRPSS

SEQ ID NO: 25369 - protein, 532 aa, Saccharomyces cerevisiae
MLLQAFLFLLAGFAAKISASMTNETSDRPLVHFTPNKGWMNDPNGLWYDAKEGKWHLYFQYNPNDTVWGLPLFWGHATSDDLTHWQDEPVAIAPKRKDSGAYSGSMVIDYNNTSGFFNDTIDPRQRCVAIWTYNTPESEEQYISYSLDGGYTFTEYQKNPVLAANSTQFRDPKVFWYEPSKKWIMTAAKSQDYKIEIYSSDDLKSWKLESAFANEGFLGYQYECPGLIEVPSEQDPSKSHWVMFISINPGAPAGGSFNQYFVGSFNGHHFEAFDNQSRVVDFGKDYYALQTFFNTDPTYGSALGIAWASNWEYSAFVPSNPWRSSMSLVRPFSLNTEYQANPETELINLKAEPILNISSAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 25370 - protein, 512 aa, Saccharomyces cerevisiae
MTNETSDRPLVHFTPNKGWMNDPNGLWYDAKEGKWHLYFQYNPNDTVWGLPLFWGHATSDDLTHWQDEPVAIAPKRKDSGAYSGSMVIDYNNTSGFFNDTIDPRQRCVAIWTYNTPESEEQYISYSLDGGYTFTEYQKNPVLAANSTQFRDPKVFWYEPSKKWIMTAAKSQDYKIEIYSSDDLKSWKLESAFANEGFLGYQYECPGLIEVPSEQDPSKSHWVMFISINPGAPAGGSFNQYFVGSFNGHHFEAFDNQSRVVDFGKDYYALQTFFNTDPTYGSALGIAWASNWEYSAFVPSNPWRSSMSLVRPFSLNTEYQANPETELINLKAEPILNISSAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 25371 - protein, 708 aa, Saccharomyces cerevisiae
MPRFAIIFALLIAYSLFLSTLFTGSIPDRANTVTSNAPCQVVIWDWIRTRRICNCCSRLCYSLLGRSNLSRTAKRGVCTIAGAVLATAAVIVAAVLVGKSSGSATKRGLTKTISVLNHTIPFTDHILNGQTLSNGTGSNFVTIGFSGYAVHATIKRASTTDIISWVIPESMEPTLARVASYVSSSSINLAAVPDTGGNASALSFQNAVQEFATSWVSMTYDQSYGDLRNVANDEGGEEILILMRKRSYRISFQVIETGSTALLLRTRRVVSQLITMTYLVTVQARVGIQIGDIFQHYGGIDNYVMTSISVLRTLEDKAFHENKLLIVREPPNKSNQDANQSYRLRPFSANDLIQNLKSVDIGFLAFCSFFDKYAHYPEIIMMKITIFISKGNLWSIIYVIQARYVRKRVMKVRGQMPGGLLTNMESLLNIVSTPNLNISEFHIQTHSMSQSKPMYFQKQCYSSQNNIIYIYNSIHITCGAVYVIVHDVRTPSVFVLIELRNCKPLKNSWCETTKTSPRDTKIKKNEYNETVCRRAGALLDGRVRTIRFLMMRTHWSRVKGVSCNTANRLSRFCNHVVSYYPSQNATIHLLPTSLRAESLEQQYTTRPLSSSNNRFCCLKSIFINNCKKACESPSLVSCNLQQTAELLMVYYLYICEACYVSRNHDLLSKQCMSTVRAVYVARMRLPKFRSTFPCMPRLCWLVNGVVVV

SEQ ID NO: 25372 - protein, 471 aa, Saccharomyces cerevisiae
MFAFYFLTACISLKGVFGVSPSYNGLGLTPQMGWDNWNTFACDVSEQLLLDTADRISDLGLKDMGYKYIILDDCWSSGRDSDGFLVADEQKFPNGMGHVADHLHNNSFLFGMYSSAGEYTCAGYPGSLGREEEDAQFFANNRVDYLKYDNCYNKGQFGTPEISYHRYKAMSDALNKTGRPIFYSLCNWGQDLTFYWGSGIANSWRMSGDITAEFTRPDSRCPCDGDEYDCKYAGFHCSIMNILNKAAPMGQNAGVGGWNDLDNLEVRVGNLTDDEEKAHFPMWAMVKSPLIIGADVNTLKPSSYSIYSQASVIAINQDPKGIPATRVWRYYVSDTDEYGQGEIQMWSGPLDNGDQVVALLNGGSVPRPMNTTLEEIFFDSNLGSKELTSTWDIYDLWANRVDNSTASAILGQNKTATGILYNATEQSYKDGLSKNDTRLFGQKIGSLSPNAILNTTVPAHGIAFYRLRPSA

SEQ ID NO: 25373 - protein, 471 aa, Saccharomyces cerevisiae
MFAFYFLTACTTLKGVFGVSPSYNGLGLTPQMGWDSWNTFACDVSEQLLLDTADRISDLGLKDMGYKYVILDDCWSSGRDSDGFLVADKHKFPNGMGHVADHLHNNSFLFGMYSSAGEYTCAGYPGSLGREEEDAQFFANNRVDYLKYDNCYNKGQFGTPDVSYHRYKAMSDALNKTGRPIFYSLCNWGQDLTFYWGSGIANSWRMSGDITAEFTRPDSRCPCDGDEYDCKYAGFHCSIMNILNKAAPMGQNAGVGGWNDLDNLEVGVGNLTDDEEKAHFSMWAMVKSPLIIGADVNHLKASSYSIYSQASVIAINQDPKGIPATRVWRYYVSDTDEYGQGEIQMWSGPLDNGDQVVALLNGGSVARPMNTTLEEIFFDSNLGSKELTSTWDIYDLWANRVDNSTASAILEQNKAATGILYNATEQSYKDGLSKNDTRLFGQKIGSLSPNAILNTTVPAHGIAFYRLRPSA

SEQ ID NO: 25374 - protein, 471 aa, Saccharomyces cerevisiae
MFAFYFLTACISLKGVFGVSPSYNGLGLTPQMGWDNWNTFACDVSEQLLLDTADRISDLGLKDMGYKYVILDDCWSSGRDSDGFLVADKHKFPNGMGHVADHLHNNSFLFGMYSSAGEYTCAGYPGSLGREEEDAQFFANNRVDYLKYDNCYNKGQFGTPDVSYHRYKAMSDALNKTGRPIFYSLCNWGQDLTFYWGSGIANSWRMSGDITAEFTRPDSRCPCDGDEYDCKYAGFHCSIMNILNKAAPMGQNAGVGGWNDLDNLEVGVGNLTDDEEKAHFSMWAMVKSPLIIGADVNHLKASSYSIYSQASVIAINQDPKGIPATRVWRYYVSDTDEYGQGEIQMWSGPLDNGDQVVALLNGGSVARPMNTTLEEIFFDSNLGSKELTSTWDIYDLWANRVDNSTASAILEQNKAATGILYNATEQSYKDGLSKNDTRLFGQKIGSLSPNAILNTTVPAHGIAFYRLRPSA

SEQ ID NO: 25375 - protein, 238 aa, Saccharomyces cerevisiae
  strain ATCC 204508 / S288c
MRATTLLSSVVSLALLSKEVLATPPACLLACVAQVGKSSSTCDSLNQVTCYCEHENSAVKKCLDSICPNNDADAAYSAFKSSCSEQNASLGDSSSSASSSASSSSKASSSTKASSSSASSSTKASSSSASSSTKASSSSAAPSSSKASSTESSSSSSSSTKAPSSEESSSTYVSSSKQASSTSEAHSSSAASSTVSQETVSSALPTSTAVISTFSEGSGNVLEAGKSVFIAAVAAMLI

SEQ ID NO: 25376 - protein, 86 aa, Saccharomyces cerevisiae
  strain ATCC 204508 / S288c
MGNIMSASFAPECTDLKTKYDSCFNEWYSEKFLKGKSVENECSKQWYAYTTCVNAALVKQGIKPALDEAREEAPFENGGKLKEVDK

SEQ ID NO: 25377 - protein, 109 aa, Saccharomyces cerevisiae
  strain ATCC 204508 / S288c
MTEFKAGSAKKGATLFKTRCLQCHTVEKGGPHKVGPNLHGIFGRHSGQAEGYSYTDANIKKNVLWDENNMSEYLTNPKKYIPGTKMAFGGLKKEKDRNDLITYLKKACE

SEQ ID NO: 25378 - protein, 113 aa, Saccharomyces cerevisiae
  strain ATCC 204508 / S288c
MAKESTGFKPGSAKKGATLFKTRCQQCHTIEEGGPNKVGPNLHGIFGRHSGQVKGYSYTDANINKNVKWDEDSMSEYLTNPKKYIPGTKMAFAGLKKEKDRNDLITYMTKAAK

SEQ ID NO: 25379 - protein, 591 aa, Saccharomyces cerevisiae
  strain ATCC 204508 / S288c
MLKYKPLLKISKNCEAAILRASKTRLNTIRAYGSTVPKSKSFEQDSRKRTQSWTALRVGAILAATSSVAYLNWHNGQIDNEPKLDMNKQKISPAEVAKHNKPDDCWVVINGYVYDLTRFLPNHPGGQDVIKFNAGKDVTAIFEPLHAPNVIDKYIAPEKKLGPLQGSMPPELVCPPYAPGETKEDIARKEQLKSLLPPLDNIINLYDFEYLASQTLTKQAWAYYSSGANDEVTHRENHNAYHRIFFKPKILVDVRKVDISTDMLGSHVDVPFYVSATALCKLGNPLEGEKDVARGCGQGVTKVPQMISTLASCSPEEIIEAAPSDKQIQWYQLYVNSDRKITDDLVKNVEKLGVKALFVTVDAPSLGQREKDMKLKFSNTKAGPKAMKKTNVEESQGASRALSKFIDPSLTWKDIEELKKKTKLPIVIKGVQRTEDVIKAAEIGVSGVVLSNHGGRQLDFSRAPIEVLAETMPILEQRNLKDKLEVFVDGGVRRGTDVLKALCLGAKGVGLGRPFLYANSCYGRNGVEKAIEILRDEIEMSMRLLGVTSIAELKPDLLDLSTLKARTVGVPNDVLYNEVYEGPTLTEFEDA

SEQ ID NO: 25380 - protein, 154 aa, Saccharomyces cerevisiae
  strain ATCC 204508 / S288c
MVQAVAVLKGDAGVSGVVKFEQASESEPTTVSYEIAGNSPNAERGFHIHEFGDATNGCVSAGPHFNPFKKTHGAPTDEVRHVGDMGNVKTDENGVAKGSFKDSLIKLIGPTSVVGRSVVIHAGQDDLGKGDTEESLKTGNAGPRPACGVIGLTN

SEQ ID NO: 25381 - protein, 467 aa, Saccharomyces cerevisiae
  strain ATCC 204508 / S288c
MFKSVVYSILAASLANAGTIPLGKLADVDKIGTQKDIFPFLGGAGPYYSFPGDYGISRDLPEGCEMKQLQMVGRHGERYPTVSLAKTIKSTWYKLSNYTRQFNGSLSFLNDDYEFFIRDDDDLEMETTFANSDDVLNPYTGEMNAKRHARDFLAQYGYMVENQTSFAVFTSNSKRCHDTAQYFIDGLGDQFNITLQTVSEAESAGANTLSACNSCPAWDYDANDDIVNEYDTTYLDDIAKRLNKENKGLNLTSTDASTLFSWCAFEVNAKGYSDVCDIFTKDELVHYSYYQDLHTYYHEGPGYDIIKSVGSNLFNASVKLLKQSEIQDQKVWLSFTHDTDILNFLTTAGIIDDKNNLTAEYVPFMGNTFHRSWYVPQGARVYTEKFQCSNDTYVRYVINDAVVPIETCSTGPGFSCEINDFYDYAEKRVAGTDFLKVCNVSSVSNSTELTFYWDWNTTHYNASLLRQ

SEQ ID NO: 25382 - protein, 532 aa, Saccharomyces cerevisiae; identical to SEQ ID NO: 838
  strain ATCC 204508 / S288c

SEQ ID NO: 25383 - protein, 512 aa, Saccharomyces cerevisiae
  strain ATCC 204508 / S288c
MTNETSDRPLVHFTPNKGWMNDPNGLWYDEKDAKWHLYFQYNPNDTVWGTPLFWGHATSDDLTNWEDQPIAIAPKRNDSGAFSGSMVVDYNNTSGFFNDTIDPRQRCVAIWTYNTPESEEQYISYSLDGGYTFTEYQKNPVLAANSTQFRDPKVFWYEPSQKWIMTAAKSQDYKIEIYSSDDLKSWKLESAFANEGFLGYQYECPGLIEVPTEQDPSKSYWVMFISINPGAPAGGSFNQYFVGSFNGTHFEAFDNQSRVVDFGKDYYALQTFFNTDPTYGSALGIAWASNWEYSAFVPTNPWRSSMSLVRKFSLNTEYQANPETELINLKAEPILNISNAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 25384 - protein, 165 aa, Saccharomyces cerevisiae
  strain ATCC 204508 / S288c
MRFPSIFTAVLFAASSALAAPVNTTTEDETAQIPAEAVIGYLDLEGDFDVAVLPFSNSTNNGLLFINTTIASIAAKEEGVSLDKREAEAWHWLQLKPGQPMYKREAEAEAWHWLQLKPGQPMYKREADAEAWHWLQLKPGQPMYKREADAEAWHWLQLKPGQPMY

SEQ ID NO: 25385 - protein, 283 aa, Saccharomyces cerevisiae
  strain ATCC 204508 / S288c
MSPPVYSDISRNINDLLNKDFYHATPAAFDVQTTTANGIKFSLKAKQPVKDGPLSTNVEAKLNDKQTGLGLTQGWSNTNNLQTKLEFANLTPGLKNELITSLTPGVAKSAVLNTTFTQPFFTARGAFDLCLKSPTFVGDLTMAHEGIVGGAEFGYDISAGSISRYAMALSYFAKDYSLGATLNNEQITTVDFFQNVNAFLQVGAKATMNCKLPNSNVNIEFATRYLPDASSQVKAKVSDSGIVTLAYKQLLRPGVTLGVGSSFDALKLSEPVHKLGWSLSFDA

SEQ ID NO: 25386 - protein, 220 aa, Saccharomyces cerevisiae
  strain ATCC 204508 / S288c
MSSNSTPEKVTAEHVLWYIPNKIGYVRVITAALSFFVMKNHPTAFTWLYSTSCLLDALDGTMARKYNQVSSLGAVLDMVTDRSSTAGLMCFLCVQYPQWCVFFQLMLGLDITSHYMHMYASLSAGKTSHKSVGEGESRLLHLYYTRRDVLFTICAFNELFYAGLYLQLFSNSATFGKWTTIISFPGYVFKQTANVVQLKRAALILADNDAKNANEKNKTY

SEQ ID NO: 25387 - protein, 617 aa, Saccharomyces cerevisiae
  strain ATCC 204508 / S288c
MKSFITRNKTAILATVAATGTAIGAYYYYNQLQQQQQRGKKNTINKDEKKDTKDSQKETEGAKKSTAPSNPPIYPVSSNGEPDFSNKANFTAEEKDKYALALKDKGNQFFRNKKYDDAIKYYNWALELKEDPVFYSNLSACYVSVGDLKKVVEMSTKALELKPDYSKVLLRRASANEGLGKFADAMFDLSVLSLNGDFNDASIEPMLERNLNKQAMSKLKEKFGDIDTATATPTELSTQPAKERKDKQENLPSVTSMASFFGIFKPELTFANYDESNEADKELMNGLSNLYKRSPESYDKADESFTKAARLFEEQLDKNNEDEKLKEKLAISLEHTGIFKFLKNDPLGAHEDIKKAIELFPRVNSYIYMALIMADRNDSTEYYNYFDKALKLDSNNSSVYYHRGQMNFILQNYDQAGKDFDKAKELDPENIFPYIQLACLAYRENKFDDCETLFSEAKRKFPEAPEVPNFFAEILTDKNDFDKALKQYDLAIELENKLDGIYVGIAPLVGKATLLTRNPTVENFIEATNLLEKASKLDPRSEQAKIGLAQMKLQQEDIDEAITLFEESADLARTMEEKLQAITFAEAAKVQQRIRSDPVLAKKIQETLAKLREQGLM

SEQ ID NO: 25388 - protein, 276 aa, Saccharomyces cerevisiae
  strain ATCC 204508 / S288c
MVESDEDFAPQEFPHTDTDVIVNEHRDENDGYASDEVGGTLSRRASSIFSINTTPLAPPNATDIQKFTSDEHHFSMMRNLHMADYITMLNGFSGFYSIVSCLRFTLTGKPHYVQRAHFFILLGMCFDFLDGRVARLRNRSSLMGQELDSLADLVSFGVAPAAIAFAIGFQTTFDVMILSFFVLCGLARLARFNVTVAQLPKDSSTGKSKYFEGLPMPTTLALVLGMAYCVRKGLIFDNIPFGIFREDQILEFHPIILVFFIHGCGMISKSLKIPKP

SEQ ID NO: 25389 - protein, 1367 aa, Saccharomyces cerevisiae
  strain ATCC 204508 / S288c
MQRPFLLAYLVLSLLFNSALGFPTALVPRGSSEGTSCNSIVNGCPNLDFNWHMDQQNIMQYTLDVTSVSWVQDNTYQITIHVKGKENIDLKYLWSLKIIGVTGPKGTVQLYGYNENTYLIDNPTDFTATFEVYATQDVNSCQVWMPNFQIQFEYLQGSAAQYASSWQWGTTSFDLSTGCNNYDNQGHSQTDFPGFYWNIDCDNNCGGTKSSTTTSSTSESSTTTSSTSESSTTTSSTSESSTTTSSTSESSTSSSTTAPATPTTTSCTKEKPTPPTTTSCTKEKPTPPHHDTTPCTKKKTTTSKTCTKKTTTPVPTPSSSTTESSSAPVPTPSSSTTESSSAPVTSSTTESSSAPVPTPSSSTTESSSAPVTSSTTESSSAPVTSSTTESSSAPVPTPSSSTTESSSAPVTSSTTESSSAPVTSSTTESSSAPVTSSTTESSSAPVTSSTTESSSAPVPTPSSSTTESSSAPVTSSTTESSSAPVPTPSSSTTESSSAPVTSSTTESSSAPVPTPSSSTTESSSAPAPTPSSSTTESSSAPVTSSTTESSSAPVPTPSSSTTESSSTPVTSSTTESSSAPVPTPSSSTTESSSAPVPTPSSSTTESSSAPAPTPSSSTTESSSAPVTSSTTESSSAPVPTPSSSTTESSSAPVPTPSSSTTESSSAPVPTPSSSTTESSSAPVTSSTTESSSAPVTSSTTESSSAPVPTPSSSTTESSSAPVPTPSSSTTESSSAPVPTPSSSTTESSSAPVTSSTTESSSAPVPTPSSSTTESSSAPVPTPSSSTTESSSAPVPTPSSSTTESSVAPVPTPSSSSNITSSAPSSTPFSSSTESSSVPVPTPSSSTTESSSAPVSSSTTESSVAPVPTPSSSSNITSSAPSSIPFSSTTESFSTGTTVTPSSSKYPGSQTETSVSSTTETTIVPTKTTTSVTTPSTTTITTTVCSTGTNSAGETTSGCSPKTVTTTVPTTTTTSVTTSSTTTITTTVCSTGTNSAGETTSGCSPKTITTTVPCSTSPSETASESTTTSPTTPVTTVVSTTVVTTEYSTSTKPGGEITTTFVTKNIPTTYLTTIAPTPSVTTVTNFTPTTITTTVCSTGTNSAGETTSGCSPKTVTTTVPCSTGTGEYTTEATTLVTTAVTTTVVTTESSTGTNSAGKTTTGYTTKSVPTTYVTTLAPSAPVTPATNAVPTTITTTECSAATNAAGETTSVCSAKTIVSSASAGENTAPSATTPVTTAIPTTVITTESSVGTNSAGETTTGYTTKSIPTTYITTLIPGSNGAKNYETVATATNPISIKTTSQLATTASASSVAPVVTSPSLTGPLQSASGSAVATYSVPSISSTYQGAANIKVLGNFMWLLLALPVVF

SEQ ID NO: 25390 - protein, 362 aa, Saccharomyces cerevisiae
  strain ATCC 204508 / S288c
MRSLNTLLLSLFVAMSSGAPLLKIREEKNSSLPSIKIFGTGGTIASKGSTSATTAGYSVGLTVNDLIEAVPSLAEKANLDYLQVSNVGSNSLNYTHLIPLYHGISEALASDDYAGAVVTHGTDTMEETAFFLDLTINSEKPVCIAGAMRPATATSADGPMNLYQAVSIAASEKSLGRGTMITLNDRIASGFWTTKMNANSLDTFRADEQGYLGYFSNDDVEFYYPPVKPNGWQFFDISNLTDPSEIPEVIILYSYQGLNPELIVKAVKDLGAKGIVLAGSGAGSWTATGSIVNEQLYEEYGIPIVHSRRTADGTVPPDDAPEYAIGSGYLNPQKSRILLQLCLYSGYGMDQIRSVFSGVYGG

SEQ ID NO: 25391 - protein, 362 aa, Saccharomyces cerevisiae; identical to SEQ ID NO: 25390
  strain ATCC 204508 / S288c

SEQ ID NO: 25392 - protein, 362 aa, Saccharomyces cerevisiae; identical to SEQ ID NO: 25390
  strain ATCC 204508 / S288c

SEQ ID NO: 25393 - protein, 362 aa, Saccharomyces cerevisiae; identical to SEQ ID NO: 25390
  strain ATCC 204508 / S288c

SEQ ID NO: 25394 - protein, 254 aa, Saccharomyces cerevisiae
  strain ATCC 204508 / S288c
MAYTKIALFAAIAALASAQTQDQINELNVILNDVKSHLQEYISLASDSSSGFSLSSMPAGVLDIGMALASATDDSYTTLYSEVDFAGVSKMLTMVPWYSSRLEPALKSLNGDASSSAAPSSSAAPTSSAAPSSSAAPTSSAASSSSEAKSSSAAPSSSEAKSSSAAPSSSEAKSSSAAPSSSEAKSSSAAPSSTEAKITSAAPSSTGAKTSAISQITDGQIQATKAVSEQTENGAAKAFVGMGAGVVAAAAMLL

SEQ ID NO: 25395 - protein, 587 aa, Saccharomyces cerevisiae
  strain ATCC 204508 / S288c
MSAINHLCLKLILASFAIINTITALTNDGTGHLEFLLQHEEEMYYATTLDIGTPSQSLTVLFDTGSADFWVMDSSNPFCLPNSNTSSYSNATYNGEEVKPSIDCRSMSTYNEHRSSTYQYLENGRFYITYADGTFADGSWGTETVSINGIDIPNIQFGVAKYATTPVSGVLGIGFPRRESVKGYEGAPNEYYPNFPQILKSEKIIDVVAYSLFLNSPDSGTGSIVFGAIDESKFSGDLFTFPMVNEYPTIVDAPATLAMTIQGLGAQNKSSCEHETFTTTKYPVLLDSGTSLLNAPKVIADKMASFVNASYSEEEGIYILDCPVSVGDVEYNFDFGDLQISVPLSSLILSPETEGSYCGFAVQPTNDSMVLGDVFLSSAYVVFDLDNYKISLAQANWNASEVSKKLVNIQTDGSISGAKIATAEPWSTNEPFTVTSDIYSSTGCKSRPFLQSSTASSLIAETNVQSRNCSTKMPGTRSTTVLSKPTQNSAMHQSTGAVTQTSNETKLELSSTMANSGSVSLPTSNSIDKEFEHSKSQTTSDPSVAEHSTFNQTFVHETKYRPTHKTVITETVTKYSTVLINVCKPTY

SEQ ID NO: 25396 - protein, 368 aa, Saccharomyces cerevisiae
  strain ATCC 204508 / S288c
MARTITFDIPSQYKLVDLIGEGAYGTVCSAIHKPSGIKVAIKKIQPFSKKLFVTRTIREIKLLRYFHEHENIISILDKVRPVSIDKLNAVYLVEELMETDLQKVINNQNSGFSTLSDDHVQYFTYQILRALKSIHSAQVIHRDIKPSNLLLNSNCDLKVCDFGLARCLASSSDSRETLVGFMTEYVATRWYRAPEIMLTFQEYTTAMDIWSCGCILAEMVSGKPLFPGRDYHHQLWLILEVLGTPSFEDFNQIKSKRAKEYIANLPMRPPLPWETVWSKTDLNPDMIDLLDKMLQFNPDKRISAAEALRHPYLAMYHDPSDEPEYPPLNLDDEFWKLDNKIMRPEEEEEVPIEMLKDMLYDELMKTME

SEQ ID NO: 25397 - protein, 329 aa, Saccharomyces cerevisiae
  strain ATCC 204508 / S288c
MVSSFSVPMPVKRIFDTFPLQTYAAQTDKDEAVALEIQRRSYTFTERGGGSSELTVEGTYKLGVYNVFLEANTGAALATDPWCLFVQLALCQKNGLVLPTHSQEQTPSHTCNHEMLVLSRLSNPDEALPILVEGYKKRIIRSTVAISEIMRSRILDDAEQLMYYTLLDTVLYDCWITQIIFCASDAQFMELYSCQKLSGSIVTPLDVENSLLQKLSAKSLKISLTKRNKFQFRHREIVKSMQGVYHNHHNSVNQEQVLNVLFENSKQVLLGLKDMLKSDGQPTYLHLKIASYILCITNVKEPIKLKTFVENECKELVQFAQDTLKNFVQ

SEQ ID NO: 25398 - protein, 313 aa, Saccharomyces cerevisiae; identical to SEQ ID NO: 849
  strain ATCC 204508 / S288c

SEQ ID NO: 25399 - protein, 393 aa, Saccharomyces cerevisiae
  strain ATCC 204508 / S288c
MSSRIIVGSAALAAAITASIMVREQKAKGQRREGNVSAYYNGQEYGSSAPPQLGKLHNIKQGIKEDALSLKDALLGVSQKAREEAPKVTKRVISPEEDAQTRKQLGQKAKDSSSQSIFNWGFSEAERRKAIAIGEFDTAKKRFEEAVDRNEKELLSTVMREKKAALDRASIEYERYGRARDFNELSDKLDQQERNSNPLKRLLKNNTGDANTEEAAARSVQGWGDTAQEFGREELEEAKRNASSEPSEAQKRLDELKKIKEKGWFGYNKGEQSEQQIAERVARGLEGWGETAAQLSKDEMDDLRWNYENSKKQLDKNVSDAMDSLSKAKEDLKQYGSHWWSGWTSKVDNDKQALKDEAQKKYDEALKKYDEAKNKFKEWNDKGDGKFWSSKKD

SEQ ID NO: 25400 - protein, 691 aa, Saccharomyces cerevisiae
  strain ATCC 204508 / S288c
MPFGIDNTDFTVLAGLVLAVLLYVKRNSIKELLMSDDGDITAVSSGNRDIAQVVTENNKNYLVLYASQTGTAEDYAKKFSKELVAKFNLNVMCADVENYDFESLNDVPVIVSIFISTYGEGDFPDGAVNFEDFICNAEAGALSNLRYNMFGLGNSTYEFFNGAAKKAEKHLSAAGAIRLGKLGEADDGAGTTDEDYMAWKDSILEVLKDELHLDEQEAKFTSQFQYTVLNEITDSMSLGEPSAHYLPSHQLNRNADGIQLGPFDLSQPYIAPIVKSRELFSSNDRNCIHSEFDLSGSNIKYSTGDHLAVWPSNPLEKVEQFLSIFNLDPETIFDLKPLDPTVKVPFPTPTTIGAAIKHYLEITGPVSRQLFSSLIQFAPNADVKEKLTLLSKDKDQFAVEITSKYFNIADALKYLSDGAKWDTVPMQFLVESVPQMTPRYYSISSSSLSEKQTVHVTSIVENFPNPELPDAPPVVGVTTNLLRNIQLAQNNVNIAETNLPVHYDLNGPRKLFANYKLPVHVRRSNFRLPSNPSTPVIMIGPGTGVAPFRGFIRERVAFLESQKKGGNNVSLGKHILFYGSRNTDDFLYQDEWPEYAKKLDGSFEMVVAHSRLPNTKKVYVQDKLKDYEDQVFEMINNGAFIYVCGDAKGMAKGVSTALVGILSRGKSITTDEATELIKMLKTSGRYQEDVW

SEQ ID NO: 25401 - protein, 377 aa, Saccharomyces cerevisiae
  strain ATCC 204508 / S288c
MSKGRVNQKRYKYPLPIHPVDDLPELILHNPLSWLYWAYRYYKSTNALNDKVHVDFIGDTTLHITVQDDKQMLYLWNNGFFGTGQFSRSEPTWKARTEARLGLNDTPLHNRGGTKSNTETEMTLEKVTQQRRLQRLEFKKERAKLERELLELRKKGGHIDEENILLEKQRESLRKFKLKQTEDVGIVAQQQDISESNLRDEDNNLLDENGDLLPLESLELMPVEAMFLTFALPVLDISPACLAGKLFQFDAKYKDIHSFVRSYVIYHHYRSHGWCVRSGIKFGCDYLLYKRGPPFQHAEFCVMGLDHDVSKDYTWYSSIARVVGGAKKTFVLCYVERLISEQEAIALWKSNNFTKLFNSFQVGEVLYKRWVPGRNRD

SEQ ID NO: 25402 - protein, 353 aa, Saccharomyces cerevisiae
  strain ATCC 204508 / S288c
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 25403 - protein, 313 aa, Saccharomyces cerevisiae
  strain ATCC 204508 / S288c
MMRRTLLHSFATLLLSLSLWSAAVMAAVTTQVTVVTNVAGALVTETTIWDPATAAAAATTTAQTGFFTTVFTTTNDVGTTVTLTQTVNRATMLPTTTTSTSSTGKTTTTVPTATSSLSSGLYLSTVTTTNDLGTTVTLTQTFTHSSTSATSSASSSVSSSVSSSGSSSSVKTTTSTGSAVAETGTRPDPSTDFTEPPVSAVTSLSIDSYITITEGTTSTYTTTRAPTSMWVTVVRQGNTITVQTTFVQRFSSQYVTVASPSVGSIGMGTLTGTVGVIKSAIKKTVSHNEAQHLGMSSFTSILGGLLTVLIWFL

SEQ ID NO: 25404 - protein, 493 aa, Saccharomyces cerevisiae
  strain ATCC 204508 / S288c
MLPYMDQVLRAFYQSTHWSTQNSYEDITATSRTLLDFRIPSAIHLQISNKSTPNTFNSLDFSTRSRINGSLSYLYSDAQQLEKFMRNSTDIPLQDATETYRQLQPNLNFSVSSANTLSSDNTTVDNDKKLLHDSKFVKKSLYYGRMYYPSSDLEAMIIKRLSPQTQFMLKGVSSFKESLNVLTCYFQRDSHRNLQEWIFSTSDLLCGYRVLHNFLTTPSKFNTSLYNNSSLSLGAEFWLGLVSLSPGCSTTLRYYTHSTNTGRPLTLTLSWNPLFGHISSTYSAKTGTNSTFCAKYDFNLYSIESNLSFGCEFWQKKHHLLETNKNNNDKLEPISDELVDINPNSRATKLLHENVPDLNSAVNDIPSTLDIPVHKQKLLNDLTYAFSSSLRKIDEERSTIEKFDNKINSSIFTSVWKLSTSLRDKTLKLLWEGKWRGFLISAGTELVFTRGFQESLSDDEKNDNAISISATDTENGNIPVFPAKFGIQFQYST

SEQ ID NO: 25405 - protein, 650 aa, Saccharomyces cerevisiae
  strain ATCC 204508 / S288c
MFTFLKIILWLFSLALASAININDITFSNLEITPLTANKQPDQGWTATFDFSIADASSIREGDEFTLSMPHVYRIKLLNSSQTATISLADGTEAFKCYVSQQAAYLYENTTFTCTAQNDLSSYNTIDGSITFSLNFSDGGSSYEYELENAKFFKSGPMLVKLGNQMSDVVNFDPAAFTENVFHSGRSTGYGSFESYHLGMYCPNGYFLGGTEKIDYDSSNNNVDLDCSSVQVYSSNDFNDWWFPQSYNDTNADVTCFGSNLWITLDEKLYDGEMLWVNALQSLPANVNTIDHALEFQYTCLDTIANTTYATQFSTTREFIVYQGRNLGTASAKSSFISTTTTDLTSINTSAYSTGSISTVETGNRTTSEVISHVVTTSTKLSPTATTSLTIAQTSIYSTDSNITVGTDIHTTSEVISDVETISRETASTVVAAPTSTTGWTGAMNTYISQFTSSSFATINSTPIISSSAVFETSDASIVNVHTENITNTAAVPSEEPTFVNATRNSLNSFCSSKQPSSPSSYTSSPLVSSLSVSKTLLSTSFTPSVPTSNTYIKTKNTGYFEHTALTTSSVGLNSFSETAVSSQGTKIDTFLVSSLIAYPSSASGSQLSGIQQNFTSTSLMISTYEGKASIFFSAELGSIIFLLLSYLLF

SEQ ID NO: 25406 - protein, 559 aa, Saccharomyces cerevisiae
  strain ATCC 204508 / S288c
MLFKSLSKLATAAAFFAGVATADDVPAIEVVGNKFFYSNNGSQFYIRGVAYQADTANETSGSTVNDPLANYESCSRDIPYLKKLNTNVIRVYAINTTLDHSECMKALNDADIYVIADLAAPATSINRDDPTWTVDLFNSYKTVVDTFANYTNVLGFFAGNEVTNNYTNTDASAFVKAAIRDVRQYISDKNYRKIPVGYSSNDDEDTRVKMTDYFACGDDDVKADFYGINMYEWCGKSDFKTSGYADRTAEFKNLSIPVFFSEYGCNEVTPRLFTEVEALYGSNMTDVWSGGIVYMYFEETNKYGLVSIDGNDVKTLDDFNNYSSEINKISPTSANTKSYSATTSDVACPATGKYWSAATELPPTPNGGLCSCMNAANSCVVSDDVDSDDYETLFNWICNEVDCSGISANGTAGKYGAYSFCTPKEQLSFVMNLYYEKSGGSKSDCSFSGSATLQTATTQASCSSALKEIGSMGTNSASGSVDLGSGTESSTASSNASGSSSKSNSGSSGSSSSSSSSSASSSSSSKKNAATNVKANLAQVVFTSIISLSIAAGVGFALV

SEQ ID NO: 25407 - protein, 205 aa, Saccharomyces cerevisiae
  strain ATCC 204508 / S288c
MKFSGLWCWLLLFLSVNVIASDVGELIDQDDEVITQKVFFDIEHGEEKVGRIVIGLYGKVCPKTAKNFYKLSTTTNSKKGFIGSTFHRVIPNFMVQGGDFTDGTGVGGKSIYGDTFPDENFTLKHDRKGRLSMANRGKDTNGSQFFITTTEEASWLDGKHVVFGQVVDGMDVVNYIQHVSRDANDKPLEAVKIAKCGEWTPELSS

SEQ ID NO: 25408 - protein, 448 aa, Saccharomyces cerevisiae; identical to SEQ ID NO: 843
  strain ATCC 204508 / S288c

SEQ ID NO: 25409 - protein, 152 aa, Saccharomyces cerevisiae
  strain ATCC 204508 / S288c
MQYHSALYVYIYVTFTTIPYKEKPDIISICFSMLSFVFDFSVRICSRTLESFSWSLISSSAFKVVSAFSLAGSCVLASRSSVGIIVSLLLFNFSTCNFVLFLSAVLIDLFFCTFLPTPTFLPTPFFFMLHLPIFSLLNALELLYLIIAGLHI

SEQ ID NO: 25410 - protein, 1609 aa, Saccharomyces cerevisiae
  strain ATCC 204508 / S288c
MNSFASLGLIYSVVNLLTRVEAQIVFYQNSSTSLPVPTLVSTSIADFHESSSTGEVQYSSSYSYVQPSIDSFTSSSFLTSFEAPTETSSSYAVSSSLITSDTFSSYSDIFDEETSSLISTSAASSEKASSTLSSTAQPHRTSHSSSSFELPVTAPSSSSLPSSTSLTFTSVNPSQSWTSFNSEKSSALSSTIDFTSSEISGSTSPKSLESFDTTGTITSSYSPSPSSKNSNQTSLLSPLEPLSSSSGDLILSSTIQATTNDQTSKTIPTLVDATSSLPPTLRSSSMAPTSGSDSISHNFTSPPSKTSGNYDVLTSNSIDPSLFTTTSEYSSTQLSSLNRASKSETVNFTASIASTPFGTDSATSLIDPISSVGSTASSFVGISTANFSTQGNSNYVPESTASGSSQYQDWSSSSLPLSQTTWVVINTTNTQGSVTSTTSPAYVSTATKTVDGVITEYVTWCPLTQTKSQAIGVSSSISSVPQASSFSGSSILSSNSSTLAASNNVPESTASGSSQYQDWSSSSLPLSQTTWVVINTTNTQGSVTSTTSPAYVSTATKTVDGVITEYVTWCPLTQTKSQAIGISSSTISATQTSKPSSILTLGISTLQLSDATFKGTETINTHLMTESTSITEPTYFSGTSDSFYLCTSEVNLASSLSSYPNFSSSEGSTATITNSTVTFGSTSKYPSTSVSNPTEASQHVSSSVNSLTDFTSNSTETIAVISNIHKTSSNKDYSLTTTQLKTSGMQTLVLSTVTTTVNGAATEYTTWCPASSIAYTTSISYKTLVLTTEVCSHSECTPTVITSVTATSSTIPLLSTSSSTVLSSTVSEGAKNPAASEVTINTQVSATSEATSTSTQVSATSATATASESSTTSQVSTASETISTLGTQNFTTTGSLLFPALSTEMINTTVVSRKTLIISTEVCSHSKCVPTVITEVVTSKGTPSNGHSSQTLQTEAVEVTLSSHQTVTMSTEVCSNSICTPTVITSVQMRSTPFPYLTSSTSSSSLASTKKSSLEASSEMSTFSVSTQSLPLAFTSSEKRSTTSVSQWSNTVLTNTIMSSSSNVISTNEKPSSTTSPYNFSSGYSLPSSSTPSQYSLSTATTTINGIKTVYTTWCPLAEKSTVAASSQSSRSVDRFVSSSKPSSSLSQTSIQYTLSTATTTISGLKTVYTTWCPLTSKSTLGATTQTSSTAKVRITSASSATSTSISLSTSTESESSSGYLSKGVCSGTECTQDVPTQSSSPASTLAYSPSVSTSSSSSFSTTTASTLTSTHTSVPLLPSSSSISASSPSSTSLLSTSLPSPAFTSSTLPTATAVSSSTFIASSLPLSSKSSLSLSPVSSSILMSQFSSSSSSSSSLASLPSLSISPTVDTVSVLQPTTSIATLTCTDSQCQQEVSTICNGSNCDDVTSTATTPPSTVTDTMTCTGSECQKTTSSSCDGYSCKVSETYKSSATISACSGEGCQASATSELNSQYVTMTSVITPSAITTTSVEVHSTESTISITTVKPVTYTSSDTNGELITITSSSQTVIPSVTTIITRTKVAITSAPKPTTTTYVEQRLSSSGIATSFVAAASSTWITTPIVSTYAGSASKFLCSKFFMIMVMVINFI

SEQ ID NO: 25411 - protein, 210 aa, Saccharomyces cerevisiae
  strain ATCC 204508 / S288c
MSVSKIAFVLSAIASLAVADTSAAETAELQAIIGDINSHLSDYLGLETGNSGFQIPSDVLSVYQQVMTYTDDAYTTLFSELDFDAITKTIVKLPWYTTRLSSEIAAALASVSPASSEAASSSEAASSSKAASSSEATSSAAPSSSAAPSSSAAPSSSAESSSKAVSSSVAPTTSSVSTSTVETASNAGQRVNAGAASFGAVVAGAAALLL

SEQ ID NO: 25412 - protein, 189 aa, Saccharomyces cerevisiae
  strain ATCC 204508 / S288c
MKAIDKMTDNPPQEGLSGRKIIYDEDGKPCRSCNTLLDFQYVTGKISNGLKNLSSNGKLAGTGALTGEASELMPGSRTYRKVDPPDVEQLGRSSWTLLHSVAASYPAQPTDQQKGEMKQFLNIFSHIYPCNWCAKDFEKYIRENAPQVESREELGRWMCEAHNKVNKKLRKPKFDCNFWEKRWKDGWDE

SEQ ID NO: 25413 - protein, 239 aa, Saccharomyces cerevisiae
  strain ATCC 204508 / S288c
MKFSTALSVALFALAKMVIADSEEFGLVSIRSGSDLQYLSVYSDNGTLKLGSGSGSFEATITDDGKLKFDDDKYAVVNEDGSFKEGSESDAATGFSIKDGHLNYKSSSGFYAIKDGSSYIFSSKQSDDATGVAIRPTSKSGSVAADFSPSDSSSSSSASASSASASSSTKHSSSIESVETSTTVETSSASSPTASVISQITDGQIQAPNTVYEQTENAGAKAAVGMGAGALAVAAAYLL

SEQ ID NO: 25414 - protein, 313 aa, Saccharomyces cerevisiae
  strain ATCC 204508 / S288c
MAPYPYKVQTTVPELQYENFDGAKFGYMFWPVQNGTNEVRGRVLLIHGFGEYTKIQFRLMDHLSLNGYESFTFDQRGAGVTSPGRSKGVTDEYHVFNDLEHFVEKNLSECKAKGIPLFMWGHSMGGGICLNYACQGKHKNEISGYIGSGPLIILHPHTMYNKPTQIIAPLLAKFLPRVRIDTGLDLKGITSDKAYRAFLGSDPMSVPLYGSFRQIHDFMQRGAKLYKNENNYIQKNFAKDKPVIIMHGQDDTINDPKGSEKFIQDCPSADKELKLYPGARHSIFSLETDKVFNTVFNDMKQWLDKHTTTEAKP

SEQ ID NO: 25415 - protein, 362 aa, Saccharomyces cerevisiae
  strain ATCC 204508 / S288c
MSRKFDLKTITDLSVLVGTGISLYYLVSRLLNDVESGPLSGKSRESKAKQSLQWEKLVKRSPALAEVTLDAYERTILSSIVTPDEINITFQDIGGLDPLISDLHESVIYPLMMPEVYSNSPLLQAPSGVLLYGPPGCGKTMLAKALAKESGANFISIRMSSIMDKWYGESNKIVDAMFSLANKLQPCIIFIDEIDSFLRERSSTDHEVTATLKAEFMTLWDGLLNNGRVMIIGATNRINDIDDAFLRRLPKRFLVSLPGSDQRYKILSVLLKDTKLDEDEFDLQLIADNTKGFSGSDLKELCREAALDAAKEYIKQKRQLIDSGTIDVNDTSSLKIRPLKTKDFTKKLRMDATSTLSSQPLD

SEQ ID NO: 25416 - protein, 562 aa, Saccharomyces cerevisiae
  strain ATCC 204508 / S288c
MSLLYIILLFTQFLLLPTDAFDRSANTNIAVYWGQNSAGTQESLATYCESSDADIFLLSFLNQFPTLGLNFANACSDTFSDGLLHCTQIAEDIETCQSLGKKVLLSLGGASGSYLFSDDSQAETFAQTLWDTFGEGTGASERPFDSAVVDGFDFDIENNNEVGYSALATKLRTLFAEGTKQYYLSAAPQCPYPDASVGDLLENADIDFAFIQFYNNYCSVSGQFNWDTWLTYAQTVSPNKNIKLFLGLPGSASAAGSGYISDTSLLESTIADIASSSSFGGIALWDASQAFSNELNGEPYVEILKNLLTSASQTATTTVATSKTSAASTSSASTSSASTSQKKTTQSTTSTQSKSKVTLSPTASSAIKTSITQTTKTLTSSTKTKSSLGTTTTESTLNSVAITSMKTTLSSQITSAALVTPQTTTTSIVSSAPIQTAITSTLSPATKSSSVVSLQTATTSTLSPTTTSTSSGSTSSGSTSSDSTARTLAKELNAQYAAGKLNGKSTCTEGEIACSADGKFAVCDHSAWVYMECASGTTCYAYDSGDSVYTQCNFSYLESNYF

SEQ ID NO: 25417 - protein, 87 aa, Saccharomyces cerevisiae
  strain ATCC 204508 / S288c
MVSQLFEEKAKAVNELPTKPSTDELLELYALYKQATVGDNDKEKPGIFNMKDRYKWEAWENLKGKSQEDAEKEYIALVDQLIAKYSS

SEQ ID NO: 25418 - protein, 725 aa, Saccharomyces cerevisiae
  strain ATCC 204508 / S288c
MTLSFAHFTYLFTILLGLTNIALASDPETILVTITKTNDANGVVTTTVSPALVSTSTIVQAGTTTLYTTWCPLTVSTSSAAEISPSISYATTLSRFSTLTLSTEVCSHEACPSSSTLPTTTLSVTSKFTSYICPTCHTTAISSLSEVGTTTVVSSSAIEPSSASIISPVTSTLSSTTSSNPTTTSLSSTSTSPSSTSTSPSSTSTSSSSTSTSSSSTSTSSSSTSTSPSSTSTSSSLTSTSSSSTSTSQSSTSTSSSSTSTSPSSTSTSSSSTSTSPSSKSTSASSTSTSSYSTSTSPSLTSSSPTLASTSPSSTSISSTFTDSTSSLGSSIASSSTSVSLYSPSTPVYSVPSTSSNVATPSMTSSTVETTVSSQSSSEYITKSSISTTIPSFSMSTYFTTVSGVTTMYTTWCPYSSESETSTLTSMHETVTTDATVCTHESCMPSQTTSLITSSIKMSTKNVATSVSTSTVESSYACSTCAETSHSYSSVQTASSSSVTQQTTSTKSWVSSMTTSDEDFNKHATGKYHVTSSGTSTISTSVSEATSTSSIDSESQEQSSHLLSTSVLSSSSLSATLSSDSTILLFSSVSSLSVEQSPVTTLQISSTSEILQPTSSTAIATISASTSSLSATSISTPSTSVESTIESSSLTPTVSSIFLSSSSAPSSLQTSVTTTEVSTTSISIQYQTSSMVTISQYMGSGSQTRLPLGKLVFAIMAVACNVIFS

SEQ ID NO: 25419 - protein, 120 aa, Saccharomyces cerevisiae
  strain ATCC 204508 / S288c
MKFISTFLTFILAAVSVTASSDEDIAQVPAEAIIGYLDFGGDHDIAFLPFSNATASGLLFINTTIAEAAEKEQNTTLAKREAVADAWHWLNLRPGQPMYKREANADAWHWLQLKPGQPMY

SEQ ID NO: 25420 - protein, 952 aa, Saccharomyces cerevisiae
  strain ATCC 204508 / S288c
MPIVRWLLLKSAVRGSSLIGKAHPCLRSIAAHPRYLSNVYSPPAGVSRSLRINVMWKQSKLTPPRFVKIMNRRPLFTETSHACAKCQKTSQLLNKTPNREILPDNVVPLHYDLTVEPDFKTFKFEGSVKIELKINNPAIDTVTLNTVDTDIHSAKIGDVTSSEIISEEEQQVTTFAFPKGTMSSFKGNAFLDIKFTGILNDNMAGFYRAKYEDKLTGETKYMATTQMEPTDARRAFPCFDEPNLKASFAITLVSDPSLTHLSNMDVKNEYVKDGKKVTLFNTTPKMSTYLVAFIVAELKYVESKNFRIPVRVYATPGNEKHGQFAADLTAKTLAFFEKTFGIQYPLPKMDNVAVHEFSAGAMENWGLVTYRVVDLLLDKDNSTLDRIQRVAEVVQHELAHQWFGNLVTMDWWEGLWLNEGFATWMSWYSCNEFQPEWKVWEQYVTDTLQHALSLDSLRSSHPIEVPVKKADEINQIFDAISYSKGASLLRMISKWLGEETFIKGVSQYLNKFKYGNAKTEDLWDALADASGKDVRSVMNIWTKKVGFPVISVSEDGNGKITFRQNRYLSTADVKPDEDKTIYPVFLALKTKNGVDSSVVLSERSKTIELEDPTFFKVNSEQSGIYITSYTDERWAKLGQQADLLSVEDRVGLVADVKTLSASGYTSTTNFLNLVSKWNNEKSFVVWDQIINSISSMKSTWLFEPKETQDALDNFTKQLISGMTHHLGWEFKSSDSFSTQRLKVTMFGAACAARDADVEKAALKMFTDYCSGNKEAIPALIKPIVFNTVARVGGAENYEKVYKIYLDPISNDEKLAALRSLGRFKEPKLLERTLGYLFDGTVLNQDIYIPMQGMRAHQEGVEALWNWVKKNWDELVKRLPPGLSMLGSVVTLGTSGFTSMQKIDEIKKFFATKSTKGFDQSLAQSLDTITSKAQWVNRDRDVVNKYLKENGYY

SEQ ID NO: 25421 - protein, 413 aa, Saccharomyces cerevisiae
  strain ATCC 204508 / S288c
MQYKKTLVASALAATTLAAYAPSEPWSTLTPTATYSGGVTDYASTFGIAVQPISTTSSASSAATTASSKAKRAASQIGDGQVQAATTTASVSTKSTAAAVSQIGDGQIQATTKTTAAAVSQIGDGQIQATTKTTSAKTTAAAVSQISDGQIQATTTTLAPKSTAAAVSQIGDGQVQATTTTLAPKSTAAAVSQIGDGQVQATTKTTAAAVSQIGDGQVQATTKTTAAAVSQIGDGQVQATTKTTAAAVSQIGDGQVQATTKTTAAAVSQITDGQVQATTKTTQAASQVSDGQVQATTATSASAAATSTDPVDAVSCKTSGTLEMNLKGGILTDGKGRIGSIVANRQFQFDGPPPQAGAIYAAGWSITPDGNLAIGDNDVFYQCLSGTFYNLYDEHIGSQCTPVHLEAIDLIDC

SEQ ID NO: 25422 - protein, 445 aa, Saccharomyces cerevisiae
  strain ATCC 204508 / S288c
MVSFRGLTTLTLLFTKLVNCNPVSTKNRDSIQFIYKEKDSIYSAINNQAINEKIHGVNLGGWLVLEPYITPSLFETFRTNPYNDDGIPVDEYHFCEKLGYEKAKERLYSHWSTFYKEEDFAKIASQGFNLVRIPIGYWAFTTLSHDPYVTAEQEYFLDRAIDWARKYGLKVWIDLHGAAGSQNGFDNSGLRDSYKFLEDENLSATMKALTYILSKYSTDVYLDTVIGIELLNEPLGPVIDMERLKNLLLKPAYDYLRNKINSNQIIVIHDAFQPYHYWDGFLNDEKNEYGVIIDHHHYQVFSQVELTRKMNERIKIACQWGKDAVSEKHWSVAGEFSAALTDCTKWLNGVGLGARYDGSWTKDNEKSHYINTCANNENIALWPEERKQNTRKFIEAQLDAFEMTGGWIMWCYKTENSIEWDVEKLIQLNIFPQPINDRKYPNQCH

SEQ ID NO: 25423 - protein, 467 aa, Saccharomyces cerevisiae
  strain ATCC 204508 / S288c
MAIVNSWLICLVSIFSFVVRVEAATFCNATQACPEDKPCCSQYGECGTGQYCLNNCDVRYSFSHDSCMPVPICKSSSTKFKDYSSKLGNANTFLGNVSEADWLYTGDVLDYDDEESLILAMPKNSGGTVLSSTRAVWYGKVSARIKTSHLAGVVTGFILYSGAGDELDYEFVGADLETAQTNFYWESVLNYTNSANISTTDTFENYHTYELDWHEDYVTWSIDGVVGRTLYKNETYNATTQKYQYPQTPSKVDISIWPGGNSTNAPGTIAWSGGEINWDASDISNPGYYYAIVNEVNITCYDPPSDTKKNGTSAYVYTSSSEFLAKDIAITDDEVMMDSDEGSGLDPHKGATTSSTQKSSSSTATSSSKTSSDHSSSTKKSSKTSSTASSSSSSSSSSSSSSSTATKNGDKVVSSVSSSVTSQTQTTSSVSGSASSSTSSMSGNNAGANVAANWRLTVLCVILGYVL

SEQ ID NO: 25424 - protein, 1537 aa, Saccharomyces cerevisiae
  strain ATCC 204508 / S288c
MTMPHRYMFLAVFTLLALTSVASGATEACLPAGQRKSGMNINFYQYSLKDSSTYSNAAYMAYGYASKTKLGSVGGQTDISIDYNIPCVSSSGTFPCPQEDSYGNWGCKGMGACSNSQGIAYWSTDLFGFYTTPTNVTLEMTGYFLPPQTGSYTFKFATVDDSAILSVGGATAFNCCAQQQPPITSTNFTIDGIKPWGGSLPPNIEGTVYMYAGYYYPMKVVYSNAVSWGTLPISVTLPDGTTVSDDFEGYVYSFDDDLSQSNCTVPDPSNYAVSTTTTTTEPWTGTFTSTSTEMTTVTGTNGVPTDETVIVIRTPTTASTIITTTEPWNSTFTSTSTELTTVTGTNGVRTDETIIVIRTPTTATTAITTTEPWNSTFTSTSTELTTVTGTNGLPTDETIIVIRTPTTATTAMTTTQPWNDTFTSTSTELTTVTGTNGLPTDETIIVIRTPTTATTAMTTTQPWNDTFTSTSTELTTVTGTNGLPTDETIIVIRTPTTATTAMTTTQPWNDTFTSTSTEITTVTGTNGLPTDETIIVIRTPTTATTAMTTPQPWNDTFTSTSTEMTTVTGTNGLPTDETIIVIRTPTTATTAITTTEPWNSTFTSTSTEMTTVTGTNGLPTDETIIVIRTPTTATTAITTTQPWNDTFTSTSTEMTTVTGTNGLPTDETIIVIRTPTTATTAMTTTQPWNDTFTSTSTEITTVTGTTGLPTDETIIVIRTPTTATTAMTTTQPWNDTFTSTSTEMTTVTGTNGVPTDETVIVIRTPTSEGLISTTTEPWTGTFTSTSTEMTTVTGTNGQPTDETVIVIRTPTSEGLVTTTTEPWTGTFTSTSTEMTTITGTNGVPTDETVIVIRTPTSEGLISTTTEPWTGTFTSTSTEMTTITGTNGQPTDETVIVIRTPTSEGLISTTTEPWTGTFTSTSTEMTHVTGTNGVPTDETVIVIRTPTSEGLISTTTEPWTGTFTSTSTEVTTITGTNGQPTDETVIVIRTPTSEGLISTTTEPWTGTFTSTSTEMTTVTGTNGQPTDETVIVIRTPTSEGLVTTTTEPWTGTFTSTSTEMSTVTGTNGLPTDETVIVVKTPTTAISSSLSSSSSGQITSSITSSRPIITPFYPSNGTSVISSSVISSSVTSSLFTSSPVISSSVISSSTTTSTSIFSESSKSSVIPTSSSTSGSSESETSSAGSVSSSSFISSESSKSPTYSSSSLPLVTSATTSQETASSLPPATTTKTSEQTTLVTVTSCESHVCTESISPAIVSTATVTVSGVTTEYTTWCPISTTETTKQTKGTTEQTTETTKQTTVVTISSCESDVCSKTASPAIVSTSTATINGVTTEYTTWCPISTTESRQQTTLVTVTSCESGVCSETASPAIVSTATATVNDVVTVYPTWRPQTANEESVSSKMNSATGETTTNTLAAETTTNTVAAETITNTGAAETKTVVTSSLSRSNHAETQTASATDVIGHSSSVVSVSETGNTKSLTSSGLSTMSQQPRSTPASSMVGYSTASLEISTYAGSANSLLAGSGLSVFIASLLLAII

SEQ ID NO: 25425 - protein, 385 aa, Saccharomyces cerevisiae
  strain ATCC 204508 / S288c
MAWSGGKDIVDQIFDAGYWLVSKSAVLSDEIKNHVEKSIESISGKISNKETPRLQENDSNRSKVYKTLRIGLQDHWKLGLGISATSLCLYLGYRTFFKLPPNLPEAESQVVLILGDMNDPIIRNQVMDLYRRRFTVYICTENADVYKKHEEDQDFIYYIDPTCEKDFEGFFVDVPRLASILFMPRLSYHPSGVISCDSLESEIHSSIFVYYQALLSIIPHLKRKTQLIMFNPSLTADLNLVHHSTEIITSGIIDSLFKIFKEYQRLNVSTIKLGILQIGSQPSNYKFLRMAGSDIHEALHYPVYKMIMSANGYKLRQLLSWLTTLGGYNSVYYCGRFSYLVSWPFASLIFNHHTRLSLKRLRGRLAKVYSSIISFFCRSSSKSSK

SEQ ID NO: 25426 - protein, 989 aa, Saccharomyces cerevisiae
  strain ATCC 204508 / S288c
MLRFQRFASSYAQAQAVRKYPVGGIFHGYEVRRILPVPELRLTAVDLVHSQTGAEHLHIDRDDKNNVFSIAFKTNPPDSTGVPHILEHTTLCGSVKYPVRDPFFKMLNKSLANFMNAMTGPDYTFFPFSTTNPQDFANLRGVYLDSTLNPLLKQEDFDQEGWRLEHKNITDPESNIVFKGVVYNEMKGQISNANYYFWSKFQQSIYPSLNNSGGDPMKITDLRYGDLLDFHHKNYHPSNAKTFTYGNLPLVDTLKQLNEQFSGYGKRARKDKLLMPIDLKKDIDVKLLGQIDTMLPPEKQTKASMTWICGAPQDTYDTFLLKVLGNLLMDGHSSVMYQKLIESGIGLEFSVNSGVEPTTAVNLLTVGIQGVSDIEIFKDTVNNIFQNLLETEHPFDRKRIDAIIEQLELSKKDQKADFGLQLLYSILPGWTNKIDPFESLLFEDVLQRFRGDLETKGDTLFQDLIRKYIVHKPCFTFSIQGSEEFSKSLDDEEQTRLREKITALDEQDKKNIFKRGILLQEKQNEKEDLSCLPTLQIKDIPRAGDKYSIEQKNNTMSRITDTNGITYVRGKRLLNDIIPFELFPYLPLFAESLTNLGTTTESFSEIEDQIKLHTGGISTHVEVTSDPNTTEPRLIFGFDGWSLNSKTDHIFEFWSKILLETDFHKNSDKLKVLIRLLASSNTSSVADAGHAFARGYSAAHYRSSGAINETLNGIEQLQFINRLHSLLDNEETFQREVVDKLTELQKYIVDTNNMNFFITSDSDVQAKTVESQISKFMERLPHGSCLPNGPKTSDYPLIGSKCKHTLIKFPFQVHYTSQALLGVPYTHKDGSALQVMSNMLTFKHLHREVREKGGAYGGGASYSALAGIFSFYSYRDPQPLKSLETFKNSGRYILNDAKWGVTDLDEAKLTIFQQVDAPKSPKGEGVTYFMSGVTDDMKQARREQLLDVSLLDVHRVAEKYLLNKEGVSTVIGPGIEGKTVSPNWEVKEL

SEQ ID NO: 25427 - protein, 61 aa, Saccharomyces cerevisiae
  strain ATCC 204508 / S288c
MDGMFAMPGAAAGAASPQQPKSRFQAFKESPLYTIALNGAFFVAGVAFIQSPLMDMLAPQL

SEQ ID NO: 25428 - protein, 251 aa, Saccharomyces cerevisiae
  strain ATCC 204508 / S288c
MAYIKIALLAAIAALASAQTQEEIDELNVILNDVKSNLQEYISLAEDSSSGFSLSSLPSGVLDIGLALASATDDSYTTLYSEVDFAAVSKMLTMVPWYSSRLLPELESLLGTSTTAASSTEASSAATSSAVASSSETTSSAVASSSEATSSAVASSSEASSSAATSSAVASSSEATSSTVASSTKAASSTKASSSAVSSAVASSTKASAISQISDGQVQATSTVSEQTENGAAKAVIGMGAGVMAAAAMLL

SEQ ID NO: 25429 - protein, 36 aa, Saccharomyces cerevisiae
  strain ATCC 204508 / S288c
MQPSTATAAPKEKTSSEKKDNYIIKGVFWDPACVIA

SEQ ID NO: 25430 - protein, 38 aa, Saccharomyces cerevisiae
  strain ATCC 204508 / S288c
MQPITTASTQATQKDKSSEKKDNYIIKGLFWDPACVIA

SEQ ID NO: 25431 - protein, 183 aa, Saccharomyces cerevisiae
  strain ATCC 204508 / S288c
MSQSNPILRGLAITTAIAALSATGYAIYFDYQRRNSPQFRKVLRQRAKEQAKMEEQAKTHAKEVKLQKVTEFLSMELAKDPIPSDPSEREATFTTNVENGERLSMQQGKELEAASKFYKALTVYPQPADLLGIYQRSIPEAIYEYIILMIAILPPANVASFVKGVVGSKAESDAVAEANDIDD

SEQ ID NO: 25432 - protein, 230 aa, Saccharomyces cerevisiae
  strain ATCC 204508 / S288c
MKLFQNSYDFNYPWDQVTAANWKKYPNEISTHVIAVDVLRRELKDQGKVLVTERLITVKQGVPKWIMMMLGGTNMSHVREVSVVDLNKKSLTMRSCNLTMCNLLKVYETVTYSPHPDDSANKTLFQQEAQITAYGSIRKLCNKMEDWSVQRFCENAKKGKMGFDAVLQVFSENWEKHVDDLSNQLVSKVNETMEDVKISAGTLLKGTERSGRTILQQNIDLFRDAYNHEN

SEQ ID NO: 25433 - protein, 467 aa, Saccharomyces cerevisiae
  strain ATCC 204508 / S288c
MLKSAVYSILAASLVNAGTIPLGKLSDIDKIGTQTEIFPFLGGSGPYYSFPGDYGISRDLPESCEMKQVQMVGRHGERYPTVSKAKSIMTTWYKLSNYTGQFSGALSFLNDDYEFFIRDTKNLEMETTLANSVNVLNPYTGEMNAKRHARDFLAQYGYMVENQTSFAVFTSNSNRCHDTAQYFIDGLGDKFNISLQTISEAESAGANTLSAHHSCPAWDDDVNDDILKKYDTKYLSGIAKRLNKENKGLNLTSSDANTFFAWCAYEINARGYSDICNIFTKDELVRFSYGQDLETYYQTGPGYDVVRSVGANLFNASVKLLKESEVQDQKVWLSFTHDTDILNYLTTIGIIDDKNNLTAEHVPFMENTFHRSWYVPQGARVYTEKFQCSNDTYVRYVINDAVVPIETCSTGPGFSCEINDFYDYAEKRVAGTDFLKVCNVSSVSNSTELTFFWDWNTKHYNDTLLKQ

SEQ ID NO: 25434 - protein, 1188 aa, Saccharomyces cerevisiae
  strain ATCC 204508 / S288c
MEQPDLSSVAISKPLLKLKLLDALRQGSFPNLQDLLKKQFQPLDDPNVQQVLHLMLHYAVQVAPMAVIKEIVHHWVSTTNTTFLNIHLDLNERDSNGNTPLHIAAYQSRGDIVAFLLDQPTINDCVLNNSHLQAIEMCKNLNIAQMMQVKRSTYVAETAQEFRTAFNNRDFGHLESILSSPRNAELLDINGMDPETGDTVLHEFVKKRDVIMCRWLLEHGADPFKRDRKGKLPIELVRKVNENDTATNTKIAIDIELKKLLERATREQSVIDVTNNNLHEAPTYKGYLKKWTNFAQGYKLRWFILSSDGKLSYYIDQADTKNACRGSLNMSSCSLHLDSSEKLKFEIIGGNNGVIRWHLKGNHPIETNRWVWAIQGAIRYAKDREILLHNGPYSPSLALSHGLSSKVSNKENLHATSKRLTKSPHLSKSTLTQNDHDNDDDSTNNNNNKSNNDYDDNNNNNNNDDDDYDDDDESRPLIEPLPLISSRSQSLSEITPGPHSRKSTVSSTRAADIPSDDEGYSEDDSDDDGNSSYTMENGGENDGDEDLNAIYGPYIQKLHMLQRSISIELASLNELLQDKQQHDEYWNTVNTSIETVSEFFDKLNRLTSQREKRMIAQMTKQRDVNNVWIQSVKDLEMELVDKDEKLVALDKERKNLKKMLQKKLNNQPQVETEANEESDDANSMIKGSQESTNTLEEIVKFIEATKESDEDSDADEFFDAEEAASDKKANDSEDLTTNKETPANAKPQEEAPEDESLIVISSPQVEKKNQLLKEGSFVGYEDPVRTKLALDEDNRPKIGLWSVLKSMVGQDLTKLTLPVSFNEPTSLLQRVSEDIEYSHILDQAATFEDSSLRMLYVAAFTASMYASTTNRVSKPFNPLLGETFEYARTDGQYRFFTEQVSHHPPISATWTESPKWDFYGECNVDSSFNGRTFAVQHLGLWYITIRPDHNISVPEETYSWKKPNNTVIGILMGKPQVDNSGDVKVTNHTTGDYCMLHYKAHGWTSAGAYEVRGEVFNKDDKKLWVLGGHWNDSIYGKKVTARGGELTLDRIKTANSATGGPKLDGSKFLIWKANERPSVPFNLTSFALTLNALPPHLIPYLAPTDSRLRPDQRAMENGEYDKAAAEKHRVEVKQRAAKKEREQKGEEYRPKWFVQEEHPVTKSLYWKFNGEYWNKRKNHDFKDCADIF

SEQ ID NO: 25435 - protein, 116 aa, Saccharomyces cerevisiae
  strain ATCC 204508 / S288c
MIETAIYGKTVDDQSRCVHWHLPKDVIAIRFKCCDKYYACFECHQELSSHPLEKYDLLDDANKHLIICGVCRHEMTFAEYYDYNSNLICPNCRSPFNPGCKLHYHLYFQNPPPAMC

SEQ ID NO: 25436 - protein, 447 aa, Saccharomyces cerevisiae
  strain ATCC 204508 / S288c
MVEKDTWKLITATALFTVAVTTITDYAWTSWQAQKQVIAQQKNKNKGGQTKSDTDKYHQYDEQFIRQSLKNNVEFLGEDTIEKLSNQYVVVVGAGGVGSWVVNSLVRSGCRKIRVVDFDQVSLSSLNRHSCAILNDVGTPKVECLRRHMREIAPWCEIDPINELWTLQNGERLTLGNGTPDFIVDCIDNIDTKVDLLEFAYNHGIKVISSMGASAKSDPTKLNVGDLATTEEDPLARVVRRKLKKRGILSGIPVVFSAEKPDPKKAKLLPLPDEEYERGKVDELSALKDFRVRILPVLGTMPSLFGLTITTWILSNISDKPLEPVEGKNRIKVYDGIYQSLAGQMSRVGIPSQRIPLALKDVSYLVEEVFKGKSPISGISTRLTLTKWDPSKPISLQNVVVLTKNEQKVHEDRVLKGKESLQDVYDAKVLKLVSQRFREEAYYSQFR

SEQ ID NO: 25437 - protein, 329 aa, Saccharomyces cerevisiae
  strain ATCC 204508 / S288c
MKFSKVSLLAASASVALSAPVAVTVTQHVHQAATVVVQGIVRVENGQTLTTFITKGTQTASASPVATTSAPIVVANAQVDSIATSVIQESAVVAESATFEESSTETSEAFSTATATIQAVQTSASATQDDVTTTLTSSTQPTSTTTPTTTTTSPTTTTSPTTTASPTTTASPTTATTTQSTASSTQSSSSDFSTSMVNEHNTKRALHKDTGSLTWSDTLATYAQNYADSYDCSGNLVHSGGPYGENLALGYGTTGSVDAWYNEITSYDYSNPGFSESAGHFTQVVWKGTSEVGCGLKSCGGEWGDYIICSYKAAGNVIGEFADNVMPLA

SEQ ID NO: 25438 - protein, 725 aa, Saccharomyces cerevisiae
  strain ATCC 204508 / S288c
MFKVFGFGAKEEIPELSQEEKTKAILKQAHDFEQALRAMDYVLDDNADEGLALLDESDAKEASDQTINALARGVIEFLEATLGFEAEEMKKASATLAKAEALSLKSRERAQKIGLKSSSLYPPGTVYAVTYTESCLLHALLMIFSESMMEAAKAILKLRKSYYMLQEILETIKAANKAKKLKITSGSEDKESTPATFITGGDAFNSVDIPYELTPEEQKDKDLLQFAEQIHSMRTERLSGAHIGNSPAINRLRGELGLQAMEDLPEEEITDHKVLSDDIDLSQATIDEFVHSGVNLCFGILQVVISLLPPAIGAVLSVVGFRGSREEGLRLVWKATKQRNVHGCIGLLALMFYYDGPFQFTDDDFDIPAAVKDSSNSEDSEDEEMDGPTLLHPGKILEDALLQSRALFPNSALWLLNEARMLSGKGRLEEAVALMDSIDVSKIRMRQVKSLMIFDRAITLIHLHQYDRAAEDILSLLDISDWSHAFYTYFAGCCYLENWRMCEMGLMKSDKKDEYQKKAEELIFTSVNLLGKKTFKSKNLPLDRFILRKVEQFKAKKEELGVENPLDGIATSPVHEIAYFYNGYNRMSEEHLELTKKMLTEYRNPAIEALDSDQELIKDLLVSLTLRRLGHIQEGCDILDEKVLPKFFSIQNGKVKYIKKTEDPWAYPTALYERALFTWKLEGMDGLPESKEWLLRAQGYADDYELSTRVGMKIKAAIDRVDHSL

SEQ ID NO: 25439 - protein, 643 aa, Saccharomyces cerevisiae
  strain ATCC 204508 / S288c
MGSGDTRGESSLVAKPIEIILNKLPHAILAQQQFQKYITSPIYRYLSKLLLFREVAWPESTKDTQKGQVGIFSFQNNYADSATTFRILAHLDEQRYPLPNGAAEKNLPSLFEGFKATVSIIQQRLLLDNVDGATNSDKEKYVQLPDINTGFVNKTYSRIDLTHLLEDVETNVENLSINKTLEMDELTRLDSMINELESRKLKILERVKHIDSKSTNLENDVTLIKDRINFIEEYNLEADREQSLRKQMEEERSSEASSFTQNEEAISSLCDVESKDTRLKDFYKMPHEKSHDKNRQIISETYSRNTTAFRMTIPHGEHGNSITALDFDTPWGTLCSSSYQDRIVKVWDLNHGIQVGELPGHLATVNCMQIDKKNYNMLITGSKDATLKLWDLNLSREIYLDHSPLKEKTEEIVTPCIHNFELHKDEITALSFDSEALVSGSRDKKIFHWDLTTGKCIQQLDLIFTPTHSDIKMPARSLNNGACLLGTEAPMIGALQCYNSALATGTKDGIVRLWDLRVGKPVRLLEGHTDGITSLKFDSEKLVTGSMDNSVRIWDLRTSSILDVIAYDLPVSSLDFDGKLITVGANEGGVNVFNMERDEHWMTPEPPHSLDGDELSRRIAIVKYKDGFLINGHNDGDINVWTL

SEQ ID NO: 25440 - protein, 365 aa, Saccharomyces cerevisiae
  strain ATCC 204508 / S288c
MKLSALLALSASTAVLAAPAVHHSDNHHHNDKRAVVTVTQYVNADGAVVIPAATTATSAAADGKVESVAAATTTLSSTAAAATTSAAASSSSSSSSSSSSSSSVGSGDFEDGTISCSDFPSGQGAVSLDWLGLGGWASIMDMNGNTATSCQDGYYCSYACSPGYAKTQWPSEQPSDGRSVGGLYCKNGKLYRSNTDTNSLCVEGQGSAQAVNKVSGSIAICGTDYPGSENMVVPTVVGAGSSQPINVIKEDSYYQWQGKKTSAQYYVNNAGVSVEDGCIWGTEGSGVGNWAPVVLGAGYTDGITYLSIIPNPNNKEAPNFNIKIVATDGSTVNGACSYENGVYSGSGSDGCTVSVTSGSANFVFY

SEQ ID NO: 25441 - protein, 348 aa, Saccharomyces cerevisiae
  strain ATCC 204508 / S288c
MSQYKTGLLLIHPAVTTTPELVENTKAQAASKKVKFVDQFLINKLNDGSITLENAKYETVHYLTPEAQTDIKFPKKLISVLADSLKPNGSLIGLSDIYKVDALINGFEIINEPDYCWIKMDSSKLNQTVSIPLKKKKTNNTKLQSGSKLPTFKKASSSTSNLPSFKKADHSRQPIVKETDSFKPPSFKMTTEPKVYRVVDDLIEDSDDDDFSSDSSKAQYFDQVDTSDDSIEEEELIDEDGSGKSMITMITCGKSKTKKKKACKDCTCGMKEQEENEINDIRSQQDKVVKFTEDELTEIDFTIDGKKVGGCGSCSLGDAFRCSGCPYLGLPAFKPGQPINLDSISDDL

SEQ ID NO: 25442 - protein, 1169 aa, Saccharomyces cerevisiae
  strain ATCC 204508 / S288c
MPVAARYIFLTGLFLLSVANVALGTTEACLPAGEKKNGMTINFYQYSLKDSSTYSNPSYMAYGYADAEKLGSVSGQTKLSIDYSIPCNGASDTCACSDDDATEYSASQVVPVKRGVKLCSDNTTLSSKTEKRENDDCDQGAAYWSSDLFGFYTTPTNVTVEMTGYFLPPKTGTYTFGFATVDDSAILSVGGNVAFECCKQEQPPITSTDFTINGIKPWNADAPTDIKGSTYMYAGYYYPIKIVYSNAVSWGTLPVSVVLPDGTEVNDDFEGYVFSFDDNATQAHCSVPNPAEHARTCVSSATSSWSSSEVCTECTETESTSYVTPYVTSSSWSSSEVCTECTETESTSTSTPYVTSSSSSSSEVCTECTETESTSYVTPYVSSSTAAANYTSSFSSSSEVCTECTETESTSTSTPYVTSSSWSSSEVCTECTETESTSYVTPYVSSSTAAANYTSSFSSSSEVCTECTETESTSTSTPYVTSSSSSSSEVCTECTETESTSYVTPYVSSSTAAANYTSSFSSSSEVCTECTETESTSTSTPYVTSSSWSSSEVCTECTETESTSYVTPYVSSSTAAANYTSSFSSSSEVCTECTETESTSTSTPYATSSTGTATSFTASTSNTMTSLVQTDTTVSFSLSSTVSEHTNAPTSSVESNASTFISSNKGSVKSYVTSSIHSITPMYPSNQTVTSSSVVSTPITSESSESSASVTILPSTITSEFKPSTMKTKVVSISSSPTNLITSYDTTSKDSTVGSSTSSVSLISSISLPSSYSASSEQIFHSSIVSSNGQALTSFSSTKVSSSESSESHRTSPTTSSESGIKSSGVEIESTSTSSFSFHETSTASTSVQISSQFVTPSSPISTVAPRSTGLNSQTESTNSSKETMSSENSASVMPSSSATSPKTGKVTSDETSSGFSRDRTTVYRMTSETPSTNEQTTLITVSSCESNSCSNTVSSAVVSTATTTINGITTEYTTWCPLSATELTTVSKLESEEKTTLITVTSCESGVCSETASPAIVSTATATVNDVVTVYSTWSPQATNKLAVSSDIENSASKASFVSEAAETKSISRNNNFVPTSGTTSIETHTTTTSNASENSDNVSASEAVSSKSVTNPVLISVSQQPRGTPASSMIGSSTASLEMSSYLGIANHLLTNSGISIFIASLLLAIV

SEQ ID NO: 25443 - protein, 120 aa, Saccharomyces cerevisiae
  strain ATCC 204508 / S288c
MVKLTSIAAGVAAIAATASATTTLAQSDERVNLVELGVYVSDIRAHLAQYYSFQVAHPTETYPVEIAEAVFNYGDFTTMLTGIAPDQVTRMITGVPWYSSRLKPAISSALSKDGIYTIAN

SEQ ID NO: 25444 - protein, 429 aa, Saccharomyces cerevisiae
  strain ATCC 204508 / S288c
MQFKNALTATAILSASALAANSTTSIPSSCSIGTSATATAQADLDKISGCSTIVGNLTITGDLGSAALASIQEIDGSLTIFNSSSLSSFSADSIKKITGDLNMQELIILTSASFGSLQEVDSINMVTLPAISTFSTDLQNANNIIVSDTTLESVEGFSTLKKVNVFNINNNRYLNSFQSSLESVSDSLQFSSNGDNTTLAFDNLVWANNITLRDVNSISFGSLQTVNASLGFINNTLPSLNLTQLSKVGQSLSIVSNDELSKAAFSNLTTVGGGFIIANNTQLKVIDGFNKVQTVGGAIEVTGNFSTLDLSSLKSVRGGANFDSSSSNFSCNALKKLQSNGAIQGDSFVCKNGATSTSVKLSSTSTESSKSSATSSASSSGDASNAQANVSASASSSSSSSKKSKGAAPELVPATSFMGVVAAVGVALL

SEQ ID NO: 25445 - protein, 455 aa, Saccharomyces cerevisiae
  strain ATCC 204508 / S288c
MLQKLSMTALVGLFSSVVSLVNADCTYSGGNYYCAQTDAIIYSNVGLSATYQDVTNMDESSCACTQADFTASGSLAPFNEELSVHFRGPIELLQFGVYYPNGESNALKKRSEKQSIESCKEGEAVVSRHKHQHKRDVAVEYVQVTSTVYVDSNGQTVTADSTNTVVGPAVPSSYTKDSTVLSSSAQAVETSESQSSISSSKTTSSAAAASSSSSSSSNTNGDWSRGSYFVPGSTSNCTFMNNQGGTAGSGVWSSCFGNSISFAASDGVSGAASAQALGDVTIKSGNEFMIFSGEECSGNNGDCGYYREGIPAYHGFGGADKIFVFEFSMPSDTSGSAYNQDMPAIWLLNAKIPRTLQYGDASCSCWKTGCGEMDLFEILTAGSDKLISHIHDGQDGGTQDYFERPTDGTLKAAVIFNSSDKTIHIIEVDESFDATLSDDVVDQWLSKSGSSAALP

SEQ ID NO: 25446 - protein, 855 aa, Saccharomyces cerevisiae
  strain ATCC 204508 / S288c
MSEGKQQFKDSNKPHKDSTDQDDDAATIVPQTLTYSRNEGHFLGSNFHGVTDDRTTLFDGEEGRREDDLLPSLRSSNSKAHLISSQLSQWNYNNNRVLLKRSILKTQAFMDQLQEENNIRPIFIAANDEREKLHVLQLNIKLDGQYNTKEKNGFNIEKKALSKLFHSQIVSVTNHLNALKKRVDDVSSKVFITGDVNTGKSALCNSLLKQRLLPEDQLPCTNVFSEILEARENDGIEEVHAIPLNIAPTLKEAIDMYSIQNPKTYEIHTLKELPDLVPQNGKYALLKIYIKDDKRPASTSLLRNGTVDISLIDSPGLNMDSLQTAEVMSRQEEIDLVIFVVNAENQLTLSAKEFISLASREKKLMFFVVKKFDKIRDKQRCKELILKQIRDLSPETYKRAADFVHFVSKNGDELPHYHNENDNEDHGDRKPDDDPYSSSDPDPDFDSLEDSLRNFVLKKRSLSKLLPAKTYLSKLLSDIIMISKSNMKMYSEEEIKINEQLETLRPEILSARAKCNDLTTSVDQMAEQTITMTYNNTKEALLNALDVPLHEYPKYQGLGQIYDFIFSTEAFIANQIDESIGSSELFAKQKTDLLVKKIYEIGKNELGDDFMCERVFRSELMFRKRKHLIGKRLKVSLSITDLFAPTWKGFLSYLSWQKPVTAPLPDIEGQTNEGQIGLMKYLGLKNYPLTQYWSRPSLLFTSKIPTLTLYFLGSTKVVGNIILNGIKLSSWSSLKKLSVPVIVVGSLLGLTYLIHDLPRALPMNLSIKYKRKLQELDYIHLNAQRTSNEVRDVLRVPTREILRSCEIIMDKKQITKKELENKKESNLLSIKFFQSLYEGTVAQKLMVEEINLDID

SEQ ID NO: 25447 - protein, 134 aa, Saccharomyces cerevisiae
  strain ATCC 204508 / S288c
MSATAKHDSNASPNSDSEDGHHHNNKKECAIEYLKARLNSASAVACGYLQAFVSKTQDFAKVCFLELQNPVVLVNLLLHSSVVCYLCNGYANHNARFLKGKPNSTVLATTAGALGLLTLDGIISKKYYSRYDKK

SEQ ID NO: 25448 - protein, 354 aa, Saccharomyces cerevisiae
  strain ATCC 204508 / S288c
MKFQVVLSALLACSSAVVASPIENLFKYRAVKASHSKNINSTLPAWNGSNSSNVTYANGTNSTTNTTTAESSQLQIIVTGGQVPITNSSLTHTNYTRLFNSSSALNITELYNVARVVNETIQDKSSAGAVVVANAKSLEAVSFFFSIIFDTEKPIVVTEDSAYAIPVANNKNATKRGVLSVTSDKLVYSGVFTPPTACSYGAGLPVAIVDDQDEVKWFFDASKPTLISSDSIIRKEYSNFTTPYGLLENGVPIVPIVYDGGYSSSLIDSLSSAVQGLVVVSSGSTNSTSSTIESTEIPVVYAQANTPLNFIDNKDVPKNAVGAGYLSPIKAQILLSIAAVNGVTSKSALESIFP

SEQ ID NO: 25449 - protein, 284 aa, Saccharomyces cerevisiae
  strain ATCC 204508 / S288c
MAIDAQKLVVVIVIVVVPLLFKFIIGPKTKPVLDPKRNDFQSFPLVEKTILTHNTSMYKFGLPHADDVLGLPIGQHIVIKANINGKDITRSYTPTSLDGDTKGNFELLVKSYPTGNVSKMIGELKIGDSIQIKGPRGNYHYERNCRSHLGMIAGGTGIAPMYQIMKAIAMDPHDTTKVSLVFGNVHEEDILLKKELEALVAMKPSQFKIVYYLDSPDREDWTGGVGYITKDVIKEHLPAATMDNVQILICGPPAMVASVRRSTVDLGFRRSKPLSKMEDQVFVF

SEQ ID NO: 25450 - protein, 151 aa, Saccharomyces cerevisiae
  strain ATCC 204508 / S288c
MEKPSPTRRQTSSLSTISNGMTMTNDNRDTTNTNSGSTSSNNSQPSSSSTPPAASGPVTDRTKVNYVPKSDDPSSFQYYPDDPENPVNKYKFALKADSQYYDPCEESSKLSFQCLERNDYDRSKCQEYFDAYRECKKQWLTARRKNRQQWE

SEQ ID NO: 25451 - protein, 639 aa, Saccharomyces cerevisiae
  strain ATCC 204508 / S288c
MAENSLLRFITKNKVAILATVSAGTAAVGAYVYYQQIKQQQQQQLKGTKDNRRQSEAFAGQNEDEADLKDDGSVVSGSNKRKKKKNKRKRNNKAKSGEGFDYPSLPNGEPDIAQLKGLSPSQRQAYAVQLKNRGNHFFTAKNFNEAIKYYQYAIELDPNEPVFYSNISACYISTGDLEKVIEFTTKALEIKPDHSKALLRRASANESLGNFTDAMFDLSVLSLNGDFDGASIEPMLERNLNKQAMKVLNENLSKDEGRGSQVLPSNTSLASFFGIFDSHLEVSSVNTSSNYDTAYALLSDALQRLYSATDEGYLVANDLLTKSTDMYHSLLSANTVDDPLRENAALALCYTGIFHFLKNNLLDAQVLLQESINLHPTPNSYIFLALTLADKENSQEFFKFFQKAVDLNPEYPPTYYHRGQMYFILQDYKNAKEDFQKAQSLNPENVYPYIQLACLLYKQGKFTESEAFFNETKLKFPTLPEVPTFFAEILTDRGDFDTAIKQYDIAKRLEEVQEKIHVGIGPLIGKATILARQSSQDPTQLDEEKFNAAIKLLTKACELDPRSEQAKIGLAQLKLQMEKIDEAIELFEDSAILARTMDEKLQATTFAEAAKIQKRLRADPIISAKMELTLARYRAKGML

SEQ ID NO: 25452 - protein, 325 aa, Saccharomyces cerevisiae
  strain ATCC 204508 / S288c
MKFNFSTIFNILFFLFTLIEANSNGETVKLITSDGIVYSYAVYTKTLAPARVVVKTISYTTTRVYPITLANSVVSSTTEKITEVSTVSASEQVSATQTNSLVSTSTVSTISPTISSGSSTSSSSTYDIESSQSIESSGTSSATAEPSASSGFRLTSSSAFVSSTAPFSSQLSSSSSSETSSSSFSTSSSSAPLSLTSSSSSSSSFATIITLAPSSSKSGNSQLTLASSSSTSAVESSQTGSTIARTTSTLVPSSSVDTTSRATTSMPLESSSTQSISVSSSDGTCYVFYDDDDYYSTVYLTNPSQSVDAATTITSTNTIYATVTI

SEQ ID NO: 25453 - protein, 321 aa, Saccharomyces cerevisiae
  strain ATCC 204508 / S288c
MTRPPLVRGIFSLGLSVAVLKGVEKTVRKHLERQGWIEPQKVDYELIFTIDRLKNLVDNKREALTAEQPDAGELSWRKVFNFISRQSSELDTRIYVLILLLSFLLPIAWTVLDGDRETTLEDKDNDCNVDLIENERRLKHYNDGERAVLQFGKNRSEPIILSYKDMNVLEGEHEFTSKEEHSNSHLTSKSENALNQVGSEDLLGCHLEKQLEEDKNEPNGEADGEDDNNREKDCSSSSEVESQSKCRKESTAEPDSLSRDTRTTSSLKSSTSFPISFKGSIDLKSLNQPSSLLHIQVSPTKSSNLDAQVNTEQAYSQPFRY

SEQ ID NO: 25454 - protein, 1075 aa, Saccharomyces cerevisiae
  strain ATCC 204508 / S288c
MTIAHHCIFLVILAFLALINVASGATEACLPAGQRKSGMNINFYQYSLKDSSTYSNAAYMAYGYASKTKLGSVGGQTDISIDYNIPCVSSSGTFPCPQEDSYGNWGCKGMGACSNSQGIAYWSTDLFGFYTTPTNVTLEMTGYFLPPQTGSYTFSFATVDDSAILSVGGSIAFECCAQEQPPITSTNFTINGIKPWDGSLPDNITGTVYMYAGYYYPLKVVYSNAVSWGTLPISVELPDGTTVSDNFEGYVYSFDDDLSQSNCTIPDPSIHTTSTITTTTEPWTGTFTSTSTEMTTITDTNGQLTDETVIVIRTPTTASTITTTTEPWTGTFTSTSTEMTTVTGTNGQPTDETVIVIRTPTSEGLITTTTEPWTGTFTSTSTEMTTVTGTNGQPTDETVIVIRTPTSEGLITTTTEPWTGTFTSTSTEVTTITGTNGQPTDETVIVIRTPTSEGLITTTTEPWTGTFTSTSTEMTTVTGTNGQPTDETVIVIRTPTSEGLISTTTEPWTGTFTSTSTEVTTITGTNGQPTDETVIVIRTPTSEGLITTTTEPWTGTFTSTSTEMTTVTGTNGQPTDETVIVIRTPTSEGLITRTTEPWTGTFTSTSTEVTTITGTNGQPTDETVIVIRTPTTAISSSLSSSSGQITSSITSSRPIITPFYPSNGTSVISSSVISSSVTSSLVTSSSFISSSVISSSTTTSTSIFSESSTSSVIPTSSSTSGSSESKTSSASSSSSSSSISSESPKSPTNSSSSLPPVTSATTGQETASSLPPATTTKTSEQTTLVTVTSCESHVCTESISSAIVSTATVTVSGVTTEYTTWCPISTTETTKQTKGTTEQTKGTTEQTTETTKQTTVVTISSCESDICSKTASPAIVSTSTATINGVTTEYTTWCPISTTESKQQTTLVTVTSCESGVCSETTSPAIVSTATATVNDVVTVYPTWRPQTTNEQSVSSKMNSATSETTTNTGAAETKTAVTSSLSRFNHAETQTASATDVIGHSSSVVSVSETGNTMSLTSSGLSTMSQQPRSTPASSMVGSSTASLEISTYAGSANSLLAGSGLSVFIASLLLAII

SEQ ID NO: 25455 - protein, 276 aa, Saccharomyces cerevisiae
  strain ATCC 204508 / S288c
MRLQRNSIICALVFLVSFVLGDVNIVSPSSKATFSPSGGTVSVPVEWMDNGAYPSLSKISTFTFSLCTGPNNNIDCVAVLASKITPSELTQDDKVYSYTAEFASTLTGNGQYYIQVFAQVDGQGYTIHYTPRFQLTSMGGVTAYTYSATTEPTPQTSIQTTTTNNAQATTIDSRSFTVPYTKQTGTSRFAPMQMQPNTKVTATTWTRKFATSAVTYYSTFGSLPEQATTITPGWSYTISSGVNYATPASMPSDNGGWYKPSKRLSLSARKINMRKV

SEQ ID NO: 25456 - protein, 459 aa, Saccharomyces cerevisiae
  strain ATCC 204508 / S288c
MSGSDRGDRLYDVLGVTRDATVQEIKTAYRKLALKHHPDKYVDQDSKEVNEIKFKEITAAYEILSDPEKKSHYDLYGDDNGAASSGGANGFGDEDFMNFFNNFFNNGSHDGNNFPGEYDAYEEGNSTSSKDIDIDISLTLKDLYMGKKLKFDLKRQVICIKCHGSGWKPKRKIHVTHDVECESCAGKGSKERLKRFGPGLVASQWVVCEKCNGKGKYTKRPKNPKNFCPDCAGLGLLSKKEIITVNVAPGHHFNDVITVKGMADEEIDKTTCGDLKFHLTEKQENLEQKQIFLKNFDDGAGEDLYTSITISLSEALTGFEKFLTKTFDDRLLTLSVKPGRVVRPGDTIKIANEGWPILDNPHGRCGDLYVFVHIEFPPDNWFNEKSELLAIKTNLPSSSSCASHATVNTEDDSNLTNNETISNFRIIHTDDLPEGIRPFKPEAQDSAHQKARSSYCCIQ

SEQ ID NO: 25457 - protein, 275 aa, Saccharomyces cerevisiae
  strain ATCC 204508 / S288c
MPPLVFDIDHIKLLRKWGICGVLSGTLPTAAQQNVFLSVPLRLMLEDVLWLHLNNLADVKLIRQEGDEIMEGITLERGAKLSKIVNDRLNKSFEYQRKFKKDEHIAKLKKIGRINDKTTAEELQRLDKSSNNDQLIESSLFIDIANTSMILRDIRSDSDSLSRDDISDLLFKQYRQAGKMQTYFLYKALRDQGYVLSPGGRFGGKFIAYPGDPLRFHSHLTIQDAIDYHNEPIDLISMISGARLGTTVKKLWVIGGVAEETKETHFFSIEWAGFG

SEQ ID NO: 25458 - protein, 1322 aa, Saccharomyces cerevisiae
  strain ATCC 204508 / S288c
MSLAHYCLLLAIVTLLGLTNVVSATTAACLPANSRKNGMNVNFYQYSLRDSSTYSNAAYMAYGYASKTKLGSVGGQTDISIDYNIPCVSSSGTFPCPQEDLYGNWGCKGIGACSNNPIIAYWSTDLFGFYTTPTNVTLEMTGYFLPPQTGSYTFKFATVDDSAILSVGGSIAFECCAQEQPPITSTNFTINGIKPWNGSPPDNITGTVYMYAGFYYPMKIVYSNAVAWGTLPISVTLPDGTTVSDDFEGYVYTFDNNLSQPNCTIPDPSNYTVSTTITTTEPWTGTFTSTSTEMTTVTGTNGVPTDETVIVIRTPTTASTIITTTEPWNSTFTSTSTELTTVTGTNGVRTDETIIVIRTPTTATTAITTTEPWNSTFTSTSTELTTVTGTNGLPTDETIIVIRTPTTATTAMTTTQPWNDTFTSTSTELTTVTGTNGLPTDETIIVIRTPTTATTAMTTTQPWNDTFTSTSTELTTVTGTNGLPTDETIIVIRTPTTATTAMTTTQPWNDTFTSTSTEITTVTGTNGLPTDETIIVIRTPTTATTAMTTTQPWNDTFTSTSTEMTTVTGTNGLPTDETIIVIRTPTTATTAITTTEPWNSTFTSTSTEMTTVTGTNGLPTDETIIVIRTPTTATTAITTTQPWNDTFTSTSTEMTTVTGTNGLPTDETIIVIRTPTTATTAMTTTQPWNDTFTSTSTEITTVTGTNGLPTDETIIVIRTPTTATTAMTTTQPWNDTFTSTSTEMTTVTGTNGVPTDETVIVIRTPTSEGLISTTTEPWTGTFTSTSTEMTTVTGTNGQPTDETVIVIRTPTSEGLVTTTTEPWTGTFTSTSTEMTTITGTNGQPTDETVIIVKTPTTAISSSLSSSSGQITSFITSARPIITPFYPSNGTSVISSSVISSSDTSSLVISSSVTSSLVTSSPVISSSFISSPVISSTTTSASILSESSKSSVIPTSSSTSGSSESETGSASSASSSSSISSESPKSTYSSSSLPPVTSATTSQEITSSLPPVTTTKTSEQTTLVTVTSCESHVCTESISSAIVSTATVTVSGATTEYTTWCPISTTEITKQTTETTKQTKGTTEQTTETTKQTTVVTISSCESDVCSKTASPAIVSTSTATINGVTTEYTTWCPISTTESKQQTTLVTVTSCGSGVCSETTSPAIVSTATATVNDVVTVYSTWRPQTTNEQSVSSKMNSATSETTTNTGAAETTTSTGAAETKTVVTSSISRFNHAETQTASATDVIGHSSSVVSVSETGNTKSLTSSGLSTMSQQPRSTPASSMVGSSTASLEISTYAGSANSLLAGSGLSVFIASLLLAII

SEQ ID NO: 25459 - protein, 662 aa, Saccharomyces cerevisiae
  strain ATCC 204508 / S288c
MTKETIRVVICGDEGVGKSSLIVSLTKAEFIPTIQDVLPPISIPRDFSSSPTYSPKNTVLIDTSDSDLIALDHELKSADVIWLVYCDHESYDHVSLFWLPHFRSLGLNIPVILCKNKCDSISNVNANAMVVSENSDDDIDTKVEDEEFIPILMEFKEIDTCIKTSAKTQFDLNQAFYLCQRAITHPISPLFDAMVGELKPLAVMALKRIFLLSDLNQDSYLDDNEILGLQKKCFNKSIDVNELNFIKDLLLDISKHDQEYINRKLYVPGKGITKDGFLVLNKIYAERGRHETTWAILRTFHYTDSLCINDKILHPRLVVPDTSSVELSPKGYRFLVDIFLKFDIDNDGGLNNQELHRLFKCTPGLPKLWTSTNFPFSTVVNNKGCITLQGWLAQWSMTTFLNYSTTTAYLVYFGFQEDARLALQVTKPRKMRRRSGKLYRSNINDRKVFNCFVIGKPCCGKSSLLEAFLGRSFSEEYSPTIKPRIAVNSLELKGGKQYYLILQELGEQEYAILENKDKLKECDVICLTYDSSDPESFSYLVSLLDKFTHLQDLPLVFVASKADLDKQQQRCQIQPDELADELFVNHPLHISSRWLSSLNELFIKITEAALDPGKNTPGLPEETAAKDVDYRQTALIFGSTVGFVALCSFTLMKLFKSSKFSK

SEQ ID NO: 25460 - protein, 231 aa, Saccharomyces cerevisiae
  strain ATCC 204508 / S288c
MNGLVLGATGLCGGGFLRHAQEAPQFSKVYAILRRELPFPATDKVVAIVERDNSKWSQLITNEMNPQVLFTALATTRAAAGGLDKQYKIDHDLNLQLAQAAKEKGCETIVLVSSAGAHPDSRFGYMKMKGEIERDVIALDFKHIIILRPGPLLGERTNSKQSGFGGNLTAALGTRVYRSRFQRLLGYPVYGDEVGKVGVHLALNTSGKDKVQFVSSKDILDISASLEKIAT

SEQ ID NO: 25461 - protein, 148 aa, Saccharomyces cerevisiae
  strain ATCC 204508 / S288c
MLSNAKLLLSLAMASTALGLVSNSSSSVIVVPSSDATIAGNDTATPAPEPSSAAPIFYNSTATATQYEVVSEFTTYCPEPTTFVTNGATFTVTAPTTLTITNCPCTIEKPTSETSVSSTHDVETNSNAANARAIPGALGLAGAVMMLL

SEQ ID NO: 25462 - protein, 249 aa, Saccharomyces cerevisiae
  strain ATCC 204508 / S288c
MTTNDTYEATYAIPMHCENCVNDIKACLKNVPGINSLNFDIEQQIMSVESSVAPSTIINTLRNCGKDAIIRGAGKPNSSAVAILETFQKYTIDQKKDTAVRGLARIVQVGENKTLFDITVNGVPEAGNYHASIHEKGDVSKGVESTGKVWHKFDEPIECFNESDLGKNLYSGKTFLSAPLPTWQLIGRSFVISKSLNHPENEPSSVKDYSFLGVIARSAGVWENNKQVCACTGKTVWEERKDALANNIK

SEQ ID NO: 25463 - protein, 560 aa, Saccharomyces cerevisiae
  strain ATCC 204508 / S288c
MIRQSLMKTVWANSSRFSLQSKSGLVKYAKNRSFHAARNLLEDKKVILQKVAPTTGVVAKQSFFKRTGKFTLKALLYSALAGTAYVSYSLYREANPSTQVPQSDTFPNGSKRKTLVILGSGWGSVSLLKNLDTTLYNVVVVSPRNYFLFTPLLPSTPVGTIELKSIVEPVRTIARRSHGEVHYYEAEAYDVDPENKTIKVKSSAKNNDYDLDLKYDYLVVGVGAQPNTFGTPGVYEYSSFLKEISDAQEIRLKIMSSIEKAASLSPKDPERARLLSFVVVGGGPTGVEFAAELRDYVDQDLRKWMPELSKEIKVTLVEALPNILNMFDKYLVDYAQDLFKEEKIDLRLKTMVKKVDATTITAKTGDGDIENIPYGVLVWATGNAPREVSKNLMTKLEEQDSRRGLLIDNKLQLLGAKGSIFAIGDCTFHPGLFPTAQVAHQEGEYLAQYFKKAYKIDQLNWKMTHAKDDSEVARLKNQIVKTQSQIEDFKYNHKGALAYIGSDKAIADLAVGEAKYRLAGSFTFLFWKSAYLAMCLSFRNRVLVAMDWAKVYFLGRDSSI

SEQ ID NO: 25464 - protein, 529 aa, Saccharomyces cerevisiae
  strain ATCC 204508 / S288c
MVLEYQQREGKGSSSKSMPPDSSSTTIHTCSEAQTGEDKGLLDPHLSVLELLSKTGHSPSPMGQNLVTSIDISGNHNVNDSISGSWQAIQPLDLGASFIPERCSSQTTNGSILSSSDTSEEEQELLQAPAADIINIIKQGQEGANVVSPSHPFKQLQKIISLPLPGKEKTPFNEQDDDGDEDEAFEEDSVTITKSLTSSTNSFVMPKLSLTQKNPVFRLLILGRTGSSFYQSIPKEYQSLFELPKYHDSATFPQYTGIVIIFQELREMVSLLNRIVQYSQGKPVIPICQPGQVIQVKNVLKSFLRNKLVKLLFPPVVVTNKRDLKKMFQRLQDLSLEYGEDVNEEDNDDEAIHTKSRSYCRNKKAENSKKKSPKSNKKPKRKKQKFFTSWFTWGISITIGISFGCCVTYFVTAAYEHQTVKSLSLRPSILASLLSLDSSSDTINTPATASPSSTEQFLWFDKGTLQINFHSDGFIMKSLTIIKETWGKMNTFVLHALSKPLKFLENLNKSSEFSIDESNRILALGYILL

SEQ ID NO: 25465 - protein, 476 aa, Saccharomyces cerevisiae
  strain ATCC 204508 / S288c
MKFSTAVTTLISSGAIVSALPHVDVHQEDAHQHKRAVAYKYVYETVVVDSDGHTVTPAASEVATAATSAIITTSVLAPTSSAAAADSSASIAVSSAALAKNEKISDAAASATASTSQGASSSSSSSSATSTLESSSVSSSSEEAAPTSTVVSTSSATQSSASSATKSSTSSTSPSTSTSTSTSSTSSSSSSSSSSSSSSSGSGSIYGDLADFSGPSEKFQDGTIPCDKFPSGQGVISIDWIGEGGWSGVENTDTSTGGSCKEGSYCSYSCQPGMSKTQWPSDQPSDGRSVGGLLCKNGYLYRSNTDADYLCEWGVEAAYVVSKLSKGVAICRTDYPGTENMVIPTYVEGGSSLPLTVVDQDTYFTWEGKKTSAQYYVNNAGVSVEDGCIWGTSGSGIGNWAPLNFGAGSTGGVTYLSLIPNPNNSDALNYNVKIVAADDSSNVIGECVYENGEFSGGADGCTVSVTSGKAHFVLYN

SEQ ID NO: 25466 - protein, 281 aa, Saccharomyces cerevisiae
  strain ATCC 204508 / S288c
MALRFFNDISRDVNGLFNRDFFHTNPLSLNISTTTENGVNFTLKAKQGVTEGPIQTSVEGRFYDRKEGVSLSQSWSNQNRLNTRIEFSKIAPGWKGDVNAFLTPQSIKNAKFNLSYAQKSFAARTSIDILQPKDFVGSVTLGHRGFVGGTDIAYDTAAGLCARYAMSIGYLAREYSFILSTNNRQCATASFFQNVNRYLQVGTKATLQSKTSSNMNIEFVTRYVPDSISQVKAKIADSGLTTLSYKRNLNKDISLGVGMSFNALQLTEPVHKFGWSLSFSP

SEQ ID NO: 25467 - protein, 155 aa, Saccharomyces cerevisiae
  strain ATCC 204508 / S288c
MTKVDFWPTLKDAYEPLYPQQLEILRQQVVSEGGPTATIQSRFNYAWGLIKSTDVNDERLGVKILTDIYKEAESRRRECLYYLTIGCYKLGEYSMAKRYVDTLFEHERNNKQVGALKSMVEDKIQKETLKGVVVAGGVLAGAVAVASFFLRNKRR

SEQ ID NO: 25468 - protein, 269 aa, Saccharomyces cerevisiae
  strain ATCC 204508 / S288c
MSFTKIAALLAVAAASTQLVSAEVGQYEIVEFDAILADVKANLEQYMSLAMNNPDFTLPSGVLDVYQHMTTATDDSYTSYFTEMDFAQITTAMVQVPWYSSRLEPEIIAALQSAGISITSLGQTVSESGSESATASSDASSASESSSAASSSASESSSAASSSASESSSAASSSASESSSAASSSASEAAKSSSSAKSSGSSAASSAASSASSKASSAASSSAKASSSAEKSTNSSSSATSKNAGAAMDMGFFSAGVGAAIAGAAAMLL

SEQ ID NO: 25469 - protein, 1041 aa, Saccharomyces cerevisiae
  strain ATCC 204508 / S288c
MNKLLLHLVRVISILGLANALTQTQPILKDIQITDSYTKTKECTDPDHWFIIEGQLSIPKGSQQNITFQVPDAFSSFPQEPFSIKHNSNSVATISRPDKSTNNFTISIPEKSSEDITTTFNFLAQLTSDAKSKVTEPKSIVYSFYSENTMFNDVIDYVAKNTSAITTDGGIYKTNNTAWFTVDLPMRTFRNPVYLTSQTSSSSDYVFDTSLTKFEVVTAVDSFNEPINAIPYTTVHDYSTEDEIRCLFNSTISGGLYFRVTYFTKKLSTSSISNTVELTYPDEGTSVRLLGKRDTSTTLASELYSESAANIDSTTSDDTTSSDAAITPTYSNSTLSSYTSQSSAIPEVAVTASLSSGILSSTVDGASTSADASMSAVSTVSSSSEQASSSSISLSAPSSSNSTFTTPSSSLSATETYSIISSASISVTQASYIDNSTTTAVTQSTSTIAVSSAEKLSSTLSYTSNVTISVSSATQHTTTPSYVSNSTTLSSSSVLESVISSPYLANTTVSGASSASQSTNPPYVSNSTTSSATQLATIAPFAINITGTSISSSITNTSSVSSTTSSLSSGPFVSNTTVASGSYILTTTTESAQLTEIGSLIPISTITTSTTTSGTDKTGSNKVASSTEIAQSIVNNSSLSVSTINTNAATAAANARNATFTHATHSGSLQPSYHSSSLLSSTIDTKVTTATTSTSRDGSSSLAFTTGLNQSVVTGTDKSDTYSVISSTESAQVTEYDSLLPISTLKPTVVTGTSRNSTFSMVSSTKLTEATATDKGDAYSVISSTQSAQVTEYGSMLPISTLETPTVIMSTDESGYFTLTTCTESGQATEYGSLIPISTLDGSVIYTFTGESVVVGYSTTVGAAQYAQHTSLVPVSTIKGSKTSLSTEESVVAGYSTTVGAAQYAQHTSLVPVSTIKGSKTSLSTEESVVAGYSTTVDSAQYAEHTNLVAIDTLKTSTFQKATATEVCVTCTALSSPHSATLDAGTTISLPTSSSTSLSTIITWYSSSTIKPPSISTYSGAAGQLTIRIGSLLLGLISFLL

SEQ ID NO: 25470 - protein, 92 aa, Saccharomyces cerevisiae
  strain ATCC 204508 / S288c
MQFSTVASVAFVALANFVAAESAAAISQITDGQIQATTTATTEATTTAAPSSTVETVSPSSTETISQQTENGAAKAAVGMGAGALAAAAMLL

SEQ ID NO: 25471 - protein, 287 aa, Saccharomyces cerevisiae
  strain ATCC 204508 / S288c
MHYKKAFLASLLSSIALTAYAPPEPWATLTPSSKMDGGTTEYRTSFGLAVIPFTVTESKVKRNVISQINDGQVQVTTQKLPHPVSQIGDGQIQVTTQKVPPVVSHIVSQIGDGQLQITTAKNVVTKSTIAVPSKTVTATATSTATAVSQIHDGQVQVTISSASSSSVLSKSKLEPTKKPNNEKVIKVQACKSSGTLAITLQGGVLIDSSGRIGSIVANRQFQFDGPPPQAGAIYAGGWSITKHGTLAIGDNDVFYQCLSGTFYNLYDQSIGGQCNPVHLQTVGLVDC

SEQ ID NO: 25472 - protein, 227 aa, Saccharomyces cerevisiae
  strain ATCC 204508 / S288c
MQFKNVALAASVAALSATASAEGYTPGEPWSTLTPTGSISCGAAEYTTTFGIAVQAITSSKAKRDVISQIGDGQVQATSAATAQATDSQAQATTTATPTSSEKISSSASKTSTNATSSSCATPSLKDSSCKNSGTLELTLKDGVLTDAKGRIGSIVANRQFQFDGPPPQAGAIYAAGWSITEDGYLALGDSDVFYQCLSGNFYNLYDQNVAEQCSAIHLEAVSLVDC

SEQ ID NO: 25473 - protein, 714 aa, Saccharomyces cerevisiae
  strain ATCC 204508 / S288c
MSVNDQITHIGKTLSTTASAFLNYQKSNSNTQDVLTNNGPYKNLLSNTVNNASSTSYFYKRTEHGRFVKNASNTFEDIYSKTRRGDVFRNKFTDNKTCFRMLTYISDDLLNEIPTKEGLKSDADGKLLTEGGENENLRKNASKKETSLFQGFKSYLPIAELAIENTERLNYDTNGTSGTVGAKDVMSKTNERDEIHTELPNFQDSFLIPPGVETKKISSSYSPSALKSFSQTLVNSLEFLNIQKNSTLSEIRDIEVEVENLRQKKEKLLGKIANIEQNQLLLEDNLKQIDDRLDFLEEYGLEVIEANSDENAEDDGMSERKALKNDAIRNEGVTTESISSEASNLPPRRRQQLRDDNSLNRLGAFYSKSKKRHRKSFPTFQQLYEPGTKIGSIMSTHDDFLTCLDFDAPFGTLCTAGYLDHTVKIWDLSKQNKIGELAGHLATINCMQINRDYGTLVTGGRDAALKLWNLNLAQQLYQETQNLTSPTNHIDSPCVHTFEAHTDEVTALSLDPSFLVSGSQDRTIRQWDLRSGKCLQTIDLSFANVLTTSTNVDLSKSTLLTQRNERPSIGALQSFDAALATGTKDGVVRLWDLRSGKVIRTLKGHTDAITSLKFDSACLVTGSYDRTVRIWDLRTGLLNKFHAYSAPVLSLDLFQENAAVVVADEPSVQIYDSEKDESWSCVEQGNETSVSTVKYKENYMVEGRENGDVNIWAV

SEQ ID NO: 25474 - protein, 731 aa, Saccharomyces cerevisiae
  strain ATCC 204508 / S288c
MFRVFGSFGSKGNQSSGEEQSTKTKQVLKQANDFEIALKAMDFVLDDRTDEGLNLLKKAEMETGSDQTILTLARGVIEFLQATLSFETEEMKRAAITLGKAEQMSWKSKQNAEKTNFRSSSIYPPGTVYAVTYTESCLLHALLMLFSESMMEAAKALLKLRRAYTMLQDIMVTVKKAERSKNSSSPSPSEKSQESCGSFVSAETTFISVDIPYKLSSEDKSNPLLLEFAEKIYTMRMGRLSGAHIGNTPSFHRLRDDLGLQTTPSQASDRHSVSDDFDLEQATIDEFIHSGANLCYGILQVVLSLLPPAIGAVLSIVGFKGSREEGLRLVWKATKERNVHGCIGLLGLMFYYDGPFQFTDADFDIPPNDNGSRALNKSRTNDSSLLPGYMDSATLLHPGKILEDALLKARALFPNSALWLLNEAKMLAGKGRLRDSLALMDSIDVNSIRMRQVKSLMVFERAILLVNLHEYNRAADDLISLLDISDWSHALYTYFAGCCYLENWRMTQLGLLNDGKEQFYKERARELIFDAPSLLGKKTFKSKNLPLDRFMLRKVQQFNNMQKKLNLQEPLDSIATSPVHELAYFYNGYNRMTENDLILTKKMLTEYHNPAIDSEDPDQELIRNLLLSLTLRRLGDAERGLALLDDIVLPKIFYIQNGKVKYFKKTEDPWAYPAALYERALFCWKLGGMESLNECREWLLRAQNYAADYELSTRIGMKIKAALDRVENALA

SEQ ID NO: 25475 - protein, 299 aa, Saccharomyces cerevisiae
  strain ATCC 204508 / S288c
MKLSKLSILTSALATSALAAPAVVTVTEHAHEAAVVTVQGVVYVENGQTRTTYETLAPASTATPTSTATALVAPPVAPSSASSNSDVVLSALKNLASVWGKTTDSTTTLTSSESTSQSLAQATTTSTPAAASTTSTPAATTTTSQAAATSSASSSDSDLSDFASSVLAEHNKKRALHKDTPALSWSDTLASYAQDYADNYDCSGTLTHSGGPYGENLALGYDGPAAVDAWYNEISNYDFSNPGFSSNTGHFTQVVWKSTTQVGCGIKTCGGAWGDYVICSYDPAGNYEGEYADNVEPLA

SEQ ID NO: 25476 - protein, 881 aa, Saccharomyces cerevisiae
  strain ATCC 204508 / S288c
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSTSTTSDTVSTISSSIMPAVAQGYTTTVSSAASSSSLKSTTINPAKTATLTASSSTVITSSTESVGSSTVSSASSSSVTTSYATSSSTVVSSDATSSTTTTSSVATSSSTTSSDPTSSTAAASSSDPASSSAAASSSASTENAASSSSAISSSSSMVSAPLSSTLTTSTASSRSVTSNSVNSVKFANTTVFSAQTTSSVSASLSSSVAADDIQGSTSKEATSSVSEHTSIVTSATNAAQYATRLGSSSRSSSGAVSSSAVSQSVLNSVIAVNTDVSVTSVSSTAHTTKDTATTSVTASESITSETAQASSSTEKNISNSAATSSSIYSNSASVSGHGVTYAAEYAITSEQSSALATSVPATNCSSIVKTTTLENSSTTTITAITKSTTTLATTANNSTRAATAVTIDPTLDPTDNSASPTDNAKHTSTYGSSSTGASLDSLRTTTSISVSSNTTQLVSTCTSESDYSDSPSFAISTATTTESNLITNTITASCSTDSNFPTSAASSTDETAFTRTISTSCSTLNGASTQTSELTTSPMKTNTVVPASSFPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25477 - protein, 298 aa, Saccharomyces cerevisiae
  strain ATCC 204508 / S288c
MSRISILAVAAALVASATAASVTTTLSPYDERVNLIELAVYVSDIGAHLSEYYAFQALHKTETYPPEIAKAVFAGGDFTTMLTGISGDEVTRMITGVPWYSTRLMGAISEALANEGIATAVPASTTEASSTSTSEASSAATESSSSSESSAETSSNAASTQATVSSESSSAASTIASSAESSVASSVASSVASSASFANTTAPVSSTSSISVTPVVQNGTDSTVTKTQASTVETTITSCSNNVCSTVTKPVSSKAQSTATSVTSSASRVIDVTTNGANKFNNGVFGAAAIAGAAALLL

SEQ ID NO: 25478 - protein, 1161 aa, Saccharomyces cerevisiae
  strain ATCC 204508 / S288c
MVNISIVAGIVALATSAAAITATTTLSPYDERVNLIELAVYVSDIRAHIFQYYSFRNHHKTETYPSEIAAAVFDYGDFTTRLTGISGDEVTRMITGVPWYSTRLKPAISSALSKDGIYTAIPTSTSTTTTKSSTSTTPTTTITSTTSTTSTTPTTSTTSTTPTTSTTSTTPTTSTTSTTPTTSTTSTTPTTSTTSTTPTTSTTSTTPTTSTTSTTPTTSTTSTTPTTSTTPTTSTTSTTSQTSTKSTTPTTSSTSTTPTTSTTPTTSTTSTAPTTSTTSTTSTTSTISTAPTTSTTSSTFSTSSASASSVISTTATTSTTFASLTTPATSTASTDHTTSSVSTTNAFTTSATTTTTSDTYISSSSPSQVTSSAEPTTVSEVTSSVEPTRSSQVTSSAEPTTVSEFTSSVEPTRSSQVTSSAEPTTVSEFTSSVEPTRSSQVTSSAEPTTVSEFTSSVEPTRSSQVTSSAEPTTVSEFTSSVEPTRSSQVTSSAEPTTVSEFTSSVEPIRSSQVTSSAEPTTVSEVTSSVEPIRSSQVTTTEPVSSFGSTFSEITSSAEPLSFSKATTSAESISSNQITISSELIVSSVITSSSEIPSSIEVLTSSGISSSVEPTSLVGPSSDESISSTESLSATSTFTSAVVSSSKAADFFTRSTVSAKSDVSGNSSTQSTTFFATPSTPLAVSSTVVTSSTDSVSPNIPFSEISSSPESSTAITSTSTSFIAERTSSLYLSSSNMSSFTLSTFTVSQSIVSSFSMEPTSSVASFASSSPLLVSSRSNCSDARSSNTISSGLFSTIENVRNATSTFTNLSTDEIVITSCKSSCTNEDSVLTKTQVSTVETTITSCSGGICTTLMSPVTTINAKANTLTTTETSTVETTITTCPGGVCSTLTVPVTTITSEATTTATISCEDNEEDITSTETELLTLETTITSCSGGICTTLMSPVTTINAKANTLTTTETSTVETTITTCSGGVCSTLTVPVTTITSEATTTATISCEDNEEDVASTKTELLTMETTITSCSGGICTTLMSPVSSFNSKATTSNNAESTIPKAIKVSCSAGACTTLTTVDAGISMFTRTGLSITQTTVTNCSGGTCTMLTAPIATATSKVISPIPKASSATSIAHSSASYTVSINTNGAYNFDKDNIFGTAIVAVVALLLL

SEQ ID NO: 25479 - protein, 361 aa, Saccharomyces cerevisiae
  strain ATCC 204508 / S288c
MISANSLLISTLCAFAIATPLSKRDSCTLTGSSLSSLSTVKKCSSIVIKDLTVPAGQTLDLTGLSSGTTVTFEGTTTFQYKEWSGPLISISGSKISVVGASGHTIDGQGAKWWDGLGDSGKVKPKFVKLALTGTSKVTGLNIKNAPHQVFSINKCSDLTISDITIDIRDGDSAGGHNTDGFDVGSSSNVLIQGCTVYNQDDCIAVNSGSTIKFMNNYCYNGHGISVGSVGGRSDNTVNGFWAENNHVINSDNGLRIKTVEGATGTVTNVNFISNKISGIKSYGIVIEGDYLNSKTTGTATGGVPISNLVMKDITGSVNSTAKRVKILVKNATNWQWSGVSITGGSSYSGCSGIPSGSGASC

SEQ ID NO: 25480 - protein, 102 aa, Saccharomyces cerevisiae [sequence omitted]

SEQ ID NO: 25481 - protein, 152 aa, Saccharomyces cerevisiae [sequence omitted]

SEQ ID NO: 25482 - protein, 327 aa, Saccharomyces cerevisiae
  strain ATCC 204508 / S288c
MVKGSVHLWGKDGKASLISVDSIALVWFIKLCTSEEAKSMVAGLQIVFSNNTDLSSDGKLPVLILDNGTKVSGYVNIVQFLHKNICTSKYEKGTDYEEDLAIVRKKDRLLEYSLLNYVDVEISRLTDYQLFLNTKNYNEYTKKLFSKLLYFPMWYNTPLQLRSQARENCEEIIGSLTLEDDEEFVESKAMESASQLAQSKTFKIAHKNKIKGKQELQQVKYNLQFDNRLQSCVSNWLAARKKLDDSVILSSDLLFLANLYVQLGLPDGNRIRSKLEQTFGSELLNSMSNKIDDFVHRPSNNLEQRDPQFREQGNVVMSLYNLACKYI

SEQ ID NO: 25483 - protein, 268 aa, Saccharomyces cerevisiae
  strain ATCC 204508 / S288c
MLIVLFLTLFCSVVFRTAYCDVAIVAPEPNSVYDLSGTSQAVVKVKWMHTDNTPQEKDFVRYTFTLCSGTNAMIEAMATLQTLSASDLTDNEFNAIIENTVGTDGVYFIQVFAQTAIGYTIHYTNRFKLKGMIGTKAANPSMITIAPEAQTRITTGDVGATIDSKSFTVPYNLQTGVVKYAPMQLQPATKVTAKTWKRKYATSEVTYYYTLRNSVDQHTTVTPGWSYIITADSNYATPAPMPADNGGWYNPRKRLSLTARKVNALRHR

SEQ ID NO: 25484 - protein, 378 aa, Saccharomyces cerevisiae
  strain ATCC 204508 / S288c
MTINTKNIVVVGAGVFGVSVANHLYRELGGTYAIKLVTASNYVYFLPSAVRLTVSKDYTKSILPLKNVLDSGIEVIKDTAASFDDKEVVLGSDRAIKFDILVLATGSKWADPIGSTYTFGDNYKEYFEREASRISDADHILFLGGGFVNCELAGELLFKYLEEIRSGKKRISIIHNSDKLLPDSGLYNDTLRKNVTDYLSKNGITLYLNTVGASLDTSPKRIFLGEGSSKYIDADLIYRGVGISPNVPVNSISDLCDKKGFIQVEKNFRVKAVEAGNVFAIGDVTNFRYHGLVKRDNWVDVLTRNVISSLQEGTEASLVDADCLETGHAPSGVSLGPNAGFGQFPLPLLGTINIPSFLISRAKSKNLFSDKMEPLFKK

SEQ ID NO: 25485 - protein, 459 aa, Saccharomyces cerevisiae
  strain ATCC 204508 / S288c
MSFRFNEAVFGDNSFNERIREKLSTALNSPSKKKLDILKSGIKVQKVDFPTIPQLEILDLDIITQPKSLAKGICKISCKDAMLRIQTVIESNLLLINEQDTPSFTMPQLINNGSFTIPITMTFSSIELEAITNIFVKNPGIGISFNDVDLDFKFDCSVKILQSTIERRLKESMHVVFKDVLPSLIFNTSQNWFTNRGESTSTIPGKREHHHQQTTMSRNVILDGSDFQELSPINMLRLSSIVSSRSTLSLHSTVMNSLSAIPGCLERQNLYRFISRMPSLNNYYSSQSFPQPKSSTVSSKQLVKPFYCSHNLLPKTVLDSSQYDLATITKIQSRLFDRSNSNDDNAKPRRRKIKCKKTRTPSNLQSQGEQAVDDSTAIETVTSTPVQTPIPELEEQSPPYLKTTVSIRDKYVIPEKISLNLDSKKDTSKKKPFYFIGLNSQEPSNNWKWGMEDSPPPYH

SEQ ID NO: 25486 - protein, 542 aa, Saccharomyces cerevisiae
  strain ATCC 204508 / S288c
MISPISFLSSLLCLTYLTSALPILPKREVVTRVHTASTTNVVTDFYSTTTEVVIAPTVEFLISDSVTFTTTLIPQGVNPTAEPTTTITKVLLKKAEMSTSSQPTSTLQPSTIPQSTSSFQAESTLQAVSTQQTAMSVSAGTSEDVQQLATTSTSISSSPSPTTTSTSTQNIVSGVGEANVEGNTQSQHHSYQAAATSTLNQQTSTSIASQESTESTNTPTSSSTSSSTSSSTSSSTSSSTSSSTSSSTSSSTSSSTSSTQETAATTSEGSSSSSAAITSSPKAIAYSPYNDDGSCKSADAVSSDLTLIKSKGISKIRVYGTDCNSFETVQPAAVKLGIKINQGLYITSSGVDSIDDSVTTLIQYGQTNGWDVFDFITVGNEAINNGWCSVSDLISKISSVKSKLSEAGYSGQITTSEPPVSFENNPDLCKKSDIDFVGINPHAYFDTSASAETAGTFVKGQVELIQGVCGTSNVFVTETGYPSSGIQNGGNIPSTANQITAVQNILNEMDLDVTILSTYNDYWKAPGDYGIEQSFGVIEYFP

SEQ ID NO: 25487 - protein, 507 aa, Saccharomyces cerevisiae
  strain ATCC 204508 / S288c
MKVLDLLTVLSASSLLSTFAAAESTATADSTTAASSTASCNPLKTTGCTPDTALATSFSEDFSSSSKWFTDLKHAGEIKYGSDGLSMTLAKRYDNPSLKSNFYIMYGKLEVILKAANGTGIVSSFYLQSDDLDEIDIEWVGGDNTQFQSNFFSKGDTTTYDRGEFHGVDTPTDKFHNYTLDWAMDKTTWYLDGESVRVLSNTSSEGYPQSPMYLMMGIWAGGDPDNAAGTIEWAGGETNYNDAPFTMYIEKVIVTDYSTGKKYTYGDQSGSWESIEADGGSIYGRYDQAQEDFAVLANGGSISSSSTSSSTVSSSASSTVSSSVSSTVSSSASSTVSSSVSSTVSSSSSVSSSSSTSPSSSTATSSKTLASSSVTTSSSISSFEKQSSSSSKKTVASSSTSESIISSTKTPATVSSTTRSTVAPTTQQSSVSSDSPVQDKGGVATSSNDVTSSTTQISSKYTSTIQSSSSEASSTNSVQISNGADLAQSLPREGKLFSVLVALLALL

SEQ ID NO: 25488 - protein, 386 aa, Saccharomyces cerevisiae; identical to SEQ ID NO: 850
  strain ATCC 204508 / S288c

SEQ ID NO: 25489 - protein, 60 aa, Saccharomyces cerevisiae
  strain ATCC 204508 / S288c
MSFLPSFILSDESKERISKILTLTHNVAHYGWIPFVLYLGWAHTSNRPNFLNLLSPLPSV

SEQ ID NO: 25490 - protein, 420 aa, Saccharomyces cerevisiae
  strain ATCC 204508 / S288c
MKLSATTLTAASLIGYSTIVSALPYAADIDTGCTTTAHGSHQHKRAVAVTYVYETVTVDKNGQTVTPTSTEASSTVASTTTLISESSVTKSSSKVASSSESTEQIATTSSSAQTTLTSSETSTSESSVPISTSGSASTSSAASSATGSIYGDLADFSGPYEKFEDGTIPCGQFPSGQGVIPISWLDEGGWSGVENTDTSTGGSCKEGSYCSYACQPGMSKTQWPSDQPSDGRSIGGLLCKDGYLYRSNTDTDYLCEWGVDAAYVVSELSNDVAICRTDYPGTENMVIPTYVQAGDSLPLTVVDQDTYYTWQGLKTSAQYYVNNAGISVEDACVWGSSSSGVGNWAPLNFGAGSSDGVAYLSLIPNPNNGNALNFNVKIVAADDSSTVNGECIYENGSFSGGSDGCTVSVTAGKAKFVLYN

SEQ ID NO: 25491 - protein, 1117 aa, Saccharomyces cerevisiae
  strain ATCC 204508 / S288c
MQLYLTLLFLLSFVECSYISFISNNADEILETDLIETLSYATLTVGEPYVAQSVVVTRVSAASHSPLSVSPKNRVSASPINSQDSDSNTRTAVQLSLSLSNYASQVSQKISAQTNNDPVTVSNIYANDNSKSKSSVHNLSSVSGVASVMPSASTMRKVTTLLSQTASTSTSTLFSSSLSISGTQLNGTLLTSVSKGTIDPLVTQMPSYSSQETKIIPSSLTSNKTIYTISVRTNAATATGEDSFIASTPASSTLFYPSNSTQDLVQTLASTTASPAYPSNRTQITLSPSVSLYSTTSPIYPSNITENGSSPSPSLSSTVSPVYPSSSTGNILLSSLFSTVDSSSSPVSSTLDTIYVSSSMQATISSSSSSRQTKTSSSSLSTSTSSTATTTENSSTTTIVNLFNAVSTDEPPTVFDRSPNPMSLADGVSNDGPIQTNKFYTNLIVGSQESPAFVYPYSLWKYTSSSYGFAVQHTTVDQYSYGGYDSSGNAEYLVNPLGIAHVVFSASNFDSSMTMQVDEMTLSSTRVVLSESNDSSNYLEIPLVQGMGFATGIYHGSLNAKIGSSVGFNTIVSESSSNLAQGILKYRITLLNGVTWLCYVIGPDDLTSTDFSLEVSSEYEIKASASVDGLIIQLAVAPSETDYEVFYDQAAGMYVTNFKLQGVSDGSTATYEFSYTTQGESASGSTMIFALPHHESSFSDIMQDYYTGIQLASTTKGVMNGYLTTSLQFSTSLNRQISWLPWSSQLGSNLLEYSKEQLQLLAEVANSELQVSISESISGLNTYYLGKVIDKYSYILLTVSEIIQDEASTKSTLENIKSAFDILLQNEQTYPLIYDTKFNGLVSSGDWGSTSTQYDFGNTYYNDHHFHYGYIIHAAAVIGYVDSKLNGTWAADNKDWVNSLVRDVANPSEKDEYFAQSRMFDWFNGHSWAAGLYENGNGKNEESSSEDYNFAYAMKLWGATIGDQSMELRGDLMISIMKDAMNDYFYYQNDNTVEPEEIIGNKVSGILFDNIIDYTTYFGTNTEYIHGIHMLPITPVSSNIRSETFVEEEWQTKIEPIIESIESGWTGILKLNQALFDPVDSYAFFSDSTFDSSTYLDNGMSRTWALAFSGGLANSIA

SEQ ID NO: 25492 - protein, 484 aa, Saccharomyces cerevisiae
  strain ATCC 204508 / S288c
MTSSSGVDNEISLDSPMPIFNESSTLKPIRVAGVVTTGTDHIDPSVLQAYLDDTIMKSITLGQLVKNADVLNKRLCQHHIALNAKQSFHFQGNTYISDEKETHDVVPLMEVVSQLDILPPKTFTAKTGTNFGNDNDAEAYLQFEKLIDKKYLKLPTRVNLEILRGTKIHSSFLFNSYSSLSPQSILNLKVFSQFYNWNTNKGLDIGQRGARLSLRYEPLFLHKLLHNPHSNESPTLFHEWFLETCWRSTKICSQGTSAPYMYSGTMLSQAGDQLRTILGHTFVLDKRDHIMCPTKGSMLKWSNELSPGKHLKTQLELNSVKSWMNDDFITFSTTIKTGYLKNLSSQQSLPVHICDKFQSGGPSDIRGFQTFGLGPRDLYDAVGGDAFVSYGLSVFSRLPWKKVEKSNFRLHWFFNGGKLVNHDNTSLGNCIGQLSKEHSTSTGIGLVLRHPMARFELNFTLPITAHENDLIRKGFQFGLGLAFL

SEQ ID NO: 25493 - protein, 757 aa, Saccharomyces cerevisiae
  strain ATCC 204508 / S288c
MASLEDLIPTVNKLQDVMYDSGIDTLDLPILAVVGSQSSGKSSILETLVGRDFLPRGTGIVTRRPLVLQLNNISPNSPLIEEDDNSVNPHDEVTKISGFEAGTKPLEYRGKERNHADEWGEFLHIPGKRFYDFDDIKREIENETARIAGKDKGISKIPINLKVFSPHVLNLTLVDLPGITKVPIGEQPPDIEKQIKNLILDYIATPNCLILAVSPANVDLVNSESLKLAREVDPQGKRTIGVITKLDLMDSGTNALDILSGKMYPLKLGFVGVVNRSQQDIQLNKTVEESLDKEEDYFRKHPVYRTISTKCGTRYLAKLLNQTLLSHIRDKLPDIKTKLNTLISQTEQELARYGGVGATTNESRASLVLQLMNKFSTNFISSIDGTSSDINTKELCGGARIYYIYNNVFGNSLKSIDPTSNLSVLDVRTAIRNSTGPRPTLFVPELAFDLLVKPQIKLLLEPSQRCVELVYEELMKICHKCGSAELARYPKLKSMLIEVISELLRERLQPTRSYVESLIDIHRAYINTNHPNFLSATEAMDDIMKTRRKRNQELLKSKLSQQENGQTNGINGTSSISSNIDQDSAKNSDYDDDGIDAESKQTKDKFLNYFFGKDKKGQPVFDASDKKRSIAGDGNIEDFRNLQISDFSLGDIDDLENAEPPLTEREELECELIKRLIVSYFDIIREMIEDQVPKAVMCLLVNYCKDSVQNRLVTKLYKETLFEELLVEDQTLAQDRELCVKSLGVYKKAATLISNIL

SEQ ID NO: 25494 - protein, 50 aa, Saccharomyces cerevisiae
  strain ATCC 204508 / S288c
MFGLPQQEVSEEEKRAHQEQTEKTLKQAAYVAAFLWVSPMIWHLVKKQWK

SEQ ID NO: 25495 - protein, 338 aa, Saccharomyces cerevisiae
  strain ATCC 204508 / S288c
MKLSTVLLSAGLASTTLAQFSNSTSASSTDVTSSSSISTSSGSVTITSSEAPESDNGTSTAAPTETSTEAPTTAIPTNGTSTEAPTTAIPTNGTSTEAPTDTTTEAPTTALPTNGTSTEAPTDTTTEAPTTGLPTNGTTSAFPPTTSLPPSNTTTTPPYNPSTDYTTDYTVVTEYTTYCPEPTTFTTNGKTYTVTEPTTLTITDCPCTIEKPTTTSTTEYTVVTEYTTYCPEPTTFTTNGKTYTVTEPTTLTITDCPCTIEKSEAPESSVPVTESKGTTTKETGVTTKQTTANPSLTVSTVVPVSSSASSHSVVINSNGANVVVPGALGLAGVAMLFL

SEQ ID NO: 25496 - protein, 467 aa, Saccharomyces cerevisiae
  strain ATCC 204508 / S288c
MQFAGKKTDQVTTSNPGFEEEEEEEEELQQDWSQLASLVSKNAALSLPKRGEKDYEPDGTNLQDLLLYNASKAMFDTISDSIRGTTVKSEVRGYYVPHKHQAVLLKPKGSFMQTMGRADSTGELWLDFHEFVYLAERGTILPYYRLEAGSNKSSKHETEILLSMEDLYSLFSSQQEMDQYFVFAHLKRLGFILKPSNQEAAVKTSFFPLKKQRSNLQAITWRLLSLFKIQELSLFSGFFYSKWNFFFRKYTTSPQLYQGLNRLVRSVAVPKNKKELLDAQSDREFQKVKDIPLTFKVWKPHSNFKKRDPGLPDFQVFVYNKNDDLQHFPTYKELRSMFSSLDYKFEFLSEIEDDDDWETNSYVEDIPRKEYIHKRSAKSQTEKSESSMKASFQKKTAQSSTKKKRKAYPPHIQQNRRLKTGYRSFIIAIMDNGLISFVKMSEADFGSESVWYTPNTQKKVDQRWKKH

SEQ ID NO: 25497 - protein, 434 aa, Saccharomyces cerevisiae
  strain ATCC 204508 / S288c
MLLKNLHSLLQLPIFSNGADKGIEPNCPINIPLSCSNKTDIDNSCCFEYPGGIFLQTQFWNYFPSKNDLNETELVKELGPLDSFTIHGLWPDNCHGGYQQFCNRSLQIDDVYYLLHDKKFNNNDTSLQISGEKLLEYLDLYWKSNNGNHESLWIHEFNKHGTCISTIRPECYTEWGANSVDRKRAVYDYFRITYNLFKKLDTFSTLEKNNIVPSVDNSYSLEQIEAALSKEFEGKKVFIGCDRHNSLNEVWYYNHLKGSLLSEMFVPMDSLAIRTNCKKDGIKFFPKGYVPTFRRRPNKGARYRGVVRLSNINNGDQMQGFLIKNGHWMSQGTPANYELIKSPYGNYYLRTNQGFCDIISSSSNELVCKFRNIKDAGQFDFDPTKGGDGYIGYSGNYNWGGDTYPRRRNQSPIFSVDDEQNSKKYKFKLKFIKN

SEQ ID NO: 25498 - protein, 223 aa, Saccharomyces cerevisiae
  strain ATCC 204508 / S288c
MKKQILIVAAQSILCSTVFGERSNVGLSTEELGGDSILYFNEDPIVIEIDKKAIDKKTLEQLASTRDVVLTDLPDTLEFIDFNEYAKMKSKSDMLLEYINEYEFDDFERSSEGGLEEEEEEDLIYDFNAQAEDLGKLGSNIYEVVEEKNIVNTYDGNLINASTTESTTTIRPFVTSHSYVASSTPYSNISSLNEDYDNASNFLTPTTVALAVLLTILLFIQAY

SEQ ID NO: 25499 - protein, 341 aa, Saccharomyces cerevisiae
  strain ATCC 204508 / S288c
MQYKKSLVASALVATSLAAYAPKDPWSTLTPSATYKGGITDYSSTFGIAVEPIATTASSKAKRAAAISQIGDGQIQATTKTTAAAVSQIGDGQIQATTKTKAAAVSQIGDGQIQATTKTTSAKTTAAAVSQIGDGQIQATTKTKAAAVSQIGDGQIQATTKTTAAAVSQIGDGQIQATTKTTAAAVSQIGDGQIQATTNTTVAPVSQITDGQIQATTLTSATIIPSPAPAPITNGTDPVTAETCKSSGTLEMNLKGGILTDGKGRIGSIVANRQFQFDGPPPQAGAIYAAGWSITPEGNLAIGDQDTFYQCLSGNFYNLYDEHIGTQCNAVHLQAIDLLNC

SEQ ID NO: 25500 - protein, 325 aa, Saccharomyces cerevisiae
  strain ATCC 204508 / S288c
MQYKKPLVVSALAATSLAAYAPKDPWSTLTPSATYKGGITDYSSSFGIAIEAVATSASSVASSKAKRAASQIGDGQVQAATTTAAVSKKSTAAAVSQITDGQVQAAKSTAAAVSQITDGQVQAAKSTAAAVSQITDGQVQAAKSTAAAVSQITDGQVQAAKSTAAAASQISDGQVQATTSTKAAASQITDGQIQASKTTSGASQVSDGQVQATAEVKDANDPVDVVSCNNNSTLSMSLSKGILTDRKGRIGSIVANRQFQFDGPPPQAGAIYAAGWSITPEGNLALGDQDTFYQCLSGDFYNLYDKHIGSQCHEVYLQAIDLIDC

SEQ ID NO: 25501 - protein, 502 aa, Saccharomyces cerevisiae
  strain ATCC 204508 / S288c
MNNNNVTEATSRAQIRPYYDPDSFNAGYSAVFKPDEGVVDPHGYTIASKLNVINSSPTTKRMANALFKSSPMKKLSNSVNDGLSLEGSNGEITGLNNFEWAELVNIQKWRKIFEQLLDMFFRKYFQLLIQQPFDVARLLIQVGEFKIFKTTVDTNKPQAPIILRDEEGDGAAREGEEDAYDEEEIDFFPIERKIAEANSTAPIMAEETDHSHHEPTDISLTIAPQSLHTIDVINALFDQEGIRGLWKANNTTFIYNFLSLSIDTWFTGLLSSFLGVPDPYFMEVINSPDISKSFILALGAGVFTSIILLPVDLIRTRLIVTSFKKKKNVKTDGKNMVTNTRSLRQLIRCWSWRKNGVSIPLDMWSLTILQSINNSFFNKLFDLVIYNQFHIEKYSQTVMYNTMKFFSKSLELFIKLPLENLLRRCQLNYLLNDQRLSFKVDSTELIVKPKKYNGIWDVIRNNSNTNRGQLWNGWKVGVISLICGYGLQMMNKVDINMEQEKF

SEQ ID NO: 25502 - protein, 524 aa, Saccharomyces cerevisiae
  strain ATCC 204508 / S288c
MQLSKSILLAALAATPSLVNAMLPIHIKNYRFIKPSSATNSESDNEVFFVKGVDYQPGGSSGYDADSDTDILSDPEVCARDAYAFQQLGVNTVRIYSLNPDLNHDKCMTIFNNAGIYAILDVNSGNYGESLNRADPSGTYDSLYLSRVFKFIDAFKNYPNVLGFFSGNEVINDQSDYAKIDPPYIRAVQRDMKQYISKHANRSIPVGYSAADNTDLRLATFKYLQCNSLDGNKVNDDLDISKSDFFGLNTYEWCSGTSSWESSGYDKLNSTFEDAVIPLIFSEYGCNKNTPRTFDEVSEGLYGGLKNVFSGGLVYEYTEEANNYGLVKLDDSGSLTYKDDFVNLESQLKNVSLPTTKESEISSDSIYKCDNSAITNIYSGFGTNNFTLPSQPAEIANMIEYGVNGTNTGKILTDYAVPTTFNYTIKNNKDDTISATISYDKANSLNELDVTATTVAKSASTSQSSSRSLTSSTSPSSSTGSSSSTGSSSASSSSKSKGVGNIVNVSFSQSGYLALFAGLISALL

SEQ ID NO: 25503 - protein, 156 aa, Saccharomyces cerevisiae
  strain ATCC 204508 / S288c
MARSRGSSRPISRSRPTQTRSASTMAAPVHPQQQQQPNAYSHPPAAGAQTRQPGMFAQMASTAAGVAVGSTIGHTLGAGITGMFSGSGSDSAPVEQQQQNMANTSGQTQTDQQLGRTCEIDARNFTRCLDENNGNFQICDYYLQQLKACQEAARQY

SEQ ID NO: 25504 - protein, 706 aa, Saccharomyces cerevisiae
  strain ATCC 204508 / S288c
MQLRNILQASSLISGLSLAADSSSTTGDGYAPSIIPCPSDDTSLVRNASGLSTAETDWLKKRDAYTKEALHSFLSRATSNFSDTSLLSTLFSSNSSNVPKIGIACSGGGYRAMLGGAGMIAAMDNRTDGANEHGLGGLLQSSTYLSGLSGGNWLTGTLAWNNWTSVQEIVDHMSESDSIWNITKSIVNPGGSNLTYTIERWESIVQEVQAKSDAGFNISLSDLWARALSYNFFPSLPDAGSALTWSSLRDVDVFKNGEMPLPITVADGRYPGTTVINLNATLFEFTPFEMGSWDPSLNAFTDVKYLGTNVTNGKPVNKDQCVSGYDNAGFVIATSASLFNEFSLEASTSTYYKMINSFANKYVNNLSQDDDDIAIYAANPFKDTEFVDRNYTSSIVDADDLFLVDGGEDGQNLPLVPLIKKERDLDVVFALDISDNTDESWPSGVCMTNTYERQYSKQGKGMAFPYVPDVNTFLNLGLTNKPTFFGCDAKNLTDLEYIPPLVVYIPNTKHSFNGNQSTLKMNYNVTERLGMIRNGFEAATMGNFTDDSNFLGCIGCAIIRRKQESLNATLPPECTKCFADYCWNGTLSTSANPELSGNSTYQSGAIASAISEATDGIPITALLGSSTSGNTTSNSTTSTSSNVTSNSNSSSNTTLNSNSSSSSISSSTARSSSSTANKANAAAISYANTNTLMSLLGAITALFGLI

SEQ ID NO: 25505 - protein, 179 aa, Saccharomyces cerevisiae
  strain ATCC 204508 / S288c
MKSFQKSYEFDYPWEKVTTANWMKYPNKISTHVIAVDVLRRELKEHGDVLLTERLITIRQNTPHWMSILVGNTNLAYVREVSTVDRRDRSLTMRSCNMTFPHILKCYETVRYVPHPKNPSNVTLFKQDAKFLSGVPTKTFSEKVENWGVKRFSDNAVKGKVGFDSILAMFNDIWKNANE

SEQ ID NO: 25506 - protein, 121 aa, Saccharomyces cerevisiae
  strain ATCC 204508 / S288c
MSDILDEIVIEDVVANCPQEFLQYHKCIRDNEENPGKCKDGRMILSTCIREKVPSVKSIMSECSEPMKKYDQCIRDNMGTRTINENCLGFLQDLRKCAELQVKNKNIKPSINGVNLELIKD

SEQ ID NO: 25507 - protein, 133 aa, Saccharomyces cerevisiae
  strain ATCC 204508 / S288c
MNNKLIYRSVRFATHNSQLLLPPLVLYRRILRQHKLLPGPQREMGDQYVRNEFKLHKDIDNPLHIVGFLASWQDYLHMISNGKWKDATLSSETLEKLSPEQTVQLYELMKETQKLHQDNEIESSKDVKRNNKD

SEQ ID NO: 25508 - protein, 528 aa, Saccharomyces cerevisiae
  strain ATCC 204508 / S288c
MKLSSAFVLSAITVAALGESITTTITATKNGHVYTKTVTQDATFVWAGEGAAVTSAVTEASTVAATSAAAETSVAAETSIVEPSTSAQGTSADEGSGSSITTTITATKNGHVYTKTVTQDATFVWTGEGERAPASTVATVETSVAAETSVAEPSTSAQGTSADEGSGSSITTTITATKNGHVYTKTVTQDATFVWTGEGERAPVSTVATVETAASPVTSVAEPSASTDEGSGSSITTTITATKNGHVYTKTVTQDATFVWTGEGERAPASTVATSSISAIEIPSTTEASIVEASSAVETSSAAETSSAVETSSAVETSSAVETSSAAETSSAAETSSAVETSSAVEISSAVETSAVETSSSSSTIETTSVKSLSPTQTSLSSSVQASSPIETSSAAKTSSVVPTFSSTTTENSSNSKSTSAVVASTTTSSESSATIVTPTRIGQAYTESSSRDAQSVRTHESNNWSSSSSASTKMVSSITRVQTTTAGIFTNGKSSTTPQIVNYTGAADSIAAGTGLMGAALAAVIFL

SEQ ID NO: 25509 - protein, 532 aa, Saccharomyces cerevisiae
  strain ATCC 204508 / S288c
MSNDGSKILNYTPVSKIDEIVEISRNFFFEKQLKLSHENNPRKKDLEFRQLQLKKLYYAVKDHEEELIDAMYKDFHRNKIESVLNETTKLMNDILHLIEILPKLIKPRRVSDSSPPFMFGKTIVEKISRGSVLIIAPFNFPLLLAFAPLAAALAAGNTIVLKPSELTPHTAVVMENLLTTAGFPDGLIQVVQGAIDETTRLLDCGKFDLIFYTGSPRVGSIVAEKAAKSLTPCVLELGGKSPTFITENFKASNIKIALKRIFFGAFGNSGQICVSPDYLLVHKSIYPKVIKECESVLNEFYPSFDEQTDFTRMIHEPAYKKAVASINSTNGSKIVPSKISINSDTEDLCLVPPTIVYNIGWDDPLMKQENFAPVLPIIEYEDLDETINKIIEEHDTPLVQYIFSDSQTEINRILTRLRSGDCVVGDTVIHVGITDAPFGGIGTSGYGNYGGYYGFNTFSHERTIFKQPYWNDFTLFMRYPPNSAQKEKLVRFAMERKPWFDRNGNNKWGLRQYFSLSAAVILISTIYAHCSS

SEQ ID NO: 25510 - protein, 128 aa, Saccharomyces cerevisiae
  strain ATCC 204508 / S288c
MATTDIISLVKNNLLYFQMWTEVEILQDDLSWKGNSLRLLRGRPPHKLSNDVDTEHENSLSSPRPLEFILPINMSQYKENFLTLECLSQTFTHLCSPSTERILLAIINDDGTIVYYFVYKGVRKPKRN

SEQ ID NO: 25511 - protein, 389 aa, Saccharomyces cerevisiae
  strain ATCC 204508 / S288c
MRFSNFLTVSALLTGALGAPAVRHKHEKRDVVTATVHAQVTVVVSGNSGETIVPVNENAVVATTSSTAVASQATTSTLEPTTSANVVTSQQQTSTLQSSEAASTVGSSTSSSPSSSSSTSSSASSSASSSISASGAKGITYSPYNDDGSCKSTAQVASDLEQLTGFDNIRLYGVDCSQVENVLQAKTSSQKLFLGIYYVDKIQDAVDTIKSAVESYGSWDDITTVSVGNELVNGGSATTTQVGEYVSTAKSALTSAGYTGSVVSVDTFIAVINNPDLCNYSDYMAVNAHAYFDENTAAQDAGPWVLEQIERVYTACGGKKDVVITETGWPSKGDTYGEAVPSKANQEAAISSIKSSCGSSAYLFTAFNDLWKDDGQYGVEKYWGILSSD

SEQ ID NO: 25512 - protein, 967 aa, Saccharomyces cerevisiae
  strain ATCC 204508 / S288c
MFNRFNKLQAALALVLYSQSALGQYYTNSSSIASNSSTAVSSTSSGSVSISSSIELTSSTSDVSSSLTELTSSSTEVSSSIAPSTSSSEVSSSITSSGSSVSGSSSITSSGSSVSSSSSATESGSSASGSSSATESGSSVSGSSTSITSGSSSATESGSSVSGSTSATESGSSASGSSSATESGSSASGSSSATESGSSVSGSSSATESGSSVSGSSSATESGSASSVPSSSGSVTESGSSSSASESSITQSGTASGSSASSTSGSVTQSGSSVSGSSASSAPGISSSIPQSTSSASTASGSITSGTLSSITSSASSATATASNSLSSSDGTIYLPSTTISGDITLTGSVIATEAVEVAAGGKLTLLDGDKYVFSADFIIHGGVFVEKSKPTYPGTEFDISGENFDVSGTFNAEEPAASSASAYSFTPGSFDNSGDISLSLSESTKGEVTFSPYSNSGAFSFSNAILNGGSVSGLQRRAESGSVNNGEINLENGSTYVVVEPVSGSGTINIISGNLYLHYPDTFTGQTVVFKGEGVLAVDPTETNTTPIPVVGYTGENQIAITADVTALSYDSATGVLTATQGNSQFSFSIGTGFSSSGFNVSEGTFAGAYAYYLNYGGVVASSATPSSTSTTSGATNSTSGSTSFGASVTGSTASTSFGASVTGSTASTLISGSPSVYTTTLTYATTTSTVVVSCSETTDSNGNVYTITTTVPCSSTTATITSCDETGCHVTTSTGTVATETVSSKSYTTVTVTHCDNNGCNTKTVTSECPEETSATTTSPKSYTTVTVTHCDDNGCNTKTVTSEAPEATTTTVSPKTYTTATVTQCDDNGCSTKTVTSEAPKETSETSETSAAPKTYTTATVTQCDDNGCNVKIITSQIPEATSTVTATSASPKSYTTVTSEGSKATSLTTAISKASSAISTYSKSAAPIKTSTGIIVQSEGIAAGLNANTLNALVGIFVLAFFN

SEQ ID NO: 25513 - protein, 175 aa, Saccharomyces cerevisiae
  strain ATCC 204508 / S288c
MVLLHKSTHIFPTDFASVSRAFFNRYPNPYSPHVLSIDTISRNVDQEGNLRTTRLLKKSGKLPTWVKPFLRGITETWIIEVSVVNPANSTMKTYTRNLDHTGIMKVEEYTTYQFDSATSSTIADSRVKFSSGFNMGIKSKVEDWSRTKFDENVKKSRMGMAFVIQKLEEARNPQF

SEQ ID NO: 25514 - protein, 161 aa, Saccharomyces cerevisiae
  strain ATCC 204508 / S288c
MCLVKTTAHLLFYSFVFGGTTFYSYVASPIAFKVLEKDQFSALQNKIFPYFFQMQAASPVILALTAPIALTTGPLSSLVVASVSGLTNLFWLLPWTHKVKEQRKNIAKKYTGSELEAKDAILRKEFGKSHGLSLLFNLSNVCGMLAYGVCLSGGLLRKIPK

SEQ ID NO: 25515 - protein, 491 aa, Saccharomyces cerevisiae
  strain ATCC 204508 / S288c
MNSPTMKSEQLTPKLSPMSFCLDDQRNAGSFQNLLNSPTKLKLDTGPIGNSLLYPTSLSKLSELSRGGRSKQRRGSDTMRSVSPIRFQFLNNTPKMLKPEYLSQTTSNLPLLSALLKNSKKTTSEGQNSNPDPLNIEKNIIKQSIKDKLEQLRSSESVAQVQKKERNPPSFEAKVCAEEPILRKNAEGLLPSYVPVPATPLEDPENHGVRKVEDKGLRVVSGGSTQCLSTEVNELPKDLNLDNLPTDNNGFVQYGLKGNNNNNRYSFISSTSTDYEPEWCDGQQHISMQMASMANAEEANSREKSNLDIKIKQLELEITELKLQNEKLVHSMTTNRYIEERFMLEVMKDPSIQAQRSQRDIERKVKQLEKKFFNCKKVLKKLTESSAVVATSTSKTEGNSARIPCPKTRLARVSVLDLKKIEEQPDSSSGTSSEEDHLTNDDTDANTSEDLNVAFEEEPTSAISTTASVQSGESKRGFQLNLPVQVEKKEK

SEQ ID NO: 25516 - protein, 511 aa, Saccharomyces cerevisiae
  strain ATCC 204508 / S288c
MVGHSAQHRSKSSLVSHLLILLIFITIIIEMCLYNKIFKNQRSDDIRDNFNNGGHRVPSNVQNHGTHIRDEAFISGVYYSNWSPYKPRFHFPHDINLKQVSHIYYAFFKINSRTGGIENTDSWSDLEMNLYKSLAIKNSELIKESSNNSVQNILPLGCIGELFYLKNTCSDKKFKVIMSIGGWSDSENFKIIIKDDKLLQNFVDSSVETMFRLGFDGIDLDWEFPGNNESEPRGYLKLVRMLRLKLNSLESQIFGKRTEDHFQLSIAAPAFKDKLFYLPITEIDQYVDYWNMMTYDYYGSWSETTGYHSNLFSETELNGNFAMHYMIDRFGVNSRKLVLGMAAYGRSFHIKDNKFEPFNQNTVLINKIFKGVGKPTKEIDKADGKEGIWPYKNLPKIGTIEQYDPKYVSAYCFDEKNSIFISYDNTKSVKTKAEYVTHNNLGGGFWWESCGEAYANESRSLINAFNEGLHFNVSSKPSIFQDVRVKKYYLNKYGDGGFLSPYLKHLDSRKQ

SEQ ID NO: 25517 - protein, 572 aa, Saccharomyces cerevisiae
  strain ATCC 204508 / S288c
MVIILLGLCTLGFPRTAFCPSIMTNSTVSINTPPPYLTLACNEKLPTVMSIAGSDSSGGAGVEADIKTITAHRCYAMTCVTTLTAQTPVKVYGAQNIPKKMVSQILDANLQDMKCNVIKTGMLTVDAIEVLHEKLLQLGENRPKLVIDPVLCAASDSSPTGKDVVSLIIEKISPFADILTPNISDCFMLLGENREVSKLQDVLEIAKDLSRITNCSNILVKGGHIPCDDGKEKHITDVLYLGAEQKFITFKGQFVNTTRTHGAGCTLASAIASNLARGYSLSQSVYGGIEYVQNAIAIGCDVTKKAVKVGPINHVYAVEIPLEKMLTDECFTASDAVPKKPIEGSLDKIPGGSFFNYLINHPKVKPHWDAYVNHEFVKRVADGTLERKKFQFFIEQDYLYLIDYVRVCCVTGSKSPTLEDLEKDLVIADCARNELNEHERRLREEFGVKDPDYLQKIKRGPALRAYCRYLIDISRRGNWQEIVVALNPCLMGYVYAVDKVKDKITAAEGSIYSEWCDTCASSFCYQAVLEGERLMNHILETYPPDQLDSLVTIFARGCELETNFWTAAMEYE

SEQ ID NO: 25518 - protein, 381 aa, Saccharomyces cerevisiae
  strain ATCC 204508 / S288c
MSFRDVLERGDEFLEAYPRRSPLWRFLSYSTSLLTFGVSKLLLFTCYNVKLNGFEKLETALERSKRENRGLMTVMNHMSMVDDPLVWATLPYKLFTSLDNIRWSLGAHNICFQNKFLANFFSLGQVLSTERFGVGPFQGSIDASIRLLSPDDTLDLEWTPHSEVSSSLKKAYSPPIIRSKPSWVHVYPEGFVLQLYPPFENSMRYFKWGITRMILEATKPPIVVPIFATGFEKIASEAVTDSMFRQILPRNFGSEINVTIGDPLNDDLIDRYRKEWTHLVEKYYDPKNPNDLSDELKYGKEAQDLRSRLAAELRAHVAEIRNEVRKLPREDPRFKSPSWWKRFNTTEGKSDPDVKVIGENWAIRRMQKFLPPEGKPKGKDD

SEQ ID NO: 25519 - protein, 545 aa, Saccharomyces cerevisiae
  strain ATCC 204508 / S288c
MLPRLGFARTARSIHRFKMTQISKPFFHSTEVGKPGPQQKLSKSYTAVFKKWFVRGLKLTFYTTLAGTLYVSYELYKESNPPKQVPQSTAFANGLKKKELVILGTGWGAISLLKKLDTSLYNVTVVSPRSFFLFTPLLPSTPVGTIEMKSIVEPVRSIARRTPGEVHYIEAEALDVDPKAKKVMVQSVSEDEYFVSSLSYDYLVVSVGAKTTTFNIPGVYGNANFLKEIEDAQNIRMKLMKTIEQASSFPVNDPERKRLLTFVVVGGGPTGVEFAAELQDYINQDLRKWMPDLSKEMKVILIEALPNILNMFDKTLIKYAEDLFARDEIDLQVNTAVKVVEPTYIRTLQNGQTNTDIEYGMLVWATGNEPIDFSKTLMSRIPEQTNRRGLLINDKLELLGSENSIYAIGDCTAHTGFFPTAQVAHQEGEYLAKILDKKLQIEQLEWDMLNSTDETEVSRLQKEVNLRKSKLDKFNYKHMGALAYIGSETAIADLHMGDSSYQLKGMFAFLFWKSAYLAMCLSIRNRILIAMDWTKVYFLGRDSSV

SEQ ID NO: 25520 - protein, 879 aa, Saccharomyces cerevisiae
  strain ATCC 204508 / S288c
MEMNMDMDMDMELASIVSSLSALSHSNNNGGQAAAAGIVNGGAAGSQQIGGFRRSSFTTANEVDSEILLLHGSSESSPIFKKTALSVGTAPPFSTNSKKFFGNGGNYYQYRSTDTASLSSASYNNYHTHHTAANLGKNNKVNHLLGQYSASIAGPVYYNGNDNNNSGGEGFFEKFGKSLIDGTRELESQDRPDAVNTQSQFISKSVSNASLDTQNTFEQNVESDKNFNKLNRNTTNSGSLYHSSSNSGSSASLESENAHYPKRNIWNVANTPVFRPSNNPAAVGATNVALPNQQDGPANNNFPPYMNGFPPNQFHQGPHYQNFPNYLIGSPSNFISQMISVQIPANEDTEDSNGKKKKKANRPSSVSSPSSPPNNSPFPFAYPNPMMFMPPPPLSAPQQQQQQQQQQQQEDQQQQQQQENPYIYYPTPNPIPVKMPKDEKTFKKRNNKNHPANNSNNANKQANPYLENSIPTKNTSKKNASSKSNESTANNHKSHSHSHPHSQSLQQQQQTYHRSPLLEQLRNSSSDKNSNSNMSLKDIFGHSLEFCKDQHGSRFIQRELATSPASEKEVIFNEIRDDAIELSNDVFGNYVIQKFFEFGSKIQKNTLVDQFKGNMKQLSLQMYACRVIQKALEYIDSNQRIELVLELSDSVLQMIKDQNGNHVIQKAIETIPIEKLPFILSSLTGHIYHLSTHSYGCRVIQRLLEFGSSEDQESILNELKDFIPYLIQDQYGNYVIQYVLQQDQFTNKEMVDIKQEIIETVANNVVEYSKHKFASNVVEKSILYGSKNQKDLIISKILPRDKNHALNLEDDSPMILMIKDQFANYVIQKLVNVSEGEGKKLIVIAIRAYLDKLNKSNSLGNRHLASVEKLAALVENAEV

SEQ ID NO: 25521 - protein, 124 aa, Saccharomyces cerevisiae
  strain ATCC 204508 / S288c
MVKLTSIVAGVAAIAAGVAAAPATTTLSPSDERVNLVELGVYVSDIRAHLAEYYMFQAAHPTETYPVEIAEAVFNYGDFTTMLTGIPADQVTRVITGVPWYSTRLRPAISSALSKDGIYTAVPN

SEQ ID NO: 25522 - protein, 224 aa, Saccharomyces cerevisiae
  strain ATCC 204508 / S288c
MIFAPSFSLIKNILLVSFLISHSFAAKTLTSSSNDDTLARSAAADADMAFFMEFLNDFDTAFPQYTSYMMQNHLTLPQPVADYYYHMVDLASTADLQSDIAQSFPFTQFQTFITAFPWYTSLLNKASATTIYLPQHFITGETEATMTNSSYASQKNSVSNSVPFSTANAGQSMISMANEENSTTALISASNSSSTSRTSQSQNGAHAKSLYFPMALFGIFAVAL

SEQ ID NO: 25523 - protein, 161 aa, Saccharomyces cerevisiae
  strain ATCC 204508 / S288c
MKISQFGSLAFAPIVLLQLFIVQAQLLTDSNAQDLNTALGQKVQYTFLDTGNSNDQLLHLPSTTSSSIITGSLAAANFTGSSSSSSIPKVTSSVITSINYQSSNSTVVTQFTPLPSSSRNETKSSQTTNTISSSTSTGGVGSVKPCLYFVLMLETIAYLFS

SEQ ID NO: 25524 - protein, 686 aa, Saccharomyces cerevisiae
  strain ATCC 204508 / S288c
MIRPLCSKIIISYIFAISQFLLAANAWSPTDSYVPGTVSCPDDINLVREATSISQNESAWLEKRNKVTSVALKDFLTRATANFSDSSEVLSKLFNDGNSENLPKIAVAVSGGGYRSMLTGAGVLAAMDNRTEGAYEHGLGGLLQSTTYLSGASGGNWLVGTLALNNWTSVQDILNNMQNDDSIWDLSDSIVTPGGINIFKTAKRWDHISNAVESKQNADYNTSLADIWGRALAYNFFPSLNRGGIGLTWSSIRDFPVFQNAEMPFPISVADGRYPGTKVINLNATVFEFNPFEMGSWDPSLNSFANVKYLGTNVSNGVPLERGKCTAGFDNAGFIMGTSSTLFNQFLLRINSTHLPSFITRLARHFLKDLSQDFNDIAVYSPNPFKDTKFLDSDYTTSIVDSDSLFLVDGGEDDENVPVLPLIQKERDVDIIFAVDNSADMRLAWPDGSSLVHTYERQFVKQGQGMSFPYVPDTNTFVNLGLNKKPTFFGCDANNLTDLQYIPPLVVYLPNAEYSFNSNQSAFKLSYSESQRRSMIQNGFEIATRNNFTDDPEFMGCVGCAIIRRKQQALNITLPPECETCFKNYCWNGTLDTTPLPDVEKDVHHSFINVNSFNSSIGQEESLYAGSSASQSSSSSSSSSSSSEIPSATATLEKKAATNSGSHLSGISVKFSAMIMLTLLMFTGAV

SEQ ID NO: 25525 - protein, 113 aa, Saccharomyces cerevisiae
  strain ATCC 204508 / S288c
MTEVVGFWESVSDDESEDKDCMEVQNTVSADESPLVQSLVSFVGSCSINLLLPFLNGMMLGFGELFAHELCWRFNWFNHRNKGYKVYPESRKIAALKEISSPGTRGRVASKFL

SEQ ID NO: 25526 - protein, 484 aa, Saccharomyces cerevisiae
  strain ATCC 204508 / S288c
MLLRSLTSAFVLSAGLAQAASSSNSSTPSIEIKGNAFFNSESGERFYIRGVDYQPGGSSNLTDPLADASVCDRDVPVLKDLGINTVRVYTVDNSQDHSHCMKLLQENGIYLILDVNTPTSAISRYDPACSYNADYLQNVFATIDTFADYDNVLGFFAGNEVINSVNTTNTATYVKAVVRDMKKYIKARKYRQIPVGYSAADIVANRQLAAEYFNCGDEADARIDMFGVNDYSWCGESSFVVSGYSTKMKLYQDYSVPVFLSEFGCNQVKSSRPFTEIEAIYSTQMSSVFSGGLVYEYSNETNNYGLVQIDGDKVTKLTDFENLKNEYSKVSNPEGNGGYSTSNNYSTCPDYEKGVWEANNTLPAMPSAASAYFTSGAGSPMGTGIATQQSCDAKDDDDEEDDDTSSSSSSSSSSSSSASSSSESSSSTSKASSSSPSASETSLLKSAASATSSSQSSSKSKGAAGIIEIPLIFRALAELYNLVL

SEQ ID NO: 25527 - protein, 210 aa, Saccharomyces cerevisiae
  strain ATCC 204508 / S288c
MLQSVVFFALLTFASSVSAIYSNNTVSTTTTLAPSYSLVPQETTISYADDTTTFFVTSTVYSTSWFTSTSATITNAASSSLSTSSASGSVTPESTHEITSTSTITSTLLLTLHDSTTLSPSSTAASVSDEDSNNKDAKVKSFEQASTSNGCVPITKFVTVTNEPVTQYVTVTPNTTTQYVTVTGAPSVTTTSPGNVQWYNTTSITNSTSW

SEQ ID NO: 25528 - protein, 153 aa, Saccharomyces cerevisiae
  strain ATCC 204508 / S288c
MKFSTIFGATTVMTAVSAAAVSSVMTTKTITATNGNNVYTKVVTDTADPIISYSTTRTVVVSNSDATYTKVVTEGPDTTSEKSTTKTLTLTNGSGSSTNLYTKTVTQAVESSTSSSSSSSSSSSSASSSGAAPAAFQGASVGALALGLISYLL

SEQ ID NO: 25529 - protein, 204 aa, Saccharomyces cerevisiae
  strain ATCC 204508 / S288c
MKFSSALVLSAVAATALAESITTTITATKNGHVYTKTVTQDATFVWGGEDSYASSTSAAESSAAETSAAETSAAATTSAAATTSAAETSSAAETSSADEGSGSSITTTITATKNGHVYTKTVTQDATFVWTGEGSSNTWSPSSTSTSSEAATSSASTTATTTAETSSSATSSSTAELSSYTGAADAITAGTGLMGAALAAVMLL

SEQ ID NO: 25530 - protein, 624 aa, Saccharomyces cerevisiae
  strain ATCC 204508 / S288c
MRFHRQGTAATVGVLLIVLLGFCWKLSESYGIVSTALPHKQPATKITDTPSIRWDNYHEFVRDIDFDNSTAIFNSIRAALRQSPSDIHPVGVSYFPAVIPKGTLMYHAGSKVPTTFEWLAMDHEFSYSFGLRSPSYGRKSLERRHGRFGNGTHGDHPKGPPPPPPPDEKDRGSQKMLTYRAARDLNKFLYLDGASAAKTDSGEMDTQLMLSNVIKEKLNLTDDGENERMAERLYAARICKWGKPFGLDGIIRVEVGFEVVLCDFSADNVELVSMLEMVQPNQYLGLPAPTVISKEEGWPLDENGNLVEDQLTDDQKAILEREDGWEKTFSNFNAVKSFNQLRAGTAHDNGEHRIHIDYRYLVSGINRTYIAPDPNNRRLLDEGMTWEKQLDMVDDLEKALEVGFDATQSMDWQLAFDELVLKFAPLLKSVSNILNSNGDINESIAINATALTLNFCLRFEPASNNSDEFGSGKDFAVYQYVSPYQALKTDADFLIWSSAVSVVGEIVDAIYKVNDLLIPEVYSFMTDNTTSSDLIKNVETARSTIDGLIESLGWIELNYRCERQCNWDEVCYTPSWGPSPMGMTEPGSHNEGFGTHFDESRQRLVINSKLQCININDLMVNRNH

SEQ ID NO: 25531 - protein, 304 aa, Saccharomyces cerevisiae
  strain ATCC 204508 / S288c
MVTIVFDHPAEDFPELKIAGEFTNWEGVPMKINTSSGKWEYKFDESSVTKHNDKDKVHFKFIDQNGNWFADDEYPKEVDEHSNENNVATLNNEEDGGSAGEEKDEGDKTAHNTNENGSELYYEGPETPTPSLKGNVTFPSPKTAISQDGSAFAKETTRKERKYEHAPLNEVPVERDPKEENKELSPNFSQEQTENKQDKGLDNLSEGNDNDNTRVNEDTDVTDTQESEHEINGSDTENTDMSEQEEIQKIDKPADQNAKSIVKEGDANTEDYESVLKKLLGALGRFFGSWFSWLTTKMSSSEAS

SEQ ID NO: 25532 - protein, 133 aa, Saccharomyces cerevisiae
  strain ATCC 204508 / S288c
MTAMKEDNAALITLKKNNDQEKLRVHKLTDASSNSADGFVINKAKNGGPLNKKSLVNNEQHIKKAVSPGRVRKHKTTTSSTKSRTKSKKKDASESKVQRENKGSFYQGAIFGSFLGAAVTTVLSNLAVKALQN

SEQ ID NO: 25533 - protein, 302 aa, Saccharomyces cerevisiae
  strain ATCC 204508 / S288c
MIKLHEVPPEPVDPASLPHDVNAHSPEGDGNPDKRKKIFGIPYPFSRSSCRRFLWNCQKISVLPMALYFPLHAANTLITPAVSPDSAPDDVLMMVREILPSITTKLLVAGITLHVSAGVLLRIVNNWNKPRRNRHRHLKISAEQDLSQDSIGLTGGISGYLFGLYKTFRIPPQVISGYILVPVLIYHLLIMKWVPNSISTEVDFASIKQLLSSKNRWWKWLGGLVPLAILLESGVYHIGSGLCRYFGVRKMTSRKKWSTAINLLTLVGFVSLIRLMKEDSTKLGPNQFESIFKKIRLLLHVN

SEQ ID NO: 25534 - protein, 133 aa, Saccharomyces cerevisiae
  strain ATCC 204508 / S288c
MQFSTVASIAAVAAVASAAANVTTATVSQESTTLVTITSCEDHVCSETVSPALVSTATVTVDDVITQYTTWCPLTTEAPKNGTSTAAPVTSTEAPKNTTSAAPTHSVTSYTGAAAKALPAAGALLAGAAALLL

SEQ ID NO: 25535 - protein, 487 aa, Saccharomyces cerevisiae
  strain ATCC 204508 / S288c
MAYSKITLLAALAAIAYAQTQAQINELNVVLDDVKTNIADYITLSYTPNSGFSLDQMPAGIMDIAAQLVANPSDDSYTTLYSEVDFSAVEHMLTMVPWYSSRLLPELEAMDASLTTSSSAATSSSEVASSSIASSTSSSVAPSSSEVVSSSVAPSSSEVVSSSVAPSSSEVVSSSVASSSSEVASSSVAPSSSEVVSSSVASSSSEVASSSVAPSSSEVVSSSVAPSSSEVVSSSVASSSSEVASSSVAPSSSEVVSSSVASSTSEATSSSAVTSSSAVSSSTESVSSSSVSSSSAVSSSEAVSSSPVSSVVSSSAGPASSSVAPYNSTIASSSSTAQTSISTIAPYNSTTTTTPASSASSVIISTRNGTTVTETDNTLVTKETTVCDYSSTSAVPASTTGYNNSTKVSTATICSTCKEGTSTATDFSTLKTTVTVCDSACQAKKSATVVSVQSKTTGIVEQTENGAAKAVIGMGAGALAAVAAMLL

SEQ ID NO: 25536 - protein, 236 aa, Saccharomyces cerevisiae
  strain ATCC 204508 / S288c
MLGLYLSSLFFAFFMAQVFATKYSITFTSDEYEEDETGQNEPGPLVFHLDKNSLPPALLNQMEFNPYLVLADLPEEPRAVDSQEHTDTVLASKSVIDFLLEDPLTIVEHKKFSQIESILHEIMEDSIQKKVGADEVFEEIPKPKIYAYEDILVTNMSIINNSEMPTSTATLTSTISYLSSTTSLALSTGVTSVEIFPTITPGNITTIGGYENSSSSLMPSMGILSFLFGLYLLLHP

SEQ ID NO: 25537 - protein, 69 aa, Saccharomyces cerevisiae
  strain ATCC 204508 / S288c
MTETDKKQEQENHAECEDKPKPCCVCKPEKEERDTCILFNGQDSEKCKEFIEKYKECMKGYGFEVPSAN

SEQ ID NO: 25538 - protein, 198 aa, Saccharomyces cerevisiae
  strain ATCC 204508 / S288c
MPRVAIIIYTLYGHVAATAEAEKKGIEAAGGSADIYQVEETLSPEVVKALGGAPKPDYPIATQDTLTEYDAFLFGIPTRFGNFPAQWKAFWDRTGGLWAKGALHGKVAGCFVSTGTGGGNEATIMNSLSTLAHHGIIFVPLGYKNVFAELTNMDEVHGGSPWGAGTIAGSDGSRSPSALELQVHEIQGKTFYETVAKF

SEQ ID NO: 25539 - protein, 444 aa, Saccharomyces cerevisiae
  strain ATCC 204508 / S288c
MQLHSLIASTALLITSALAATSSSSSIPSSCTISSHATATAQSDLDKYSRCDTLVGNLTIGGGLKTGALANVKEINGSLTIFNATNLTSFAADSLESITDSLNLQSLTILTSASFGSLQSVDSIKLITLPAISSFTSNIKSANNIYISDTSLQSVDGFSALKKVNVFNVNNNKKLTSIKSPVETVSDSLQFSFNGNQTKITFDDLVWANNISLTDVHSVSFANLQKINSSLGFINNSISSLNFTKLNTIGQTFSIVSNDYLKNLSFSNLSTIGGALVVANNTGLQKIGGLDNLTTIGGTLEVVGNFTSLNLDSLKSVKGGADVESKSSNFSCNALKALQKKGGIKGESFVCKNGASSTSVKLSSTSKSQSSQTTAKVSKSSSKAEEKKFTSGDIKAAASASSVSSSGASSSSSKSSKGNAAIMAPIGQTTPLVGLLTAIIMSIM

SEQ ID NO: 25540 - protein, 114 aa, Saccharomyces cerevisiae
  strain ATCC 204508 / S288c
MSNPFQNIGKNLLYISAAGIASIYVVKTIVKARRDAKFIPKARGNNGEVNEKNYYDNLAQVKPGFPIPKDGGDNIDCSEDHQLVRKSKYEGSGLSAVTRKRGDKLGFLDRRRNE

SEQ ID NO: 25541 - protein, 98 aa, Saccharomyces cerevisiae; identical to SEQ ID NO: 3579
  strain ATCC 204508 / S288c

SEQ ID NO: 25542 - protein, 54 aa, Saccharomyces cerevisiae
  strain ATCC 204508 / S288c
MLLCFHMCQRIMWLPFDLMKWRRFHCGAVLVGTLSLRNRSPKILSLYFISDRTG

SEQ ID NO: 25543 - protein, 74 aa, Saccharomyces cerevisiae
  strain ATCC 204508 / S288c
MIAQSTRLAAAVSSSAASAGVSRIAASAMASTIFKRSPGNSFNSFKEYRENAKTYGPLSASLATRRHLAHAPKL

SEQ ID NO: 25544 - protein, 73 aa, Saccharomyces cerevisiae
  strain ATCC 204508 / S288c
MSNPCQKEACAIQDCLLSHQYDDAKCAKVIDQLYICCSKFYNDNGKDSRSPCCPLPSLLELKMKQRKLTPGDS

SEQ ID NO: 25545 - protein, 79 aa, Saccharomyces cerevisiae
  strain ATCC 204508 / S288c
MKMNPCTVILCKSLFFFCLFQVDCYCNRKNIQNQSSRIATKIKRSYWFRWQKHIILANIHKIIKAYQRSIIKLPVTKGL

SEQ ID NO: 25546 - protein, 136 aa, Saccharomyces cerevisiae
  strain ATCC 204508 / S288c
MQFSTVASIAAIAAVASAASNITTATVTEESTTLVTITSCEDHVCSETVSPALVSTATVTVNDVITQYTTWCPLPTTEAPKNTTSPAPTEKPTEKPTEKPTQQGSSTQTVTSYTGAAVKALPAAGALLAGAAALLL

SEQ ID NO: 25547 - protein, 271 aa, Saccharomyces cerevisiae
  strain ATCC 204508 / S288c
MSFDINWSTLESDNRLNDLIRKHLNSYLQNTQLPSYVSNLRVLDFDLGKVGPAITLKEITDPLDEFYDSIREEADQETEENNDNKEDSEHICPDRTIANHEGPKDDFEAPVVMPSPNDIQFLLEVEYKGDLLVTIGADLVLNYPVEKFMTLPVKLSISDIGLHSLCIVACLSKQLFLSFLCDVSDPALDDNQTVLDPKGPILAATKPLERISIVRSMKIETEIGEQYQGQGSVLRSVGELEQFLFTIFKDFLRKELAWPSWINLDFNDGDE

SEQ ID NO: 25548 - protein, 662 aa, Saccharomyces cerevisiae
  strain AWRI1631
MTKETIRVVICGDEGVGKSSLIVSLTKAEFIPTIQDVLPPISIPRDFSSSPTYSPKNTVLIDTSDSDLIALDHELKSADVIWLVYCDHESYDHVSLFWLPHFRSLGLNIPVILCKNKCDSISNVNANAMVVSENSDDDIDTKVEDEEFIPILMEFKEIDTCIKTSAKTQFDLNQAFYLCQRAITHPISPLFDAMVGELKPLAVMALKRIFLLSDLNQDSYLDDNEILGLQKKCFNKSIDVNELNFIKDLLLDISKHDQEYINRKLYVPGKGITKDGFLVLNKIYAERGRHETTWAILRTFHYTDSLCINDKILHPKLVVPDTSSVELSPKGYRFLVDIFLKFDIDNDGGLNNQELHRLFKCTPGLPKLWTSTNFPFSTVVNNKGCITLQGWLAQWSMTTFLNYSTTTAYLVYFGFQEDARLALQVTKPRKMRRRSGKLYRSNINDRKVFNCFVIGKPCCGKSSLLEAFLGRSFSEEYSPTIKPRIAVNSLELKGGKQYYLILQELGEQEYAILENKDKLKECDVICLTYDSSDPESFSYLVSLLDKFTHLQDLPLVFVASKADLDKQQQRCQIQPDELADELFVNHPLHISSRWLSSLNELFIKITEAALDPGKNTPGLPEETAAKDVDYRQTALIFGSTVGFVALCSFTLMKLFKSSKFSK

SEQ ID NO: 25549 - protein, 493 aa, Saccharomyces cerevisiae
  strain AWRI1631
MLPYMDQVLRAFYQSTHWSTQNSYEDITATSRTLLDFRIPSAIHLQISNKSTPNTFNSLDFSTRSRINGSLSYLYSDAQQLENFMRNSTDIPLQDATETYRQLQPNLNFSVSSGNTLSSDNTTVDNDKKLLHDSKFVKKSLYYGRMYYPSSDLEAMIIKRLNPQTQFMLKGVSSFKESLNVLTCYFQRDSHRNLQEWIFSTSDLLCGYRVLHNFLTTPSKFNTSLYNNSSLSLGAEFWLGLVSLSPGCSTTLRYYTHSTNTGRPLTLTLSWNPLFGHISSTYSAKTGTNSTFCAKYDFNLYSIESNLSFGCEFWQKKHHLLETNKNNNDKLEPISDELVDINSNSRATKLLHENVPDLNLAVNDIPSTLDIPVHKQKLLNDLTYAFSSSLRKIDEERSTIEKFDNKINSSIFTSVWKLSTSLRDKTLKLLWEGKWRGFLISAGTELVFTRGFQESLSDDEKNDNAISISATDTENGNIPVFPTKFGIQFQYST

SEQ ID NO: 25550 - protein, 429 aa, Saccharomyces cerevisiae
  strain AWRI1631
MQFKNALTATAILSASALAANSSTSIPSSCSIGTSATATAQADLDKISGCSTIVGNLTITGDLGSAALASIQEIDGSLTIFNSSSLSSFSADSIKKITGDLNMQELIILTSASFGSLQEVDSINMVTLPAISTFSTDLQNANNIIVSDTTLESVEGFSTLKKVNVFNINNNRYLNSFQSSLESVSDSLQFSSNGDNTTLAFDNLVWANNITLRDVNSISFGSLQTVNASLGFINNTLPSLNLTQLSKVGQSLSIVSNDELSKAAFSNLTTVGGGFIIANNTQLKVIDGFNKVQTVGGAIEFTGNFSTLDLSSLKSVRGGAKFDSSSSNFSCNALKKLQSNGAIQGDSFVCKNGATSTSVKLSSTSTESSKSSATSSASSSGDASNAQANVSASASSSSSSSKKSKGAAPELVPATSFMGVVAAVAVALL

SEQ ID NO: 25551 - protein, 268 aa, Saccharomyces cerevisiae; identical to SEQ ID NO: 25483
  strain AWRI1631

SEQ ID NO: 25552 - protein, 459 aa, Saccharomyces cerevisiae
  strain AWRI1631
MSFRFNEAVFGDNSFNERVREKLSTALNSPSKKKLDILKSGIKVQKVDFPTIPQLEILDLDIITQPKSLAKGICKISCKDAMLRIQTVIESNLLLINEQDTPSFTMPQLINNGSFTIPITMTFSSIELEAITNIFVKNPGIGISFNDVDLDFKFDCSVKILQSTIERRLKESMHVVFKDVLPSLIFNTSQNWFTNRGESTSTIPGKREHHHQQTTMSRNVILDGSDFQELSPINMLRLSSIVSSRSTLSLHSTVMNSLSAIPGCLERQNLYRFISRMPSLNNYYSSQSFPQPKSSTVSSKQLVKPFYCSHNLLPKTVLDSSQYDLATITKIQSRLFDRSNSNDDNAKPRRRKIKCKKTRTPSNLQSQGEQAVDDSTAIETVTSTPVQTPIPELEEQSPPYLKTTVSIRDKYVIPEKISLNLDSKKDTSKKKPFYFIGLNSQEPSNNWKWGMEDSPPPYH

SEQ ID NO: 25553 - protein, 529 aa, Saccharomyces cerevisiae; identical to SEQ ID NO: 25464
  strain AWRI1631

SEQ ID NO: 25554 - protein, 276 aa, Saccharomyces cerevisiae; identical to SEQ ID NO: 25455
  strain AWRI1631

SEQ ID NO: 25555 - protein, 287 aa, Saccharomyces cerevisiae
  strain AWRI1631
MHYKKAFLASLLSSIALTAYAPPEPWATLTPSSKMDGGTTEYRTSFGLAVIPFTVTESKVKRNVISQINDGQVQVTTQKLPHPVSQIGDGQIQVTTQKVPPVVSHIVSQIGDGQLQITTAKNVVTKSTIAVPSKTATATATSTATAVSQIHDGQVQVTISSASSSSVLSKSKLEPTKKPNNENVIKVQACKSSGTLAITLQGGVLIDSNGRIGSIVANRQFQFDGPPPQAGAIYAGGWSITKHGTLAIGDNDVFYQCLSGTFYNLYDQSIGGQCNPVHLQTVGLVDC

SEQ ID NO: 25556 - protein, 303 aa, Saccharomyces cerevisiae
  strain AWRI1631
MQYKKTLVASALAATTLAAYAPSEPWSTLTPTATYSGGVTDYASTFGIAVQPISTTSSASSAATTASSKAKRAASQIGDGQVQAATTTASVSTKSSAAAVSQIGDGQIQATTKTTAAASLKLVMVKIQATTKTTAAAVSQIGDGQVQATTKTTAAAVSQITDGQVQATTKTTQAASQVSDGQVQATSATSASAAATSTDPVDAVSCKTSGTLEMNLKGGILTDGKGRIGSIVANRQFQFDGPPPQAGAIYAAGWSITPDGNLAIGDNDVFYQCLSGTFYNLYDEHIGSQCTPVHLEAIDLIDC

SEQ ID NO: 25557 - protein, 225 aa, Saccharomyces cerevisiae
  strain AWRI1631
MQFKNVALAASVAALSATASAEGYTPGEPWSTLTPTGSISCGAAEYTTTFGIAVQAITSSKAKRDVISQIGDGQVQATSAAATDSQVQASSTATPTSSEKISSSASKTSSTNATSSSCATPSLKDSSCKNSGTLELTLKDGVLTDAKGRIGSIVANRQFQFDGPPPQAGAIYAAGWSITEDGYLALGDSDVFYQCLSGNFYNLYDQNVAEQCSAIHLEAVSLVDC

SEQ ID NO: 25558 - protein, 299 aa, Saccharomyces cerevisiae; identical to SEQ ID NO: 25475
  strain AWRI1631

SEQ ID NO: 25559 - protein, 337 aa, Saccharomyces cerevisiae
  strain AWRI1631
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSTSTTSDTVSTISSSIMPAVAQGYTTTVSSAASSSSLKSTTINPAKTATLTASSSTVITSSTESVGSSTVSSASSSSVTTSYATSSSTVVSSDATSSTTTTSSVATSSSTTSSDPASSTTTASSSTTSSDPTSSTAAASSSDPASSSAAASSSASTENAASSSS

SEQ ID NO: 25560 - protein, 329 aa, Saccharomyces cerevisiae; identical to SEQ ID NO: 25437
  strain AWRI1631

SEQ ID NO: 25561 - protein, 362 aa, Saccharomyces cerevisiae
  strain AWRI1631
MKLSALLALSASTAVLAAPAVHHSDNHHHNDKRAVVTVTQYVNADGTVVIPAANTATSAAADGKVESVAAATTTLSSTAAAATTSAAASSSSSSSSSSSSVGSGDFEDGTISCSDFPSGQGAVSLDWLGLGGWASIMDMNGNTATSCQDGYYCSYACSPGYAKTQWPSEQPSDGRSVGGLYCKNGKLYRSNTDTNSLCVEGQGSAQAVNKVSGSIAICGTDYPGSENMVVPTVVGAGSSQPINVIKEDSYYQWQGKKTSAQYYVNNAGVSVEDGCIWGTEGSGVGNWAPVVLGAGYTDGITYLSIIPNPNNKEAPNFNIKIVATDGSTVNGACSYENGVYSGSGSDGCTVSVTSGSANFVFY

SEQ ID NO: 25562 - protein, 271 aa, Saccharomyces cerevisiae; identical to SEQ ID NO: 25547
  strain AWRI1631

SEQ ID NO: 25563 - protein, 662 aa, Saccharomyces cerevisiae; identical to SEQ ID NO: 25548
  strain AWRI796

SEQ ID NO: 25564 - protein, 268 aa, Saccharomyces cerevisiae; identical to SEQ ID NO: 25483
  strain AWRI796

SEQ ID NO: 25565 - protein, 120 aa, Saccharomyces cerevisiae; identical to SEQ ID NO: 25419
  strain AWRI796

SEQ ID NO: 25566 - protein, 288 aa, Saccharomyces cerevisiae
  strain AWRI796
  MOD_RES (277)..(277): Any amino acid
MRLQRNSIICALVFLVSFVLGDVNIVSPSSKATFSPSGGTVSVPVEWMDNGAYPSLSKISTFTFSLCTGPNNNIDCVAVLASKITPSELTQDDKVYSYTAEFASTLTGNGQYYIQVFAQVDGQGYTIHYTPRFQLTSMGGVTAYTYSATTEPTPQTSIQTTTTNNAQATTIDSRSFTVPYTKQTGTSRFAPMQMQPNTKVTATTWTRKFATSAVTYYSTFGSLPEQATTITPGWSYTISSGVNYATPASMPSDNGGWYKPSKRLSLSARKINMRKVXKNRRLLLSSLQ

SEQ ID NO: 25567 - protein, 299 aa, Saccharomyces cerevisiae; identical to SEQ ID NO: 25475
  strain AWRI796

SEQ ID NO: 25568 - protein, 897 aa, Saccharomyces cerevisiae
  strain AWRI796
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSTSTTSDTVSTISSSIMPAVAQGYTTTVSSAASSSSLKSTTINPAKTATLTASSSTVITSSTESVGSSTVSSASSSSVTTSYATSSSTVVSSDATSSTTTTSSVATSSSTTSSDPASSTTTASSSTTSSDPTSSTAAASSSDPASSSAAASSSASTENAASSSSAISSSSSMVSAPLSSTLTTSTASSRSVTSSSVNSVKFANTTVFSAQTTSSVSASLSSSVAADDIQGSTSKEATSSVSEHTSIVTSAINAAQYATRLGSSSRSSSGAVSSSAVSQSVLNSVIAVNTDVSVTSVSSAAHTTKDTATTSVTASESITSETAQASSSTEKNISNSAATSSSIYSNSASVSGHGVTYAAEYAITSEQSSALATSVPATNCSSIVKTTTLENSSTTTITAITKSTTTLATTANNSTRAATAVTIDPTLDPTDNSASPTDNAKHTSTYGSSSTGASLDSLRTTTSISVSSNTTQLVSTCTSESNYSDSPSFAISTATTTESNLITNTITASCSTDSNFPISAASSTDETAFTRTISTSCSTLNGASTQTSELTTSPMKTNTVVPASSFPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25569 - protein, 293 aa, Saccharomyces cerevisiae
  strain AWRI796
MISANSLLISTLCAFAIATPLSKRDSCTLTGSSLSSLSTVKKCSSIVIKDLTVPAGQTLDLTGLSSGTTVTFEGTTTFQYKEWSGPLISISGSKISVVGASGHTIDGQGAKWWDGLGDSGKVKPKFVKLALTGTSKVTGLNIKNAPHQVFSINKCSDLTISDITIDIRDGDSAGGHNTDGFDVGSSSNVLIQGCTVYNQDDCIAVNSGSTIKFMNNYCYNGHGISVGSVGGRSDNTVNGFWAENNHVINSDNGLRIKTVEGATGTVTNVNFISNKISGIKKLWYCYRRRLFEW

SEQ ID NO: 25570 - protein, 329 aa, Saccharomyces cerevisiae; identical to SEQ ID NO: 25437
  strain AWRI796

SEQ ID NO: 25571 - protein, 165 aa, Saccharomyces cerevisiae; identical to SEQ ID NO: 25384
  strain AWRI796

SEQ ID NO: 25572 - protein, 268 aa, Saccharomyces cerevisiae; identical to SEQ ID NO: 25483
  strain FostersB

SEQ ID NO: 25573 - protein, 120 aa, Saccharomyces cerevisiae; identical to SEQ ID NO: 25419
  strain FostersB

SEQ ID NO: 25574 - protein, 276 aa, Saccharomyces cerevisiae
  strain FostersB
MRLQRNSIICALVFLVSFVLGDVNIVSPSSKATFSPSGGTVSVPVEWMDNGAYPSLSKISTFTFSLCTGPNNNIDCVAVLASKITPSELTQDDKVYSYTAEFASTLTGNGQYYIQVFAQVDGEGYTIHYTPRFQLTSMGGVTAYTYSATTEPTPQTSIQTTTTNNAQATTIDSRSFTVPYTKQTGTSRFAPMQMQPNTKVTATTWTRKFATSAVTYYSTFGSLPEQATTITPGWSYTISSGVNYATPASMPSDNGGWYKPSKRLSLSARKINMRKV

SEQ ID NO: 25575 - protein, 299 aa, Saccharomyces cerevisiae
  strain FostersB
  MOD_RES (71)..(71): Any amino acid
  MOD_RES (295)..(295): Any amino acid
MKLSKLSILTSALATSALAAPAVVTVTEHAHEAAVVTVQGVVYVENGQTRTTYETLAPASTATPTSTATAXVAPPVAPSSASSNSDVVLSALKNLASVWGKTTDSTTTLTSSESTSQSLAQATTTSTPAAASTTSTPAATTTTSQAAATSSASSSDSDLSDFASSVLAEHNKKRALHKDTPALSWSDTLASYAQDYADNYDCSGTLTHSGGPYGENLALGYDGPAAVDAWYNEISNYDFSNPGFSSNTGHFTQVVWKSTTQVGCGIKTCGGAWGDYVICSYDPAGNYEGEYADNXEPLA

SEQ ID NO: 25576 - protein, 918 aa, Saccharomyces cerevisiae
  strain FostersB
  MOD_RES (266)..(266): Any amino acid
  MOD_RES (305)..(305): Any amino acid
  MOD_RES (325)..(325): Any amino acid
  MOD_RES (338)..(338): Any amino acid
  MOD_RES (358)..(358): Any amino acid
  MOD_RES (379)..(379): Any amino acid
  MOD_RES (402)..(402): Any amino acid
  MOD_RES (474)..(474): Any amino acid
  MOD_RES (514)..(514): Any amino acid
  MOD_RES (573)..(573): Any amino acid
  MOD_RES (588)..(588): Any amino acid
  MOD_RES (592)..(592): Any amino acid
  MOD_RES (597)..(597): Any amino acid
  MOD_RES (659)..(659): Any amino acid
  MOD_RES (709)..(709): Any amino acid
  MOD_RES (744)..(744): Any amino acid
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSSTSTTSDTVSTISSSIMPAVAQGYTTTVSSAASSSSLKSTTINPAKTATLTASSSTVITSSTESVGSSTVSSASSSSVTTSYATSSSTVVSXDATSSTTTTSSVATSSSTTSSDPASSTTTASSSTTSSDXTSSTTSSSSSTTSSDPTSSXAASSSSTTSSDPXSSSAAASSSASTENAASSSXAISSSSSMVSAPLSSTLTTSXASSRSVTSSSVNSVKFANTTVFXAQTTSSVSASLSSSVAADDIQGSTSKEATSSVSEHTSIVTSATNAAQYATRLGSSSRSSSGAVSSSAVSQSXLNSVIAVNTDVSVTSVSSAAHTTKDTATTSVTASESITSXTAQVSSSTEKKISNSAATSSSIYSNSASVSGHGVTYAAEYAITSEQSSALATSVPATNXSSIVKTTTLENSSTXTITXITKSXTTLATTANNSTRAATAVTIDPTLDPTDNSASPTDNAKHTSTYGSSSTGASLDSLRTTTSISXSSNTTQLVSTCTSESDYSDSPSFAISTATTTESNLITNTITASCSTDSNXPISAASSTDETAFTRTISTSCSTLNGASTQTSELXTSPMKTNTVVPASSSPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25577 - protein, 425 aa, Saccharomyces cerevisiae
  strain FostersB
  MOD_RES (106)..(106): Any amino acid
MISANSLLISTLCAFAIATPLSKRDSCTLTGSSLSSLSTVKKCSSIVIKDLTVPAGQTLDLTGLSSGTTVMFEGTTTFQYKEWSGPLISISGSKISVVGASGHTIXGQGAKWWDGLGDSGKVKPKFVKLALTGTSKVTGLNIKNAPHQVFSINKCSDLTISDITIDIRDGDSAGGHNTDGFDVGSSSNVLIQGCTVYNQDDCIAVNSGSTIKFMNNYCYNGHGISVGSVGGRSDNTVNGFWAENNYVINSDNGLRIKTVEGATGTVTNVNFISNKISGTKSYGIVIEGDYLNGKTTGTATGGVPISNLVMKDITGSVNSTAKRVKILVKNATNWQWSGVSIYRWFFLFWMFWNPIWIWCKLLILFKSTHMTIYTFFSFFYYSIHNRTKMQENIGILFRQFMLGFFVNSGLIITVDLYQVGIFFAI

SEQ ID NO: 25578 - protein, 330 aa, Saccharomyces cerevisiae
  strain FostersB
  MOD_RES (250)..(250): Any amino acid
MKFSKVSLLAASASVALSAPVAVTVTQHVHQAATVVVQGIVRVENGQTLTTFITKGTQTASASPVATTSAPIVVANAQVDSIATSVIQESAVVAESATFEESSTETSEAFSTATATIQAVQTSASATQDDVTTTLTSSTQPTSTTTPTTTTTSPTTTVSPTTTASPTTTTASPTTATTTQSTASSTQSSSSDFSTSMVNEHNTKRALHKDTGSLTWSDTLATYAQNYADSYDCSGNLVHSGGPYGENLAXGYGTTGSVDAWYNEITSYDYSNPGFSESAGHFTQVVWKGTSEVGCGLKSCGGAWGDYIICSYKAAGNVIGEFADNVMPLA

SEQ ID NO: 25579 - protein, 165 aa, Saccharomyces cerevisiae
  strain FostersB
MRFPSIFTAVLFAASSALAAPVNTTTEDETAQIPAEAVIGYLDLEGDFDVAVLPFSNSTNNGLLFINTTIASIAAKEEGVSLDKREAEAWHWLQLKPGQPMYKREADAEAWHWLQLKPGQPMYKREADAEAWHWLQLKPGQPMYKREADAEAWHWLQLKPGQPMY

SEQ ID NO: 25580 - protein, 137 aa, Saccharomyces cerevisiae
  strain FostersO
MIGTKAANPSMITIAPEAQTRITTGDVGATIDSKSFTVPYNLQTGVVKYAPMQLQPATKVTAKTWKRKYATSEVTYYYTLRNSVDQHTTVTPGWSYIITADSNYATPAPMPADNGGWYNPRKRLSLTARKVNALRHR

SEQ ID NO: 25581 - protein, 120 aa, Saccharomyces cerevisiae; identical to SEQ ID NO: 25419
  strain FostersO

SEQ ID NO: 25582 - protein, 276 aa, Saccharomyces cerevisiae
  strain FostersO
  MOD_RES (17)..(17): Any amino acid
  MOD_RES (24)..(24): Any amino acid
MRLQRNSIICALVFLVXFVLGDVXIVSPSSKATFSPSGGTVSVPVEWMDNGAYPSLSKISTFTFSLCTGPNNNIDCVAVLASKITPSELTQDDKVYSYTAEFASTLTGNGQYYIQVFAQVDGZGYTIHYTPRFQLTSMGGVTAYTYSATTEPTPQTSIQTTTTNNAQATTIDSRSFTVPYTKQTGTSRFAPMQMQPNTKVTATTWTRKFATSAVTYYSTFGSLPEQATTITPGWSYTISSGVNYATPASMPSDNGGWYKPSKRLSLSARKINMRKV

SEQ ID NO: 25583 - protein, 384 aa, Saccharomyces cerevisiae
  strain FostersO
MISANSLLISTLCAFAIATPLSKRDSCTLTGSSLSSLSTVKKCSSIVIKDLTVPAGQTLDLTGLSSGTTVTFEGTTTFQYKEWSGPLISISGSKISVVGASGHTIDGQGAKWWDGLGDSGKVKPKFVKLALTGTSKVTGLNIKNAPHQVFSINKCSDLTISDITIDIRDGDSAGGHNTDGFDVGSSSNVLIQGCTVYNQDDCIAVNSGSTIKFMNNYCYNGHGISVGSVGGRSDNTVNGFWAENNYVINSDNGLRIKTVEGATGTVTNVNFISNKISGTKSYGIVIEGDYLNGKTTGTATGGVPISNLVMKDITGSVNSTAKRVKILVKNATNWQWSGVSIYRWFFLFWMFWNPIWIWCKLLILFKSTHMTIYTFFSFFYLFNT

SEQ ID NO: 25584 - protein, 897 aa, Saccharomyces cerevisiae
  strain FostersO
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSTSTTSDTVSTISSSIMPAVAQGYTTTVSSAASSSSLKSTTINPAKTATLTASSSTVITSSTESVGSSTVSSASSSSVTTSYATSSSTVVSSDATSSTTTTSSVATSSSTTSSDPASSTTTASSSTTSSDPTSSTGAASSSDPASSSAAASSSASTENAASSSGAISSSSSMVSAPLSSTLTTSTASSRSVTSSSVNSVKFANTTVFSAQTTSSVSASLSSSVAADDIQGSTSKEATSSVSEHTSIVTSATNAAQYATRLGSSSRSSSGAVSSSAVSQSVLNSVIAVNTDVSVTSVSSAAHTTKDTATTSVTASESITSETAQASSSTEKKISNSAATSSSIYSNSASVSGHGVTYAAEYAITSEQSSALATSVPATNCSSIVKTTTLENSSTTTITAITKSTTTLATTANNSTRAATAVTIDPTLDPTDNSASPTDNAKHTSTYGSSSTGASLDSLRTTTSISVSSNTTQLVSTCTSESDYSDSPSFAISTATTTESNLITNTITASCSTDSNFPTSAASSTDETAFTRTISTSCSTLNGASTQTSELTTSPMKTNTVVPASSSPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25585 - protein, 144 aa, Saccharomyces cerevisiae
  strain JAY291
MRFPSIFTAVLFAASSALAAPVNTTTEDETAQIPAEAVIGYLDLEGDFDVAVLPFSNSTNNGLLFINTTIASIAAKEEGVSLDKREAEAWHWLQLKPGQPMYKREAEAEAWHWLQLKPGQPMYKREADAEAWHWLQLKPGQPMY

SEQ ID NO: 25586 - protein, 329 aa, Saccharomyces cerevisiae; identical to SEQ ID NO: 25437
  strain JAY291

SEQ ID NO: 25587 - protein, 662 aa, Saccharomyces cerevisiae; identical to SEQ ID NO: 25548
  strain JAY291

SEQ ID NO: 25588 - protein, 430 aa, Saccharomyces cerevisiae
  strain JAY291
MQFKNALTATAILSASALAGTNSTTSIPSSCSIGTSATATAQADLDKISGCSTIVGNLTITGDLGSAALASIQEIDGSLTIFNSSSLSSFSADSIKKITGDLNMQELIILTSASFGSLQEVDSINMVTLPAISTFSTDLQNANNIIVSDTTLESVEGFSTLKKVNVFNINNNRYLNSFQSSLESVSDSLQFSSNGDNTTLAFDNLVWANNITLRDVNSISFGSLQTVNASLGFINNTLPSLNLTQLSKVGQSLSIVSNDELSKAAFSNLTTVGGGFIIANNTQLKVIDGFNKVQTVGGAIEVTGNFSTLDLSSLKSVRGGANFDSSSSNFSCNALKKLQSNGAIQGDSFVCKNGATSTSVKLSSTSTESSKSSATSSASSSGDASNAQASVSASASSSSSSSKKSKGAAPELVPATSFMGVVAAVAVALL

SEQ ID NO: 25589 - protein, 299 aa, Saccharomyces cerevisiae; identical to SEQ ID NO: 25475
  strain JAY291

SEQ ID NO: 25590 - protein, 897 aa, Saccharomyces cerevisiae
  strain JAY291
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSTSTTSDTVSTISSSIMPAVAQGYTTTVSSAASSSSLKSTTINPAKTATLTASSSTVITSSTESVGSSTVSSASSSSVTTSYATSSSTAVSSDATSSTTTTSSVATSSSTTSSDPASSTTTASSSTTSSDPTSSTAAASSSDPASSSAAASSSASTENAASSSSAISSSSSMVSAPLSSTLTTSTASSRSVTSNSVNSVKFANTTVFSAQTTSSVSASLSSSVAADDIQGSTSKEATSSVSEHTSIVTSATNAAQYATRLGSSSRSSSGAVSSSAVSQSVLNSVIAVNTDVSVTSVSSAAHTTKDTATTSVTASESITSETAQASSSTEKNISNSAATSSSIYSNSASVSGHGVTYAAEYAITSEQSSALATSVPATNCSSIVKTTTLENSSTTTITAITKSTTTLATTAKNSTRAATAVTIDPTLDPTDNSASPTDNAKHTSTYGSSSTGASLDSLRTTTSISVSSNTTQLVSTCTSESNYSDSPSFAISTATTTESNLITNTITASCSTDSNFPISAASSTDETAFTRTISTSCSTLNGASTQTSELTTSPMKTNTVVPASSFPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25591 - protein, 74 aa, Saccharomyces cerevisiae
  strain JAY291
MSNPCQKEACAIQGYCLLSHQYDDAKCAKVIDQLYICCSKFYKDNGKDSRSPCCPLPSLLELKMKQRKLTPGDS

SEQ ID NO: 25592 - protein, 276 aa, Saccharomyces cerevisiae; identical to SEQ ID NO: 25455
  strain JAY291

SEQ ID NO: 25593 - protein, 102 aa, Saccharomyces cerevisiae [sequence omitted]

SEQ ID NO: 25594 - protein, 529 aa, Saccharomyces cerevisiae; identical to SEQ ID NO: 25464
  strain JAY291

SEQ ID NO: 25595 - protein, 120 aa, Saccharomyces cerevisiae; identical to SEQ ID NO: 25419
  strain JAY291

SEQ ID NO: 25596 - protein, 268 aa, Saccharomyces cerevisiae; identical to SEQ ID NO: 25483
  strain JAY291

SEQ ID NO: 25597 - protein, 348 aa, Saccharomyces cerevisiae; identical to SEQ ID NO: 25441
  strain JAY291

SEQ ID NO: 25598 - protein, 662 aa, Saccharomyces cerevisiae
  strain Kyokai no. 7 / NBRC 101557
MTKETIRVVICGDEGVGKSSLIVSLTKAEFIPTIQDVLPPISIPRDFSSSPTYSPKNTVLIDTSDSDLIALDHELKSADVIWLVYCDHESYDHVSLFWLPHFRSLGLNIPVILCKNKCDSISNVNANAMVVSENSDDDIDTKVEDEEFIPILMEFKEIDTCIKTSAKTQFDLNQAFYLCQRAITHPISPLFDAMVGELKPLAVMALKRIFLLSDLNQDSYLDDNEILGLQKKCFNKSIDVNELNFIKDLLLDISKHDQEYINRKLYVPGKGITKDGFLVLNKIYAERGRHETTWAILRTFHYTDSLCINDKILHPKLVVPDTSSVELSPKGYRFLVDIFLKFDIDNDGGLNNQELHRLFKCTPGLPKLWTSTNFPFSTVVNNKGCITLQGWLAQWSMTTFLNYSTTTAYLVYFGFQEDARLALQVTKPRKMRRRSGKLYRSNINDRKVFNCFVIGKPCCGKSSLLEAFLGRSFSEEYSPTIKPRIAVNSLELKGGKQYYLILQELGEQEYAILENKDKLKECDIICLTYDSSDPESFSYLVSLLDKFTHLQDLPLVFVASKADLDKQQQRCQIQPDELADELFVNHPLHISSRWLSSLNELFIKITEAALDPGKNTPGLPEETAAKDVDYRQTALIFGSTVGFVALCSFTLMKLFKSSKFSK

SEQ ID NO: 25599 - protein, 268 aa, Saccharomyces cerevisiae
  strain Kyokai no. 7 / NBRC 101557
MLIVLFLTLFCSVVFRTAYCDVAIVAPEPNSVYDLSGTSQAVVKVKWMHTDNTPQEKDFVRYTFTLCSGTNAMIEAMATLQTLSATDLTDNEFNAIIENTVGTDGVYFIQVFAQTAIGYTIHYTNRFKLKGMIGTKAANPSMITIAPKAQTRITTGDVGATIDSKSFTVPYNLQTGVVKYAPMQLQPATKVTAKTWKRKYATSEVTYYYTLRNSVDQHTTVTPGWSYIITADSNYATPAPMPADNGGWYNPRKRLSLTARKVNALRHR

SEQ ID NO: 25600 - protein, 120 aa, Saccharomyces cerevisiae; identical to SEQ ID NO: 25419
  strain Kyokai no. 7 / NBRC 101557

SEQ ID NO: 25601 - protein, 276 aa, Saccharomyces cerevisiae
  strain Kyokai no. 7 / NBRC 101557
MRLQRNSIICALVFLVSFVLGDVNIVSPSSKATFSPSGGTVSVPVEWMDNGAYPSLSKISTFTFSLCTGPNNNIDCVAVLANKITPSELTQDDKVYSYTAEFASTLTGNGQYYIQVFAQVDGQGYTIHYTPRFQLTSMGGVTAYTYSATTEPTPQTSIQTTTTNNAQATTIDSRSFTVPYTKQTGTSRFAPMQMQPNTKVTATTWTRKFATSAVTYYSTFGSLPEQATTITPGWSYTISSGVNYATPASMPSDNGGWYKPSKRLSLSARKINMRKV

SEQ ID NO: 25602 - protein, 299 aa, Saccharomyces cerevisiae
  strain Kyokai no. 7 / NBRC 101557
MKLSKLSILTSALATSALAAPAVVTVTEHAHEAAVVTVQGVVYVENGQTRTTYETLAPASTATPTSTATALVAPPVALSSASSNSDAVLSALKNLASVWGKTTDSTTTLTPSESTSQSLAQATTTSTPAAASTTSTPAATTTTSQAAATSSASSSDSDLSDFASSMLAEHNKKRALHKDTPALSWSDTLASYAQDYADNYDCSGTLTHSGGPYGENLALGYDGPAAVDAWYNEISNYDFSNPGFSSNTGHFTQVVWKSTTQVGCGIKTCGGAWGDYVICSYDPAGNYEGEYADNVEPLA

SEQ ID NO: 25603 - protein, 918 aa, Saccharomyces cerevisiae
  strain Kyokai no. 7 / NBRC 101557
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSSTSTTSDTVSTISSSIMPAVAQGYTTTVSSAVSSSSLKSTTINPAKTATLTASSSTVITSSTESVGSSTVSSASSSSVTTSYATSSSTVVSSDATSSTTTTSSVATSSSTTSSDPASSTTTASSSTTSSDLTSSTTSSSSSTTSSDPTSSTAASSSSTTSSDPVSSSAAASSSASTENAASSSSAISSSSSMVSAPLSSTLTTSAASSRSVTSSSVNSVKFANTTVFSAQTTSSVSASLSSSVAADDIQGSTSKEATSSVSEHTSIVTSATNAAQYATRLGSSSRSSSGAVSSSAVSQSALNSVIAVNTDVSVTSVSSAAHTTKDTATTSVTASESITSDTAQVSSSTEKKISNSAATSSSIYSNSASVSGHGVTYAAEYAITSEQSSALATSVPATNRSSIVKTTTLENSSTATITTITKSATTLATTANNSTRAATAVTIDPTLDPTDNSASPTDNAKHTSTYGSSSTGASLDSLRTTTSISASSNTTQLVSTCTSESDYSDSPSFAISTATTTESNLITNTITASCSTDSNLPISAASSTDETAFTRTISTSCSTLNGASTQTSELSTSPMKTNTVVPASSFPSTTTTCLENDNTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25604 - protein, 234 aa, Saccharomyces cerevisiae
  strain Kyokai no. 7 / NBRC 101557
MSKSDLAVEIIAAQRPRVRLMGAFINKCSDLTISDITIDIRDGDSAGGHNTDGFDVGSSSNVLIQGCTVYNQDDCIAVNSGSTIKFMNNYCYNGHGISVGSVGGRSDNTVNGFWAENNHVINSDNGLRIKTVEGATGTVTNVNFISNKISGIKSYGIVIEGDYLNGKTTGTATGGVPISNLVMKDITGSVNSTAKRVKILVKNATNWQWSGVSITGGSSYSGCSGIPSGSGASC

SEQ ID NO: 25605 - protein, 336 aa, Saccharomyces cerevisiae
  strain Kyokai no. 7 / NBRC 101557
MKFSKVSLLAASASVALSAPVAVTVTQHVHQAATVVVQGIVRVENGQTLTTFITKGTQTASASPVATTSAPIVVANAQVDSIATSVIQESAVVAESATFEESSTETSEAFSTATATIQAVQTSASATQDDVTTTLTSSTQPTSTTTPTTTTTSPTTTTSPTTTASPTTTASPTTTTASPTTATTTQSTASSTQSSSSDFSTSMVNEHNTKRALHKDTGSLTWSDTLATYAQNYADSYDCSGNLVHSGGPYGENLALGYGTTGSVDAWYNEITSYDYSNPGFSESAGHFTQVVWKGTSEVGCGLKSCGGAWGDYIICSYKAAGNVIGEFADNVMPLA

SEQ ID NO: 25606 - protein, 186 aa, Saccharomyces cerevisiae
  strain Kyokai no. 7 / NBRC 101557
MRFPSIFTAVLFAASSALAAPVNTTTEDETAQIPAEAVIGYLDLEGDFDVAVLPFSNSTNNGLLFINTTIASIAAKEEGVSLDKREAEAWHWLQLKPGQPMYKREADAEAWHWLQLKPGQPMYKREADAEAWHWLQLKPGQPMYKREADAEAWHWLQLKPGQPMYKREADAEAWHWLQLKPGQPMY

SEQ ID NO: 25607 - protein, 1713 aa, Saccharomyces cerevisiae
  strain Kyokai no. 7 / NBRC 101557
MFNRFNKLQAALALVLYSQSALGQYYTSSSIASNSSTAVSSTSSGSVSISSSIELTSSTSDVSSSLTELTSSFTEVSSSIAPSTSSSEVSSSITSSGSSVSGSSSITSSGSSVSSSSPYDERFNSLDLSVHVSAGFSAGVSVGLEPSATTASVTTTLSPYDERVNLIELGVYVSDMRAHLVEYLLFQAAHSTEPHPTEIAAAFLDHGDFTTRLTGISGDEVTRMITGVPWYSTRLKPAISEALAKDGIYTAIPTSTSTTSDTYISSSSPSQVTSSAEPTTVSGVTSSVEPTRSSQVTSSAEPTTVSEITSSAEPLSSSKATTSAESISSNQITISSELIVSSVITSSSEIPSSIEVLTSSGISSSVEPTSLVGPSSDESISSTESLSATSTPLAVSSTVVTSSTDSVSPNIPFSEISSSPESSTAITSGSSSATESGSSVSGSTSATESGSSASGSSSATESGSSVSGSTSATESGSASSVPSSSGSVTESGSSSSASESSITQSGTASGSSVSSTSGSVTQSGSSVSGSSASSAPGISSSIPQSTSSASTASGSITSGTLTSITSGSSSATESGSSVSGSSSATESGSSVSGSTSATESGSSVSGSTSATESGSSASGSSSATESGSSVSGSTSATESGSSVSGSTSATESGSSASGSSSATESGSASSVPSSSGSVTESGSSSSASESSITQSGTASGSSASSTSGSVTQSGSSVSGSSASSAPGISSSIPQSTSSASTASGSITSGTLTSITSGSSSATESGSSASGSSSATESGSSVSGSTSATESGSSVSGSTSATESGSSASGSSSATESGSSVSGSTSATESGSSASGSSSATESGSASSVPSSSGSVTESGSSSSASESSITQSGTASGSSASSTSGSVTQSGSSVSGSSASSTSGSVTQSGSSVSGSSASSAPGISSSIPQSTSSASTASGSITSGTLTSITSSASSASATASNSLSSSDGTIYLPTTTISGDLTLTGKVIATEGVVVAAGAKLTLLDGDKYSFSADLKVYGDLLVKKSKETYPGTEFDISGENFDVTGNFNAEESAATSASIYSFTPSSFDNSGDISLSLSKSKKGEVTFSPYSNSGAFSFSNAILNGGSVSGLQRRDDTEGSVNNGEINLDNGSTYVIVEPVSGKGTVNIISGNLYLHYPDTFTGQTVVFKGEGVLAVDPTESNTTPIPVVGYTGENQIAITADVTALSYDSATGVLTATQGNSQFSFSIGTGFSSSGFNVSEGTFAGAYAYYLNYGGVVASSATPSSTSTTSGATNSTSGSTSFGASVTGSTASTSFGASVTGSTASTLISGSPSVYTTTLTYATTTSTVVVSCSETTDSNGNVYTITTTVPCSSTTATITSCDETGCHVTTSTGTVATETVSSKSYTTVTVTHCDNNGCNTKTVTSEAPEATTTTVSPKTYTTATVTQCDDNGCSTKTVTSECPEETSATTTSPKSYTTVTVTHCDDNGCNTKTVTSEAPEATTTTVSPKTYTTATVTQCDDNGCSTKTVTSECPEETSATTTSPKSYTTVTVTHCDDNGCNTKTVTSEAPEATTTTVSPKTYTTATVTQCDDNGCSTKTVTSEAPKETSETSETSAAPKTYTTATVTQCDDNGCNVKIITSQIPEATSTVTATSASPKSYTTVTSEGSKATSLTTAISKASSAISTYSKSAAPIKTSTGIIVQSEGIAAGLNANTLNALVGIFVLAFFN

SEQ ID NO: 25608 - protein, 662 aa, Saccharomyces cerevisiae; identical to SEQ ID NO: 25548
  strain Lalvin EC1118 / Prise de mousse

SEQ ID NO: 25609 - protein, 268 aa, Saccharomyces cerevisiae; identical to SEQ ID NO: 25483
  strain Lalvin EC1118 / Prise de mousse

SEQ ID NO: 25610 - protein, 120 aa, Saccharomyces cerevisiae; identical to SEQ ID NO: 25419
  strain Lalvin EC1118 / Prise de mousse

SEQ ID NO: 25611 - protein, 529 aa, Saccharomyces cerevisiae; identical to SEQ ID NO: 25464
  strain Lalvin EC1118 / Prise de mousse

SEQ ID NO: 25612 - protein, 276 aa, Saccharomyces cerevisiae; identical to SEQ ID NO: 25455
  strain Lalvin EC1118 / Prise de mousse

SEQ ID NO: 25613 - protein, 299 aa, Saccharomyces cerevisiae; identical to SEQ ID NO: 25475
  strain Lalvin EC1118 / Prise de mousse

SEQ ID NO: 25614 - protein, 894 aa, Saccharomyces cerevisiae
  strain Lalvin EC1118 / Prise de mousse
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSTSTTSDTVSTIPSSIMPAVAQGYTTTVSSAASSSSLKSTTINPAKTATLTASSSTVITSSTESVGSSTVSSASSSSVTTSYATSSSTVVSSDATSSTTTTSSVATSSSTTSSDPASSTTTASSSTTSSDPTSSTAAASSSDPASSSAAASSSASTENAASSSSAISSSSSMVSAPLSSTLTTSTASSRSVTSSSVNSVKFANTTVFSAQTTSSVSASLSSSVAADDIQGSTSKEATSSVSEHTSIVTSATNAAQYATRLGSSSRSSSGAVSSSAVSQSVLNSVIAVNTDVSVTSVSSAAHTTKDTATTSVTASESITSETAQASSSTEKNISNSAATSSSIYSNSASVSGHGVTYAAEYAITSSALATSVPATNCSSIVKTTTLENSSTTTITAITKSITTLATTANNSTRAATAVTIDPTLDPTDNSASPTDNAKHTSTYGSSSTGASLDSLRTTTSISVSSNTTQLVSTCTSESNYSDSPSFAISTATTTESNLITNTITASCSTDSNFPISAASSTDETAFTRTISTSCSTLNGASTQTSELTTSPMKTNTVVPASSFPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25615 - protein, 361 aa, Saccharomyces cerevisiae
  strain Lalvin EC1118 / Prise de mousse
MISANSLLISTLCAFAIATPLSKRDSCTLTGSSLSSLSTVKKCSSIVIKDLTVPAGQTLDLTGLSSGTTVTFEGTTTFQYKEWSGPLISISGSKISVVGASGHTIDGQGAKWWDGLGDSGKVKPKFVKLALTGTSKVTGLNIKNAPHQVFSINKCSDLTISDITIDIRDGDSAGGHNTDGFDVGSSSNVLIQGCTVYNQDDCIAVNSGSTIKFMNNYCYNGHGISVGSVGGRSDNTVNGFWAENNHVINSDNGLRIKTVEGATGTVTNVNFISNKISGIKSYGIVIEGDYLNGKTTGTATGGVPISNLVMKDITGSVNSTAKRVKILVKNATNWQWSGVSITGGSSYSGCSGIPSGSGASC

SEQ ID NO: 25616 - protein, 329 aa, Saccharomyces cerevisiae; identical to SEQ ID NO: 25437
  strain Lalvin EC1118 / Prise de mousse

SEQ ID NO: 25617 - protein, 348 aa, Saccharomyces cerevisiae
  strain Lalvin EC1118 / Prise de mousse
MSQYKTGLLLIHPAVTTTPELVENTKAQAASKKVKFVDQFLINKLNDGSITLENAKYETVHYLTPEAQTDIKFPKKLISVLADSLKPNGSLIGLSDIYKVDALINGFEIINEPDYCWIKMDSSKLNQTVSIPLKKKKTNNTKLQSGSKLPTFKKASSSTSNLPSFKKADHSRQPIVKETDSFKPPSFKMATEPKVYRVVDDLIEDSDDDDFSSDSSKAQYFDQVDTSDDSIEEEELIDEDGSGKSMITMITCGKSKTKKKKACKDCTCGMKEQEGKEINDIRSQQDKVVKFTEDELTEIDFTIDGKKVGGCGSCSLGDAFRCSGCPYLGLPAFKPGQPINLDSISDDL

SEQ ID NO: 25618 - protein, 73 aa, Saccharomyces cerevisiae
  strain Lalvin EC1118 / Prise de mousse
MSNPCQKEACAIQDCLLSHQYDDAKCAKVIDQLYICCSKFYKDNGKDSRSPCCPLPSLLELKMKQRKLTPGDS

SEQ ID NO: 25619 - protein, 102 aa, Saccharomyces cerevisiae [sequence omitted]

SEQ ID NO: 25620 - protein, 165 aa, Saccharomyces cerevisiae; identical to SEQ ID NO: 25384
  strain Lalvin EC1118 / Prise de mousse

SEQ ID NO: 25621 - protein, 268 aa, Saccharomyces cerevisiae
  strain Lalvin QA23
  MOD_RES (4)..(4): Any amino acid
MLIXLFLTLFCSVVFRTAYCDVAIVAPEPNSVYDLSGTSQAVVKVKWMHTDNTPQEKDFVRYTFTLCSGTNAMIEAMATLQTLSASDLTDNEFNAIIENTVGTDGVYFIQVFAQTAIGYTIHYTNRFKLKGMIGTKAANPSMITIAPEAQTRITTGDVGATIDSKSFTVPYNLQTGVVKYAPMQLQPATKVTAKTWKRKYATSEVTYYYTLRNSVDQHTTVTPGWSYIITADSNYATPAPMPADNGGWYNPRKRLSLTARKVNALRHR

SEQ ID NO: 25622 - protein, 120 aa, Saccharomyces cerevisiae; identical to SEQ ID NO: 25419
  strain Lalvin QA23

SEQ ID NO: 25623 - protein, 276 aa, Saccharomyces cerevisiae; identical to SEQ ID NO: 25455
  strain Lalvin QA23

SEQ ID NO: 25624 - protein, 299 aa, Saccharomyces cerevisiae; identical to SEQ ID NO: 25475
  strain Lalvin QA23

SEQ ID NO: 25625 - protein, 894 aa, Saccharomyces cerevisiae
  strain Lalvin QA23
  MOD_RES (186)..(186): Any amino acid
  MOD_RES (573)..(573): Any amino acid
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSTSTTSDTVSTIXSSIMPAVAQGYTTTVSSAASSSSLKSTTINPAKTATLTASSSTVITSSTESVGSSTVSSASSSSVTTSYATSSSTVVSSDATSSTTTTSSVATSSSTTSSDPASSTTTASSSTTSSDPTSSTAAASSSDPASSSAAASSSASTENAASSSSAISSSSSMVSAPLSSTLTTSTASSRSVTSSSVNSVKFANTTVFSAQTTSSVSASLSSSVAADDIQGSTSKEATSSVSEHTSIVTSATNAAQYATRLGSSSRSSSGAVSSSAVSQSVLNSVIAVNTDVSVTSVSSAAHTTKDTATTSVTASESITSETAQASSSTEKNISNSAATSSSIYSNSASVSGHGVTYAAEYAITSSALATSVPATNCSSIVKTTTLENSSTTTITAITKSXTTLATTANNSTRAATAVTIDPTLDPTDNSASPTDNAKHTSTYGSSSTGASLDSLRTTTSISVSSNTTQLVSTCTSESNYSDSPSFAISTATTTESNLITNTITASCSTDSNFPISAASSTDETAFTRTISTSCSTLNGASTQTSELTTSPMKTNTVVPASSFPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25626 - protein, 361 aa, Saccharomyces cerevisiae; identical to SEQ ID NO: 25615
  strain Lalvin QA23

SEQ ID NO: 25627 - protein, 186 aa, Saccharomyces cerevisiae
  strain Lalvin QA23
MRFPSIFTAVLFAASSALAAPVNTTTEDETAQIPAEAVIGYLDLEGDFDVAVLPFSNSTNNGLLFINTTIASIAAKEEGVSLDKREAEAWHWLQLKPGQPMYKREAEAEAWHWLQLKPGQPMYKREADAEAWHWLQLKPGQPMYKREADAEAWHWLQLKPGQPMYKREADAEAWHWLQLKPGQPMY

SEQ ID NO: 25628 - protein, 222 aa, Saccharomyces cerevisiae; identical to SEQ ID NO: 338
  strain RM11-1a

SEQ ID NO: 25629 - protein, 268 aa, Saccharomyces cerevisiae; identical to SEQ ID NO: 25483
  strain RM11-1a

SEQ ID NO: 25630 - protein, 120 aa, Saccharomyces cerevisiae; identical to SEQ ID NO: 25419
  strain RM11-1a

SEQ ID NO: 25631 - protein, 459 aa, Saccharomyces cerevisiae
  strain RM11-1a
MSFRFNEAVFGDNSFNERVREKLSTALNSPSKKKLDILKSGIKVQKVDFPTIPQLEILDLDIITQPKSLAKGICKISCKDAMLRIQTVIESNLLLISEQDTPSFTMPQLINNGSFTIPITMTFSSIELEAITNIFVKNPGIGISFNDVDLDFKFDCSVKILQSTIERRLKESMHVVFKDVLPSLIFNTSQNWFTNRGESTSTIPGKREHHHQQTTMSRNVILDGSDFQELSPINMLRLSSIVSSRSTLSLHSTVMNSLSAIPGCLERQNLYRFISRMPSLNNYYSSQSFPQPKSSTVSSKQLVKPFYCSHNLLPKTVLDSSQYDLATITKIQSRLFDRSNSNDDNAKPRRRKIKCKKTRTPSNLQSQGEQAVDDSTAIETVTSTPVQTPIPELEEQSPPYLKTTVSIRDKYVIPEKISLNLDSKKDTSKKKPFYFIGLNSQEPSNNWKWGMEDSPPPYH

SEQ ID NO: 25632 - protein, 271 aa, Saccharomyces cerevisiae
  strain RM11-1a
MSFDINWSTLESDNRLNDLIRKHLNSYLQNTQLPSYVSNLRVLDFDLGKVGPAITLKEITDPLDEFYDSIREEADQETEENNDNKEDSEHVCPDRTIANHEGPKDDFEAPVVMPSPNDIQFLLEVEYKGDLLVTIGADLVLNYPVEKFMTLPVKLSISDIGLHSLCIVACLSKQLFLSFLCDVSDPALDDNQTVLDPKGPILAATKPLERISIVRSMKIETEIGEQYQGQGSVLRSVGELEQFLFTIFKDFLRKELAWPSWINLDFNDGDE

SEQ ID NO: 25633 - protein, 144 aa, Saccharomyces cerevisiae; identical to SEQ ID NO: 25585
  strain RM11-1a

SEQ ID NO: 25634 - protein, 73 aa, Saccharomyces cerevisiae; identical to SEQ ID NO: 25618
  strain RM11-1a

SEQ ID NO: 25635 - protein, 102 aa, Saccharomyces cerevisiae [sequence omitted]

SEQ ID NO: 25636 - protein, 276 aa, Saccharomyces cerevisiae; identical to SEQ ID NO: 25455
  strain RM11-1a

SEQ ID NO: 25637 - protein, 287 aa, Saccharomyces cerevisiae; identical to SEQ ID NO: 25555
  strain RM11-1a

SEQ ID NO: 25638 - protein, 368 aa, Saccharomyces cerevisiae
  strain RM11-1a
MQYKKTLVASALAATTLAAYAPSEPWSTLTPTATYSGGVTDYASTFGIAVQPISTTSSASSAATTASSKAKRAASQIGDGQVQAATTTASVSTKSSAAAVSQIGDGQIQATTKTTAAAVSRDGQIQATTKTTSAKTTAAAVSQIGDGQIQATTTTLAPKSTAAAVSQMGDGQIQATTKTTAAAVSQIGDGQVQATTKTTAAAVSQIGDGQVQATTKTTAAAVSQITDGQVQATTKTTQAASQVSDGQVQATSATSASAAATSTDPVDAVSCKTSGTLEMNLKGGILTDGKGRIGSIVANRQFQFDGPPPQAGAIYAAGWSITPDGNLAIGDNDVFYQCLSGTFYNLYDEHIGSQCTPVHLEAIDLIDC

SEQ ID NO: 25639 - protein, 299 aa, Saccharomyces cerevisiae; identical to SEQ ID NO: 25475
  strain RM11-1a

SEQ ID NO: 25640 - protein, 878 aa, Saccharomyces cerevisiae
  strain RM11-1a
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSTSTTSDTVSTISSSIMPAVAQGYTTTVSSAASSSSLKSTTINPAKTATLTASSSTVITSSTESVGSSTVSSASSSSVTTPYATSSSTVVSNDATSSTTTTSSVATSSSTTSSDPTSSTAAASSSDPASSSAAASSSASTENAASSSSAISSSSSMVSAPLSSTLTTSTASSRSVTSSSVNSVKFANTTVFSAQTTSSVSASLSSSVAADDIQGSTSKEATSSVSEHTSIVTSATNAAQYATRLGSSSRSSSGAVSSSAVSQSVLNSVIAVNTDVSVTSVSSAAHTTKDTATTSVTASESITSETAQASSSTEKNISNSAATSSSIYSNSASVSGHGVTYAAEYAITSSALATSVPATNCSSIVKTTTLENSSTTTITAITKSTTTLATTANNSTRAATAVTIDPTLDPTDNSASPTDNAKHTSTYGSSSTGASLDSLRTTTSISVSSNTTQLVSTCTSESNYSDSPSFAISTATTTESNLITNTITASCSTDSNFPISAASSTDETAFTRTISTSCSTLNGASTQTSELTTSPMKTNTVVPASSFPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25641 - protein, 361 aa, Saccharomyces cerevisiae; identical to SEQ ID NO: 25615
  strain RM11-1a

SEQ ID NO: 25642 - protein, 341 aa, Saccharomyces cerevisiae
  strain RM11-1a
MQYKKSLVASALVTTSLAAYAPKDPWSTLTPSATYKGGITDYSSTFGIAVEPIATTASSKAKRAAAISQIGDGQIQATTKTTAAAVSQIGDGQIQATTKTKAAAVSQIGDGQIQATTKTTSAKTTAAAVSQIGDGQIQATTKTKAAAVSQIGDGQIQATTKTTAAAVSQIGDGQIQATTKTTAAAVSQIGDGQIQATTNTTVAPVSQITDGQIQATTLTSATIIPSPAPAPITNGTDPVTAETCKSSGTLEMNLKGGILTDGKGRIGSIVANRQFQFDGPPPQAGAIYAAGWSITPEGNLAIGDQDTFYQCLSGNFYNLYDEHIGTQCNAVHLQAIDLVNC

SEQ ID NO: 25643 - protein, 307 aa, Saccharomyces cerevisiae
  strain RM11-1a
MQYKKPLVVSALAATSLAAYAPKDPWSTLTPSATYKGGITDYSSSFGIAIEAVATSASSVASSKAKRAASQIGDGQVQAATTTAAVSKKSTAAAVSQITDGQVQAAKSTAAAASQISDGQVQAAKSTAAAVSQITDGQVQAAKSTAAAASQISDGQVQATTSTKAAASQITDGQIQASKTTSGASQVSDGQVQATAEVKDANDPVDVVSCNNNSTLSMSLSKGILTDRKGRIGSIVANRQFQFDGPPPQAGAIYAAGWSITPEGNLALGDQDTFYQCLSGDFYNLYDKHIGSQCHEVYLQAIDLIDC

SEQ ID NO: 25644 - protein, 329 aa, Saccharomyces cerevisiae; identical to SEQ ID NO: 25437
  strain RM11-1a

SEQ ID NO: 25645 - protein, 362 aa, Saccharomyces cerevisiae; identical to SEQ ID NO: 25561
  strain RM11-1a

SEQ ID NO: 25646 - protein, 348 aa, Saccharomyces cerevisiae; identical to SEQ ID NO: 25617
  strain RM11-1a

SEQ ID NO: 25647 - protein, 529 aa, Saccharomyces cerevisiae
  strain RM11-1a
MVLEYQQREGKGSSSKSMPPDSSSTTIHTCSEAQTGEDKGLLDPHLSVLELLSKTGHSPSPMGQNLVTSIDISGNHNVNDSISGSWQAIQPLDLGASFIPERCSSQTTNGSILSSSDTSEEEQELLQAPAADIINIIKQGQEGANVVSPSHPFKQLQKIISLPLPGKEKTPFNEQDDDGDEDEAFEEDSVTITKSLTSSTNSFVMPKLSLTQKNPVFRLLILGRTGSSFYQSIPKEYQSLFELPKYHDSATFPQYTGIVIIFQELREMVSLLNRIVQYSPGKPVIPICQPGQVIQVKNVLKSFLRNKLVKLLFPPVVVTNKRDLKKMFQRLQDLSLEYGEDVNEEDNDDEAIHTKSRSYCRNKKAENSKKKSPKSNKKPKRKKQKFFTSWFTWGISITIGISFGCCVTYFVTAAYEHQTVKSLSLRPSILASLLSLDSSSDTINTPATASPSSTEQFLWFDKGTLQINFHSDGFIMKSLTIIKETWGKMNTFVLHALSKPLKFLENLNKSSEFSIDESNRILALGYILL

SEQ ID NO: 25648 - protein, 493 aa, Saccharomyces cerevisiae; identical to SEQ ID NO: 25549
  strain RM11-1a

SEQ ID NO: 25649 - protein, 662 aa, Saccharomyces cerevisiae; identical to SEQ ID NO: 25548
  strain RM11-1a

SEQ ID NO: 25650 - protein, 268 aa, Saccharomyces cerevisiae; identical to SEQ ID NO: 25621
  strain VIN 13
  MOD_RES (4)..(4): Any amino acid

SEQ ID NO: 25651 - protein, 120 aa, Saccharomyces cerevisiae; identical to SEQ ID NO: 25419
  strain VIN 13

SEQ ID NO: 25652 - protein, 276 aa, Saccharomyces cerevisiae; identical to SEQ ID NO: 25455
  strain VIN 13

SEQ ID NO: 25653 - protein, 299 aa, Saccharomyces cerevisiae; identical to SEQ ID NO: 25475
  strain VIN 13

SEQ ID NO: 25654 - protein, 894 aa, Saccharomyces cerevisiae
  strain VIN 13
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSTSTTSDTVSTISSSIMPAVAQGYTTTVSSAASSSSLKSTTINPAKTATLTASSSTVITSSTESVGSSTVSSASSSSVTTSYATSSSTVVSSDATSSTTTTSSVATSSSTTSSDPASSTTTASSSTTSSDPTSSTAAASSSDPASSSAAASSSASTENAASSSSAISSSSSMVSAPLSSTLTTSTASSRSVTSSSVNSVKFANTTVFSAQTTSSVSASLSSSVAADDIQGSTSKEATSSVSEHTSIVTSATNAAQYATRLGSSSRSSSGAVSSSAVSQSVLNSVIAVNTDVSVTSVSSAAHTTKDTATTSVTASESITSETAQASSSTEKNISNSAATSSSIYSNSASVSGHGVTYAAEYAITSSALATSVPATNCSSIVKTTTLENSSTTTITAITKSTTTLATTANNSTRAATAVTIDPTLDPTDNSASPTDNAKHTSTYGSSSTGASLDSLRTTTSISVSSNTTQLVSTCTSESNYSDSPSFAISTATTTESNLITNTITASCSTDSNFPISAASSTDETAFTRTISTSCSTLNGASTQTSELTTSPMKTNTVVPASSFPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25655 - protein, 267 aa, Saccharomyces cerevisiae
  strain VIN 13
MISANSLLISTLCAFAIATPLSKRDSCTLTGSSLSSLSTVKKCSSIVIKDLTVPAGQTLDLTGLSSGTTVTFEGTTTFQYKEWSGPLISISGSKISVVGASGHTIDGQGAKWWDGLGDSGKVKPKFVKLALTGTSKVTGLNIKNAPHQVFSINKCSDLTISDITIDIRDGDSAGGHNTDGFDVGSSSNVLIQGCTVYNQDDCIAVNSGSTIKFMNNYCYNGHGISVGSVGGRSDNTVNGFWAENNHVINSDNGLRIKTVEGATGTVN

SEQ ID NO: 25656 - protein, 329 aa, Saccharomyces cerevisiae; identical to SEQ ID NO: 25437
  strain VIN 13

SEQ ID NO: 25657 - protein, 144 aa, Saccharomyces cerevisiae
  strain VIN 13
  MOD_RES (107)..(107): Any amino acid
MRFPSIFTAVLFAASSALAAPVNTTTEDETAQIPAEAVIGYLDLEGDFDVAVLPFSNSTNNGLLFINTTIASIAAKEEGVSLDKREAEAWHWLQLKPGQPMYKREAXAEAWHWLQLKPGQPMYKREADAEAWHWLQLKPGQPMY

SEQ ID NO: 25658 - protein, 429 aa, Saccharomyces cerevisiae
  strain YJM789
MQFKNALTATAILSASALAANSTTSIPSSCSIGTSATATAQADLDKISGCSTIVGNLTITGDLGSAALASIQEIDGSLTIFNSSSLSSFSADSIKKITGDLNMQELIILTSASFGSLQEVDSINMVTLPAISTFSTDLQNANNIIVSDTTLESVEGFSTLKKVNVFNINNNRYLNSFQSSLESVSDSLQFSSNGDNTTLAFDNLVWANNITLRDVNSISFGSLQTVNASLGFINNTLPSLNLTQLSKVGQSLSIVSNDELSKAAFSNLTTVGGGFIIANNTQLKVIDGFNKVQTVGGAIEVTGNFSTLDLSSLKSVRGGANFDSSSSNFSCNALKKLQSNGAIQGDSFVCKNGATSTSVKLSSTSTESSKSSATSSASSSGDASNAQASVSASASSSSSSSKKSKGAAPELVPATSFMGVVAAVAVALL

SEQ ID NO: 25659 - protein, 134 aa, Saccharomyces cerevisiae; identical to SEQ ID NO: 25447
  strain YJM789

SEQ ID NO: 25660 - protein, 73 aa, Saccharomyces cerevisiae; identical to SEQ ID NO: 25618
  strain YJM789

SEQ ID NO: 25661 - protein, 271 aa, Saccharomyces cerevisiae; identical to SEQ ID NO: 25547
  strain YJM789

SEQ ID NO: 25662 - protein, 731 aa, Saccharomyces cerevisiae
  strain YJM789
MFRVFGSFGSKGNQSSGEEQSTKTKQVLKQANDFEIALKAMDFVLDDRTDEGLNLLKKAEMETGSDQTILTLARGVIEFLQATLSFETEEMKRAAITLGKAEQMSWKSKQNAEKTNFRSSSIYPPGTVYAVTYTESCLLHALLMLFSESMMEAAKALLKLRRAYTMLQDIMVTVKKAERSKNSSSPSPSEKSQESCGSFVSAETTFISVDIPYKLSSEDKSNPLLLEFAEKIYTMRMGRLSGAHIGNTPSFHRLRDDLGLQTTPSQASDRHSVSDDFDLEQATIDEFIHSGANLCYGILQVVLSLLPPAIGAVLSIVGFKGSREEGLRLVWKAIKERNVHGCIGLLGLMFYYDGPFQFTDADFDIPPNDNGSRALNKSRTNDSSLLPGYMDSATLLHPGKILEDALLKARALFPNSALWLLNEAKMLAGKGRLRDSLALMDSIDVNSIRMRQVKSLMVFERAILLVNLHEYNRAADDLISLLDISDWSHALYTYFAGCCYLENWRMTQLGLLNDGKEQFYKERARELIFDAPSLLGKKTFKSKNLPLDRFMLRKVQQFNNMQKKLNLQEPLDSIATSPVHELAYFYNGYNRMTENDLILTKKMLTEYHNPAIDSEDPDQELIRNLLLSLTLRRLGDAERGLALLDDIVLPKIFYIQNGKVKYFKKTEDPWAYPAALYERALFCWKLGGMESLNECREWLLRAQNYAADYELSTRIGMKIKAALDRVENALA

SEQ ID NO: 25663 - protein, 299 aa, Saccharomyces cerevisiae
  strain YJM789
MKLSKLSILTSALATSALAAPAVVTVTEHAHEAAVVTVQGVVYVENGQTRTTYETLAPASTATPTSTATALVAPPVALSSASSNSDAVLSALKNLASVWGKTTDSTTTLTPSESTSQSLAQATTTSTPAAASTTSTPAATTTTSQAAATSSASSSDSDLSDFASSVLAEHNKKRALHKDTPALSWSDTLASYAQDYADNYDCSGTLTHSGGPYGENLALGYDGPAAVDAWYNEISNYDFSNPGFSSNTGHFTQVVWKSTTQVGCGIKTCGGAWGDYVICSYDPAGNYEGEYADNVEPLA

SEQ ID NO: 25664 - protein, 914 aa, Saccharomyces cerevisiae
  strain YJM789
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSSTSTTSETVSTISSSIMPAVAQGYTTTVSSAASSSSLKSTTINPAKTATLTASSSTVITSSTESVGSSTVSSASSSSVTTSSSTVVSSDATSSTTTTSSVATSSSTTSSDPGSSTTTASSSTTSSDLTSSTTSSSSSTTSSDPTSSTAASSSSTTSSDPVSSSAAASSSASTENAASSSSAISSSSSMVSAPLSSTLTTSAASSRSVTSSSVNSVKFANTTVFSAQTTSSVSASLSSSVAADDIQGSTSKEATSSVSEHTSIVTSATNAAQYATRLGSSSRSSSGAVSSSAVSQSALNSVIAVNTDVSVTSVSSAAHTTKDTATTSVTASESITSDTAQVSSSTEKKISNSAATSSSIYSNSASVSGHGVTYAAEYAITSEQSSALATSVPATNRSSIVKTTTLENSSTATITAITESTTTLATTANNYTRAATAVTIDPTLDPTDNSASPTDNAKHTSTYGSSSTGASLDSLRTTTSISASSNTTQLVSTCTSESDYSDSPSFAISTATTTESNLITNTITASCSTDSNFPISAASSTDETAFTRTISTSCSTLNGASTQTSELSTSPMKTNTVVPASSFPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25665 - protein, 361 aa, Saccharomyces cerevisiae; identical to SEQ ID NO: 25615
  strain YJM789

SEQ ID NO: 25666 - protein, 276 aa, Saccharomyces cerevisiae
  strain YJM789
MRLQRNSIICALVFLVSFVLGDVNIVSPSSKATFSPSGGTVSVPVEWMDNGAYPSLSKISTFTFSLCTGPNNNIDCVAVLASKITPSELTQDDKVYSYTAEFASTLTGNGQYYIQVFAQVDGQGYTLHYTPRFQLTSMGGVTAYTYSATTEPTPQTSIQTTTTNNAQATTIDSRSFTVPYTKQTGTSRFAPMQMQPNTKVTATTWTRKFATSAVTYYSTFGSLPEQATTITPGWSYTISSGVNYATPASMPSDNGGWYKPSKRLSLSARKINMRKV

SEQ ID NO: 25667 - protein, 287 aa, Saccharomyces cerevisiae
  strain YJM789
MHYKKAFLASLLSSIALTAYAPPEPWATLTPSSKMDGGTTEYRTSFGLAVIPFTVTESKVKRNVISQINDGQVQVTTQKLPHPVSQIGDGQIQVTTQKVPPVVSHIVSQIGDGQLQITTAKNVVTKSTIAVPSKTVTATATSTATAVSQIHDGQVQVTISSASSSSVLSKSKLEPTKKPNNEKVIKVQACKSSGTLAITLQEGVLIDSSGRIGSIVANRQFQFDGPPPQAGAIYAGGWSITKHGTLAIGDNDVFYQCLSGTFYNLYDQSIGGQCNPVHLQTVGLVDC

SEQ ID NO: 25668 - protein, 389 aa, Saccharomyces cerevisiae
  strain YJM789
MQYKKTLVASALAATTLAAYAPSEPWSTLTPTATYSGGVTDYASTFGIAVQPISTTSSASSAATTASSKAKRAASQIGDGQVQAATTTASVSTKSTAAAVSQIGDGQVQATTKTTAAAVSQIGDGQIQATTKTTSAKTTAAAVSQIGDGQIQATTTTLAPKSTAAAVSQIGDGQVQATTKTTAAAVSQIGDGQVQATTKTTAAAVSQIGDGQVQATTKTTAAAVSQIGDGQVQATTKTTAAAVSQITDGQVQATTKTTQAASQVSDGQVQATTATSASAAATSTDPVDAVSCKTSGTLEMNLKGGILTDGKGRIGSIVANRQFQFDGPPPQAGAIYAAGWSITPDGNLAIGDNDVFYQCLSGTFYNLYDEHIGSQCTPVHLEAIDLIDC

SEQ ID NO: 25669 - protein, 225 aa, Saccharomyces cerevisiae; identical to SEQ ID NO: 25557
  strain YJM789

SEQ ID NO: 25670 - protein, 714 aa, Saccharomyces cerevisiae
  strain YJM789
MSVNDQITHIGKTLSTTASAFLNYQKSNSNTQDVLTNNGPYKNLLSNTVNNASSTSYFYKRTEHGRFVKNASNTFEDIYSKTRRGDVFRNKFTDNKTCFRMLTYISDDLLNEIPTKEGLKSDADGKLLTEGGENENLRKNASKKETSLFQGFKSYLPIAELAIENTERLNYDTNGTSGTVGAKDVMSKTNERDEIHTELPNFQDSFLIPPGVETKKISSSYSPSALKSFSQTLVNSLEFLNIQKNSTLSEIRDIEVEVENLRQKKEKLLGKIANIEQNQLLLEDNLKQIDDRLDFLEEYGLEVIEANSDENAEDDGMSERKALKNDAIRNEGVTTESISSEASNLPPRRRQQLRDDNSLNRLGAFYSKSKKRHRKSFPTFQQLYEPGTKIGSIMSTHDDFLTCLDFDAPFGTLCTAGYLDHTVKIWDLSKQNKIGELAGHLATINCMQINRDYGTLVTGGRDAALKLWNLNLAQQLYQETQNLTSPTNHIDSPCVYTFEAHTDEVTALSLDPSFLVSGSQDRTIRQWDLRSGKCLQTIDLSFANVLTTSTNVDLSKSTLLTQRNERPSIGALQSFDAALATGTKDGVVRLWDLRSGKVIRTLKGHTDAITSLKFDSACLVTGSYDRTVRIWDLRTGLLNKFHAYSAPVLSLDLFQENAAVVVADEPSVQIYDSEKDESWSCVEQGNETSVSTVKYKENYMVEGRENGDVNIWAV

SEQ ID NO: 25671 - protein, 617 aa, Saccharomyces cerevisiae; identical to SEQ ID NO: 25387
  strain YJM789

SEQ ID NO: 25672 - protein, 102 aa, Saccharomyces cerevisiae [sequence omitted]

SEQ ID NO: 25673 - protein, 321 aa, Saccharomyces cerevisiae
  strain YJM789
MTRPPLVRGIFSLGLSVAVLKGVEKTVRKHLERQGWIEPQKVDYELIFTIDRLKNLVDNKREALTAEQPDAGELSWRKVFNFISRQSSELDARIYVLILLLSFLLPIAWTVLDGDRETTLEDKDNDCNVDLIENERRLKHYNDGERAVLQFGKNRSEPIILSYKDMNVLEGEHEFTSKEEHSNSHLTSKSENALSQVGSEDLLGCHLEKQLEEDKNEPNGEADGEDDNNREKDCSSSSEVESQSKCRKESTAEPDSLSRDTRTTSSLKSSTSFPISFKGSIDLKSLNQPSSLLHIQVSPTKSSNLDAQVNTEQAYSQPFRY

SEQ ID NO: 25674 - protein, 459 aa, Saccharomyces cerevisiae; identical to SEQ ID NO: 25485
  strain YJM789

SEQ ID NO: 25675 - protein, 120 aa, Saccharomyces cerevisiae; identical to SEQ ID NO: 25419
  strain YJM789

SEQ ID NO: 25676 - protein, 529 aa, Saccharomyces cerevisiae; identical to SEQ ID NO: 25464
  strain YJM789

SEQ ID NO: 25677 - protein, 284 aa, Saccharomyces cerevisiae
  strain YJM789
MAIDAQKLVVVIVIVVVPLLFKFIIGPKTKPVLDPKRNDFQSFPLVEKTILTHNTSMYKFGLPHADDVLGLPIGQHIVIKANINGKDITRSYTPTSLDGDTKGNFELLVKSYPTGNVSKMIGELKIGDSIQIKGPRGNYHYERNCRSHLGMIAGGTGIAPMYQIMKAIAMDSHDTTKVSLVFGNVHEEDILLKKELEALVAMKPSQFKIVYYLDSPDREDWAGGVGYITKDVIKEHLPAATVDNVQILICGPPAMVASVRRSTVDLGFRRSKPLSKMEDQVFVF

SEQ ID NO: 25678 - protein, 186 aa, Saccharomyces cerevisiae; identical to SEQ ID NO: 25627
  strain YJM789

SEQ ID NO: 25679 - protein, 268 aa, Saccharomyces cerevisiae; identical to SEQ ID NO: 25483
  strain YJM789

SEQ ID NO: 25680 - protein, 444 aa, Saccharomyces cerevisiae
  strain YJM789
MQLHSLIASTALLITSALAATSSSSSIPSSCTISSHATATAQSDLDKYSRCDTLVGNLTIGGGLKTGALANVKEINGSLTIFNATNLTSFAADSLESITDSLNLQSLTILTSASFGSLQSVDSIKLITLPAISSFTSNIKSANNIYISDTSLQSVDGFSALKKVNVFNVNNNKKLTSIKSPVETVSDSLQFSFNGNQTKITFDDLVWANNISLTDVHSVSFANLQKINSSLGFINNSISSLNFTKLNTIGQTFSIVSNDYLKNLSFSNLSTIGGALVVANNTGLQKIGGLDNLTTIGGTLEVVGNFTSLNLDSLKSVKGGADVESKSSNFSCNALKALQKKGGIKGESFVCKNGASSTSVKLSSTSKSQSSQTTAKVSKSSSKAEEKKFTSGDIKAAASASSVSSSSASSSSSKSSKGNAAIMAPIGQTTPLVGLLTAIIMSIM

SEQ ID NO: 25681 - protein, 222 aa, Saccharomyces cerevisiae
  strain YJM789
MSSSESIRMVLIGPPGAGKGTQAPNLQERFHAAHLATGDMLRSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKN

SEQ ID NO: 25682 - protein, 341 aa, Saccharomyces cerevisiae
  strain YJM789
MQYKKSLVASALVATSLAAYAPKDPWSTLTPSATYKGGITDYSSTFGIAVEPIATTASSKAKRAAAISQIGDGQIQATTKTTAAAVSQIGDGQIQATTKTKAAAVSQIGDGQIQATTKTTSAKTTAAAVSQIGDGQIQATTKTKAAAVSQIGDGQIQATTKTTAAAVSQIGDGQIQATTKTTAAAVSQIGDGQIQATTNTTVAPVSQITDGQIQATTLTSATIIPSPAPAPITNGTDPVTAETCKSSGTLEMNLKGGILTDGKGRIGSIVANRQFQFDGPPPQAGAIYAAGWSITPEGNLAIGDQDTFYQCLSGNFYNLYDEHIGTQCNAVHLQAIDLVNC

SEQ ID NO: 25683 - protein, 415 aa, Saccharomyces cerevisiae
  strain YJM789
MQYKKPLVVSALAATSLAAYAPKDPWSTLTPSATYKGGITDYSSSFGIAIEAVATSASSVASSKAKRAASQIGDGQVQAATTTAAVSKKSTAAAVSQITDGQVQAAKSTAAAASQISDGQVQAAKSTAAAVSQITDGQVQAAKSTAAAVSQITDGQVQAAKSTAAAVSQITDGQVQAAKSTAAAVSQITDGQVQAAKSTAAAASQISDGQVQAAKSTAAAASQISDGQVQAAKSTAAAASQISDGQVQAAKSTAAAASQISDGQVQATTSTKAAASQITDGQIQASKTTSGASQVSDGQVQATAEVKDANDPVDVVSCNNNSTLSMSLSKGILTDRKGRIGSIVANRQFQFDGPPPQAGAIYAAGWSITPEGNLALGDQDTFYQCLSGDFYNLYDKHIGSQCHEVYLQAIDLIDC

SEQ ID NO: 25684 - protein, 302 aa, Saccharomyces cerevisiae
  strain YJM789
MFSRLSRSHSKALPIALGTVAIAAATAFYFANRNQHSFVFNESNKVFKGDDKWIDLPISKIEEESHDTRRFTFKLPTEDSEMGLVLASALFAKFVTPKGSNVVRPYTPVSDLSQKGHFQLVVKHYEGGKMTSHLFGLKPNDTVSFKGPIMKWKWQPNQFKSITLLGAGTGINPLYQLAHHIVENPNDKTKVNLLYGNKTPQDILLRKELDALKEKYPDKFNVTYFVDDKQDDQDFDGEIGFISKDFIQEHVPGPKESTHLFVCGPPPFMNAYSGEKKSPKDQGELIGILNNLGYSKDQVFKF

SEQ ID NO: 25685 - protein, 341 aa, Saccharomyces cerevisiae
  strain YJM789
MKFSKVSLLAASASVALSAPVAVTVTQHVHQAATVVVQGIVRVENGQTLTTFITKGTQTASASPVATTSAPIVVANAQVDSIATSVIQESTVVAESATFEESSTETSEAFSTATATIQAVQTSASATQDDVTTTLTSSTQPTSTTTPTTTTTSPTTTTSPTTTTSPTTTTSPTTTASPTTTASPTTATTTQSTASSTQSSSSDFSTSMVNEHNTKRALHKDTGSLTWSDTLATYAQNYADSYDCSGNLVHSGGPYGENLALGYGTTGSVDAWYNEITSYDYSNPGFSESAGHFTQVVWKGTSEVGCGLKSCGGEWGDYIICSYKAAGNVIGEFADNVMPLA

SEQ ID NO: 25686 - protein, 725 aa, Saccharomyces cerevisiae
  strain YJM789
MFKVFGFGAKEEIPELSQEEKTKAILKQAHDFEQALRAMDYVLDDNADEGLALLDESDAKEASDQTINALARGVIEFLEATLGFEAEEMKKASATLAKAEALSLKSRERAQKIGLKSSSLYPPGTVYAVTYTESCLLHALLMIFSESMMEAAKAILKLRKSYYMLQEILETIKAANKAKKLKITSGSEDKESTPATFITGGDAFNSVDIPYELTPEEQKDKDLLQFAEQIHSMRTKRLSGAHIGNSPAINRLRGELGLQAMEDLPEEEITDHKVLSDDIDLSQATIDEFVHSGVNLCFGILQVVISLLPPAIGAVLSVVGFRGSREEGLRLVWKATKQRNVHGCIGLLALMFYYDGPFQFTDDDFDIPAAVKDSSNSEDSEDEEMDGPTLLHPGKILEDALLQSRALFPNSALWLLNEARMLSGKGRLEEAVALMDSIDVSKIRMRQVKSLMIFDRAITLIHLHQYDRAAEDILSLLDISDWSHAFYTYFAGCCYLENWRMCEMGLMKSDKKDEYQKKAEELIFTSVNLLGKKTFKSKNLPLDRFILRKVEQFKAKKEELGVENPLDGIATSPVHEISYFYNGYNRMSEEHLELTKKMLTEYRNPAIEALDSDQELIKDLLVSLTLRRLGHIQEGCDILDEKVLPKFFSIQNGKVKYIKKTEDPWAYPTALYERALFTWKLEGMDGLPESKEWLLRAQGYADDYELSTRVGMKIKAAIDRVDHSL

SEQ ID NO: 25687 - protein, 645 aa, Saccharomyces cerevisiae
  strain YJM789
MGSGDTRGESSLVAKPIEIILNKLPHAILAQQQFQKYITSPIYRYLSKLLLFREVAWPESTKDTQKGQVGIFSFQNNYADSATTFRILAHLDEQRYPLPNGAAEKNLPSLFEGFKATVSIIQQRLLLDNVDGATNSDKEKYVQLPDINTGFVNKTYSRIDLTHLLEDVETNVENLSINKTLEMDELTRLDSMINELESRKLKILERVKHIDSKSTNLENDVTLIKDRINFIEEYSLEADREQSLRKQMEEERSSEASSFTQNEEAISSLYDVESKDTRLKDFYKMPHEKSHDKNRQMHIISETYSRNSTAFRMTIPHGEHGNSITALDFDTPWGTLCSSSYQDRIVKVWDLNHGIQVGELPGHLATVNCMQIDKKNYNMLITGSKDATLKLWDLNLSRELYLDHSPLKEKTEEIVTPCIHNFELHKDEITALSFDSEALVSGSRDKKIFHWDLTTGKCIQQLDLIFTPTHSDIKMPARSLNNGTCLLGTEAPMIGALQCYNSALATGTKDGLVRLWDLRVGKPVRLLEGHTDGITSLKFDSEKLVTGSMDNSVRIWDLRTSSILDVIAYDLPVSSLDFDGKLITVGANEGGVNVFNMERDEHWMTPEPPHSLDGDELSRRIAIVKYKDGFLINGHNDGDINVWTL

SEQ ID NO: 25688 - protein, 362 aa, Saccharomyces cerevisiae
  strain YJM789
MKLSALLALSASTAVLAAPAVHHSDNHHHNDKRAVVTVTQYVNADGAVVIPAANTATSAAADGKVESVAAATTTLSSTAAAATTSAAASSSSSSSSSSSSVGSGDFEDGTISCSDFPSGQGAVSLDWLGLGGWASIMDMNGNTATSCQDGYYCSYACSPGYAKTQWPSEQPSDGRSVGGLYCKNGKLYRSNTDTNSLCVEGQGSAQAVNKVSGSIAICGTDYPGSENMVVPTVVGAGSSQPINVIKEDSYYQWQGKKTSAQYYVNNAGVSVEDGCIWGTEGSGVGNWAPVVLGAGYTDGITYLSIIPNPNNKEAPNFNIKIVATDGSTVNGACSYENGVYSGSGSDGCTVSVTSGSANFVFY

SEQ ID NO: 25689 - protein, 348 aa, Saccharomyces cerevisiae; identical to SEQ ID NO: 25617
  strain YJM789

SEQ ID NO: 25690 - protein, 662 aa, Saccharomyces cerevisiae; identical to SEQ ID NO: 25548
  strain YJM789

SEQ ID NO: 25691 - protein, 493 aa, Saccharomyces cerevisiae
  strain YJM789
MLPYMDQVLRAFYQSTHWSTQNSYEDITATSRTLLDFRIPSAIHLQISNKSTPNTFNSLDFSTRSRINGSLSYLYSDAQQLEKFMRNSTDIPLQDATETYRQLQPNLNYSVSSGNTLSSDNTTVDNDKKLLHDSKFVKKSLYYGRMYYPSSDLEAMIIKRLSPQTQFMLKGVSSFKESLNVLTCYFQRDSHRNLQEWIFSTSDLLCGYRVLHNFLTTPSKFNTSLYNNSSLSLGAEFWLGLVSLSPGCSTTLRYYTHSTNTGRPLTLTLSWNPLFGHISSTYSAKTGTNSTFCAKYDFNLYSIESNLSFGCEFWQKKHHLLETNKNNNDKLEPISDELVDINPNSRATKLLHENVPDLNSAVNDIPSTLDIPVHKQKLLNDLTYAFSSSLRKIDEERSTIEKFDNKINSSIFTSVWKLSTSLRDKTLKLLWEGKWRGFLISAGTELVFTRGFQESLSDDEKNDNAISISATDTENGNIPVFPAKFGIQFQYST

SEQ ID NO: 25692 - protein, 268 aa, Saccharomyces cerevisiae; identical to SEQ ID NO: 25483
  strain Zymaflore VL3

SEQ ID NO: 25693 - protein, 120 aa, Saccharomyces cerevisiae; identical to SEQ ID NO: 25419
  strain Zymaflore VL3

SEQ ID NO: 25694 - protein, 276 aa, Saccharomyces cerevisiae; identical to SEQ ID NO: 25455
  strain Zymaflore VL3

SEQ ID NO: 25695 - protein, 299 aa, Saccharomyces cerevisiae; identical to SEQ ID NO: 25475
  strain Zymaflore VL3

SEQ ID NO: 25696 - protein, 894 aa, Saccharomyces cerevisiae
  strain Zymaflore VL3
MLEFPISVLLGCLVAVKAQTTFPNFESDVLNEHNKFRALHVDTAPLTWSDTLATYAQNYADQYDCSGVLTHSDGPYGENLALGYTDTGAVDAWYGEISKYNYSNPGFSESTGHFTQVVWKSTAEIGCGYKYCGTTWNNYIVCSYNPPGNYLGEFAEEVEPLISTVSSSSSSSSSTSTTSDTVSTISSSIMPAVAQGYTTTVSSAASSSSLKSTTINPAKTATLTASSSTVITSSTESVGSSTVSSASSSSVTTSYATSSSTVVSSDATSSTTTTSSVATSSSTTSSDPASSTTTASSSTTSSDPTSSTAAASSSDPASSSAAASSSASTENAASSSSAISSSSSMVSAPLSSTLTTSTASSRSVTSSSVNSVKFANTTVFSAQTTSSVSASLSSSVAADDIQGSTSKEATSSVSEHTSIVTSATNAAQYATRLGSSSRSSSGAVSSSAVSQSVLNSVIAVNTDVSVTSVSSAAHTTKDTATTSVTASESITSETAQASSSTEKNISNSAATSSSIYSNSASVSGHGVTYAAEYAITSSALATSVPATNCSSIVKTTTLENSSTTTITAITKSTTTLATTANNSTRAATAVTIDPTLDPTDNSASPTDNAKHTSTYGSSSTGASLDSLRTTTSISVSSNTTQLVSTCTSESDYSDSPSFAISTATTTESNLITNTITASCSTDSNFPTSAASSTDETAFTRTISTSCSTLNGASTQTSELTTSPMKTNTVVPASSFPSTTTTCLENDDTAFSSIYTEVNAATIINPGETSSLASDFATSEKPNEPTSVKSTSNEGTSSTTTTYQQTVATLYAKPSSTSLGARTTTGSNGRSTTSQQDGSAMHQPTSSIYTQLKEGTSTTAKLSAYEGAATPLSIFQCNSLAGTIAAFVVAVLFAF

SEQ ID NO: 25697 - protein, 329 aa, Saccharomyces cerevisiae
  strain Zymaflore VL3
  MOD_RES (69)..(69): Any amino acid
  MOD_RES (164)..(164): Any amino acid
  MOD_RES (170)..(170): Any amino acid
MKFSKVSLLAASASVALSAPVAVTVTQHVHQAATVVVQGIVRVENGQTLTTFITKGTQTASASPVATTXAPIVVANAQVDSIATSVIQESAVVAESATFEESSTETSEAFSTATATIQAVQTSASATQDDVTTTLTSSTQPTSTTTPTTTTTSPTTTTSPTTTXSPTTTXSPTTATTTQSTASSTQSSSSDFSTSMVNEHNTKRALHKDTGSLTWSDTLATYAQNYADSYDCSGNLVHSGGPYGENLALGYGTTGSVDAWYNEITSYDYSNPGFSESAGHFTQVVWKGTSEVGCGLKSCGGEWGDYIICSYKAAGNVIGEFADNVMPLA

SEQ ID NO: 25698 - protein, 165 aa, Saccharomyces cerevisiae
  strain Zymaflore VL3
  MOD_RES (72)..(72): Any amino acid
MRFPSIFTAVLFAASSALAAPVNTTTEDETAQIPAEAVIGYLDLEGDFDVAVLPFSNSTNNGLLFINTTIAXIAAKEEGVSLDKREAEAWHWLQLKPGQPMYKREAEAEAWHWLQLKPGQPMYKREADAEAWHWLQLKPGQPMYKREADAEAWHWLQLKPGQPMY

SEQ ID NO: 25699 - protein, 316 aa, Saccharomyces cerevisiae killer virus M1
MTKPTQVLVRSVSILFFITLLHLVVALNDVAGPAETAPVSLLPREAPWYDKIWEVKDWLLQRATDGNWGKSITWGSFVASDAGVVIFGINVCKNCVGERKDDISTDCGKQTLALLVSIFVAVTSGHHLIWGGNRPVSQSDPNGATVARRDISTVADGDIPLDFSALNDILNEHGISILPANASQYVKRSDTAEHTTSFVVTNNYTSLHTDLIHHGNGTYTTFTTPHIPAVAKRYVYPMCEHGIKASYCMALNDAMVSANGNLYGLAEKLFSEDEGQWETNYYKLYWSTGQWIMSMKFIEESIDNANNDFEGCDTGH

SEQ ID NO: 25700 - protein, 662 aa, Saccharomyces cerevisiae x Saccharomyces kudriavzevii VIN7; identical to SEQ ID NO: 25548

SEQ ID NO: 25701 - protein, 268 aa, Saccharomyces cerevisiae x Saccharomyces kudriavzevii VIN7
MLIILFLTLFCSVVFRTAYCDVAIVAPEPNSVYDLSGTSQAVVKVKWMHTDNTPQEKDFVRYTFTLCSGTNAMIEAMATLQTLSASDLTDNEFNAIIENTVGTDGVYFIQVFAQTAIGYTIHYTNRFKLKGMIGTKAANPSMITIAPEAQTRITTGDVGATIDSKSFTVPYNLQTGVVKYAPMQLQPATKVTAKTWKRKYATSEVTYYYTLRNSVDQHTTVTPGWSYIITADSNYATPAPMPADNGGWYNPRKRLSLTARKVNALRHR

SEQ ID NO: 25702 - protein, 120 aa, Saccharomyces cerevisiae x Saccharomyces kudriavzevii VIN7; identical to SEQ ID NO: 25419

SEQ ID NO: 25703 - protein, 299 aa, Saccharomyces cerevisiae x Saccharomyces kudriavzevii VIN7; identical to SEQ ID NO: 25475

SEQ ID NO: 25704 - protein, 276 aa, Saccharomyces cerevisiae x Saccharomyces kudriavzevii VIN7
MRLQRNSIICALVFLVSFVLGDVNIVSPSSKATFSPSGGTVSVPVEWMDNGAYPSLSKISTFTFSLCTGPNNNIDCVAVLASKITPSELTQDDKVYSYTTEFASTLTGNGQYYIQVFAQVDGQGYTIHYTPRFQLTSMGGVTAYTYSATTEPTPQTSIQTTTTNNAQATTIDSRSFTVPYTKQTGTSRFAPMQMQPNTKVTATTWTRKFATSAVTYYSTFGSLPEQATTITPGWSYTISSGVNYATPASMPSDNGGWYKPSKRLSLSARKINMRKV

SEQ ID NO: 25705 - protein, 361 aa, Saccharomyces cerevisiae x Saccharomyces kudriavzevii VIN7; identical to SEQ ID NO: 25615

SEQ ID NO: 25706 - protein, 341 aa, Saccharomyces cerevisiae x Saccharomyces kudriavzevii VIN7
MKFSKVSLLAASASVALSAPVAVTVTQHVHQAATVVVQGIVRVENGQTLTTFITKGTQTASASPVATTSAPIVVANAQVDSIATSVIQESAVVAESATFEESSTETSEAFSTATATIQAVQTSASATQDDVTTTLTSSTQPTSTTTPTTTTTSPTTTTSPTTTTSPTTTTSPTTTASPTTTASPTTATTTQSTASSTQSSSSDFSTSMVNEHNTKRALHKDTGSLTWSDTLATYAQNYADSYDCSGNLVHSGGPYGENLALGYGTTGSVDAWYNEITSYDYSNPGFSESAGHFTQVVWKGTSEVGCGLKSCGGEWGDYIICSYKAAGNVIGEFADNVMPLA

SEQ ID NO: 25707 - protein, 631 aa, Saccharomyces cerevisiae x Saccharomyces kudriavzevii VIN7
MPTIQDVLPPISIPRDFSSLPSYSPRNTVLIDTSDSDLIVLDHELKSADVIWLVYCDHESYDHVSLFWLPHFRSLGLNIPVILCKNKCDSISDANANAMMAPANSDDIDTKVEDEEFIPILMEFKEIDTCIKTSAKTQFDLNQAFYLCQRAITHPISPLFDAMIGELKPLAVMALKRIFLLSDLNQDSYLDDGEILGLQKKCFNKSIDVNELNFIKDMLSDISKHDQQYANRKLYVAGKGITKDGFLVLNKIYAERGRHETMWAILRTFHYTDSLCINDKILHPRLVVPDTSSVELSPKGYRFLVDIFLKFDTDNDGGLNNQELHRLFKCTPGLPESWISTNFPFSTVVNNKSCITLQGWLAQWSMTTFLNYSTTTAYLVYFGFQEDARLALQVTKPRKMRRRSGKLYRSIVNDRKVFNCFVIGKPCCGKSSLLEAFLGRSFSEEYSPTIKPRIAVNSLELKGGKQYYLILQELGEQEYAILENKDKLKECDVICLTYDSSDPESFSYLVSLLDKFAHLQDLPLVFVASKADLDKQQQRCHVQPDELADELFVNHPLHISSRWLSSLNELFIKITEAALDPGKNTPGLPEEAPTKDVDYRQTALILGSTVGFIALCSFTLMKLFKPSKFHK

SEQ ID NO: 25708 - protein, 202 aa, Saccharomyces cerevisiae x Saccharomyces kudriavzevii VIN7
MLVVPFLALLCSLALQTVYCDVAIVGPLPNSVFDLSGSGQSTIKVKWMHTDSTPQEKDFIKYTFTLCTGTNAMIEAMASLQTLTAAELTDNEFEAVIKNTVGTDGVYFIQVFAQTAIGYTIHYTNRFKLKGMVGAKVASPSMITIAPEAQTRITTGDLGATIDSRSFTVPYNLQTGVVKYAPMQLQPGYESNGEDMEKKVRH

SEQ ID NO: 25709 - protein, 276 aa, Saccharomyces cerevisiae x Saccharomyces kudriavzevii VIN7
MRLQTNSILCALVFLITCVFADVNVVSPHSKATFSPSGETVSIPIEWMDNGAYPPLAKFASFTFTLCTGPNNNIQAVAIIASKIKPSQLTLDGSVYSYTATFPSTLAGDGQYYIQVYGWVDNQGSTTHYTPRFQLTSMGGTTAYTFSDSVAPTPQTSIQTTTTNNAQATTIDSRSFTVPYTQQTGTSRFAPMQMQPNTKVTATTWTRKYATSAVTYYSTFGSLPQQGTTLTPGWSYTISSGMNYATPAAMPSDNGGWYEPSKRLSLSARKINMRKA

SEQ ID NO: 25710 - protein, 293 aa, Saccharomyces cerevisiae x Saccharomyces kudriavzevii VIN7
MKLSKLSILTSALATTAFAAPAVVTVTEHAHNAAVVTVQGVVYVENGQILTTYKTFAPTSAAKPTSTATAVIAPPIASASASASGSSGSNAALSALQDLANVWGKTTDSTTTLTPSTSPSQSQPQATATASPTVTATTSQAAATSASASDDELSDFASSVLAEHNKKRALHKDTPALTWSNTLATYAQDYADNYDCSGTLTHSGGPYGENLALGYDGTSAVDAWYNEISSYDFSNPGFSGNTGHFTQVVWKSTTQVGCGIKTCGGAWGDYVICSYDPAGNYEGEYADNVEPLA

SEQ ID NO: 25711 - protein, 290 aa, Saccharomyces cerevisiae x Saccharomyces kudriavzevii VIN7
MIFGNSLLLSTLYTFAVATPLLKRDSCTLSGSSLSSLSTVKKCTSIIIKDLTVPAGQTLDLSGLSKGTTVTFQGTTTFQYKEWAGPLISISGSKISVVGASGHVIDGQGAKWWDGLGDNGKVKPKFVKLALTGTSKVTGLNVKNAPHQVFSVNKCSDLTISGVTIDIRDGDSAGGHNTDAFDVGSSTNVVIQGCTVYNQDDCIAVNSGTTIKFLNNYCYNGHGISIGSVGGRSDNIVNGFWAENNHVINSDNGLRIKTVQGATGSVTNVNFITNTISNIKNTVLLLKVII

SEQ ID NO: 25712 - protein, 130 aa, Saccharomyces cerevisiae x Saccharomyces kudriavzevii VIN7
MRFSSIITAVFAASSALAAPVNTTSESETVQIPAEAIIGYLDLEGDFDVAVLPFANSTNNGLLFINTTIANLATKEESVPLSKREAEADAEAWHWLQLKPGQPMYKREAEAEADAEAWHWLQLKPGQPMY

SEQ ID NO: 25713 - protein, 350 aa, Synechococcus elongatus
  strain PCC 7942
MKTAWTRRSFLQSAALATATVITIAACGGNNQSSSGGSGQPVEVTLVSYAVTQAAYEQIIPKFAAQWKEKTGQEVRFNQSYGGSGSQTRAVIDGLEADVVALALESDINQIEKAGLIQPGWQQRVPNNGIITNSVVALVTQEGNPKGIKDWTDLTKPGVRIVTANPKTSGGARWNFLGAWGSVTQTGGTEEQALQFTTDIYKNVPILAKDARESTDVFTKGQADVLLNYENELILAQQKGEKVDYAIPPVNINIQGPVAVVDTYTDKHGTRKVSEAFVQFLFTPEAQAEFAKVGFRPALPEGVDPQLLAPFPKIQTWFTVADLGGWAKVQPEFFGDGGWFDKVQQAVAGR

SEQ ID NO: 25714 - protein, 320 aa, Synechococcus elongatus
  strain PCC 7942
MSVRSLRWPRQKAFLAVISLVVAVLLAVPGWLTPATAASQATVQFVAPTWAAERLNNKQLKILDVRTNPLAYIEGHLPGAVNIADAAYRGPNGFLPVQIWDPEKLASLFGRAGVSNNDTVLVYSDGNDVLGATLVAYLLERSGVQNIAVLDGGYKGYKDAGLPVTKEYPRYQAARFAPKDNRAFRVDIKQVEQLTGKSTFVDPRPPALFSGEQQVFIRNGHIPGARNIPWPTFTEANNANESLKNPHKLKPLSELKAILEAKGVTPDKDVIVTCSTGREASLQYLVLKHLLKYPKVRIYEGSWTEYSASNLPVETGPDRV

SEQ ID NO: 25715 - protein, 771 aa, Synechococcus elongatus
  strain PCC 7942
MQAWKILGSGLVLGTAAIAGQPSPVWAQAASTIAANPSATEVNRVLVTPTTNGISLSLSTTGTQAPQAFSTNLDKVWVTDLIGARLNLPEGKSFTQPNPVPGIESIAVSQVSENGVRIVVTGSDRPPIVTNSSRNGGSLQFELSTQTAIAAAPSPSAPLVGAAPRPNLRPPAAPAPQRTAQATPPTPIPVSPAPQPPVQPLDPRQVLQPTPSPAPGQLPPLQPRAVAPPLGDIAISNTVPQGTAVTFPNARPVPRIALRNASAREVLSIIATSAGLNLVYLDSNGQPTAAAPVVSNEPKVSVDLQNIDAQSAFNYVLQIAGLQASRRDNVILVGRNLPPSAGGLVSRTFRLNQAVAQNVAGYLTTLGANSVVSFTKKVCVSTGVQDTTATGGGAGTGAGQGQIQTLSQTSAQCFDEPEVKELKVPGTPAGPLPLKNISITADIRTNSLSIVGDPQAINFATGLIQQLDLRKRQASVNVKVIDLDLNDLNAIATSFSFGIGNTLFSGSGGLRTTVIDNAGSVIQPPNDSVFNPSNLPAGINPANPLLALPNQLTNNFLGALSASIINNKTKLLTDPTLIIQEGERSEVKLTSQVVQKIESETTTNGSGPPTVSRTIDLADVGLQLTINIERIDDNGFITLTVLPAISSPQDVVTFGDPNTNGVLTTLIKKREVSSGKIRLRDSQTLILSGIIQDEERERVAKIPLLGDLPLIGSLFRTSYTDRQRREVVVVITPKILADTDATVFGYGYQPSPPAQSVLNNTLQTPTVAPLP

SEQ ID NO: 25716 - protein, 430 aa, Synechococcus elongatus
  strain PCC 7942
MPDDYGTQIAEITAREILDSRGRPTVEAEVHLEDGSVGLAQVPSGASTGTFEAHELRDDDPSRYGGKGVQKAVENVSAIEDALIGLSALDQEGLDKAMIALDGTPNKKNLGANAILAVSLATAHAAATSLNLPLYRYLGGPLANVLPVPMMNVINGGAHADNNVDFQEFMIMPVGAPSFKEALRWGAEVFHALAKVLKDKGLATGVGDEGGFAPNLGSNKEALELLLTAIEAAGYKPGEQVALAMDVASSEFYKNGLYTCDGVSHEPAGMIGILADLVSQYPIVSIEDGLQEDDWSNWKTLTQQLGSTVQLVGDDLFVTNPDRLQSGIEQGVGNAVLIKLNQIGTLTETLRTIDLATRSGYRSVISHRSGETEDTTIADLAVATRAGQIKTGSLSRSERIAKYNRLLRIEAALGENALYAGAIGLGPKGR

SEQ ID NO: 25717 - protein, 339 aa, Synechococcus elongatus
  strain PCC 7942
MIRIRNRWFRWLAIALASLVASIGIATVGFAATGVTPDQVLSAIEGTFGVNVGQRRNHIKGTCAVGNFVATTEAKTYSRSPLFSGQSIPVVARFSLAGGNPKAPDTAKNPRGLGLQFQLPNNRFLNMALLNTPVFGVASPEGFYENILAIRPDPTTGKPDPEKVKAFREKYPENKAQAAFLASNNPPTSYANTSYFGLHAFKFINQTNQTRLVRWQFVPQDGEKRLTDAELQAAPANFLEQKLIERTQDSPVKWDFWITLGQPGDAEDNPTIAWPSDRQQVKVGTLTLTAASPQPGAACEGINYDPLVLSDGIEPTNDPVLQFRSGVYALSYSKRTRGL

SEQ ID NO: 25718 - protein, 302 aa, Synechococcus phage P60
MMASASLPVTFVGVDGVDGAVGPQGPEGPQGLQGDTGPQGPQGLQGEQGLQGPQGLPGADGADGAQGPQGIQGEQGLQGPQGLPGADGADSTVPGPQGPKGDKGDTGDAGPQGPKGDTGDAGPQGLKGDPGNDGADGATGPEGPQGPQGNPGADGADGAQGPKGDKGDTGDPGAQGPQGNPGDQGPQGNPGADGADGAIGPEGPQGPQGPEGPEGPMSTAALTVDINSDIASASRAIIYAPGSNGQASLKYNGSFLINPLNGTLTAPTFIGDLTGDVSVATISYLGFEHRCYSHRQPHNDCW

SEQ ID NO: 25719 - protein, 372 aa, Synechococcus phage S-CBS2
MANLIKLRRSAVQGNIPTTAQIALGELALNTYDGKLYAKKSVGGVESIVELSGGGGGGGTTGTPLRYLHVDGTTTQNLSTTEVTLDFDTTITSSGAGDFTVGSGGEITVLNNGTYYVEYSATGDQTSGNNRVIVFAHLEVNGTVVTGSQASVYSRNIADGAFSAVGSSVVNLNANDVIRVRASSDINSIIATIDNSISGLSIFSLSGSGPQGEQGIQGPQGIQGEPGIQGEQGIQGPQGIQGEPGIQGEQGIQGEQGIQGETGPAGPTGPAGPSDIPQNAKTTSYTLISSDNGKHISITTGGVTVPSGVFSSGNVISVYNNSSTAQTVTQGTGVTLRTGGTATTGNVTLSQRGLCTILCVSSNEFVVTGHIS

SEQ ID NO: 25720 - protein, 236 aa, Synechococcus phage S-CRM01
MALNFPANPTPNQIYFDVSNGYRYQWVVDPQSLTGQGKWTVRTSGFNNNPAGAQGPQGFQGDPGGPQGPQGFQGPPGTGAQGPQGVPGAQGPQGDAGGPQGDPGEQGPQGEPGATTSPLIPLGITCSDETTPITTGTDKFTFTVPLNGTIDSIIASSIVAPDGSDIIIDVNKNGSSILTTEIHIDDGDVSSIGSATPYVISDDALVAGDVISVDFDQVGSTTEGTGVKLWFIIQYS

SEQ ID NO: 25721 - protein, 578 aa, Synechococcus phage S-CRM01
MSLFKKTKVIGSLGISPTITNKTIFSDVEPTERENGGDLRSGDRWVNTLDSTESVWSEDILPDGAWILISSNSTETGPQGFQGDQGPQGVAGSNGTQGPQGFQGADGINGTQGPQGFQGANGIDGTQGPQGNAGSNGTQGPQGFQGVGGNNGSQGPQGFQGNQGLRGFQGFQGDIGAQGSRGFQGDQGPQGFTGLQGSQGAQGSQGLRGFQGFQGNQGDSGTQGPRGFQGFQGDTGPQGVTGVGTQGPRGFQGFQGDTGPQGTQGVAGNTGTQGPQGFQGNQGVAGSNGTQGPQGFQGNQGVAGSNGTQGPQGFQGNQGVAGSNGTQGPQGFQGNAGSNGTPGPQGFQGVAGSNGTQGPQGFQGNAGSNGTQGPQGFQGNAGSQGPQGFQGNAGSNGTQGPQGFQGVAGSNGTQGPQGFQGNAGSNGTQGPQGFQGNQGATGSGTQGPQGAPGVGTPGPQGFQGPQGPQGGGGGSGYVYTYSDTEPTSPNPGDEWTDSSDPKLPTYRYIDDGNTAQWVELVVSGQAGPQGDQGDPGIFTGTPSFIQSTQPTLLELNGNDKYIWWDTSNGLTLWIEDGT

SEQ ID NO: 25722 - protein, 376 aa, Synechococcus phage S-CRM01
MFDFPLSPVLNQVYTEGDRSWTWNGKSWVAIVSIGDQGEPGVQGPQGFQGNQGSQGIAGSNGTQGPQGFQGVAGSNGTQGPQGFQGNQGSQGIAGSNGTQGPQGFQGVAGSNGTQGPQGFQGSQGIAGSNGTQGPQGFQGVAGSNGTQGPQGFQGNQGTQGIAGTQGPQGFQGFQGSSGASGYTYSPTAPSSPNVGDEWTNSDDPRLPTYRYINDGNTTQWVELNASGESGPQGTQGVQGVQGTQGAQGPQGVPGSVMRLCIAASDESTALTTGNNRVRFRMPRAMTVTEVRATVNTAPTGSTLIVDINEGDTPVSILSTKISIDATEFSSVTAAVPPVISDTSLANDALISIDIDQIGATVPGAGLKVWIIGVEA

SEQ ID NO: 25723 - protein, 353 aa, Synechococcus phage S-PM2
MTSSTLSQPIKQRGWFDVLDDWIKRDRFVFVGWSGLLLFPTAYLALGGWLTGTTFVTSWYTHGLASSYLEGANFLTAAVSTPADAMGHSLLLLWGPESQGDIVRWFQLGGLWTFVALHGAFSLIGFMLRQFEISRLVGIRPYNAIAFSGPIAVFVSVFLMYPLGQSSWFFAPSFGVAAIFRFLLFLQGFHNWTLNPFHMMGVAGILGGALLCAIHGATVENTLYEDGEQSNTFKAFEPTQEEETYSMVTANRYWSQIFGIAFSNKRWLHFFMLFVPVMGLWTSSIGIIGLALNLRAYDFVSQEIRAAEDPEFETFYTKNILLNEGLRAWMAPVDQPHENFVFPEEVLPRGNAL

SEQ ID NO: 25724 - protein, 351 aa, Synechococcus phage S-RSM2
MVASNLTLQQRGWFDVLDDWLKRDRFVFVGWSGLLLFPTAYLAIGGWLTGTTFVTSWYTHGLASSYLEGANFLTAAVSTPADAMGHSLLLLWGPEAQGDFIRWCQLGGLWAFVALHGAFALIGFMLRQFELARLIGIRPYNAIAFSGPIAVFVSVFLIYPLGQSSWFFAPSFGVAAIFRFLLFLQGFHNWTLNPFHMMGVAGILGGALLSAIHGVTVENTLYQDGEQANTFKAFDSTQEEETYSMVTANRFWSQIFGIAFSNKRWLHFFMLFVPVMGLWTSSIGIIGLALNLRAYDFVSQEIRASEDPEFETFYTKNILLNEGLRAWLAPVDQPHENFVFPEEVLPRGNAL

SEQ ID NO: 25725 - protein, 1477 aa, Synechococcus phage S-SSM7
MAEFRLGRVKFNWTGDWTTSKAYLIDDIAKFGGNTYVAIENHTSTASVSDFYANDLSKWNIHIEGLEQKGQWATGVYYRINDLVKFGNVVYRVTTAHTSEGTFIDKTKVTEYVKGFQNEGEWDGNVEYQSGDVVNYNGSSYVALTTSLAGFQPPQYLGVSTDPNAKWTILSDGLAGAASTYIEGTYYRGDLIQYGGNIYRHKLGITTNVSPLQVGLGSIQPQSFTGTEVWDLLVKGFDFKGGFSTTFNYHPGHVARYGSDSYISIGSSHKNVIPTAGIGTFWEVLASGDSSAALNTKGDLLSYNSGNVRIGIGSTGYALAVQSNGMPGYEIVGNQTRIYYVDSEDGLDVNNGLAPNLAFKTIKKACEAARPKTNITNMVYTASTGVATVTAPGHGLLNTGTFVQLQDIQFECLSGGNVFNVLGMTYNKAVGLATITAIGLGAAPEVGIGATVRIRNLSVQYQGSAQFAHTFQTATEDAIQSGGDYVHTFNSCAPNGVTVVGGSSITPTSATYDPSNGNFTMTITGHSLSTSDSVTIADNAFTFTCTMNNNASQKTYPRPGKDPAQGQQLAITGTTTDTITVNVGPSPIVNHQPTAVSYNQATGDMVCTIGPHTLTVGTSVKLATDGMVFRCSMDGYTTDHSYPRQVAGDGNPDPAYNTALNITAVTTNTITINVGTASDDQTITGKFPAVHTQGTYEFLVQAVPDSNSITLNVGVSTTDYLYVSGGTAFVGLTTTKYPDKVAKSYYEVLEVTDVDNFKCNVGISTIDHTYVEGGLVTDLTPAILKLSASQFYEQLPVTVPPFTSIVGNALRGSQVLPKAGTSDDSSTPNNRSHMFKMSDATTIQAISMKGMEGFYYDPNAPLELDNSNLRTGIGTTAAGVFISLNPDSPIDNKSPYVKDCTCFSDPATESGRFGGGGVGVFIDGGVHDTGAKSMVFDAFTHVASDGAGYILDKGAIAEIVSCFTYYAKWGYYSGGGSRIRGVGGNNSYGDYGVISSGFSTDEVPRTAKVFGDMMTVQGTTKGGTVSIGATMFGQTSKATAWMLNDQISADKIYFKYQSGYGNAGIGTTGFVDGEIVWFGNGAENSSGVGSITVGAAASSTTGQKGTILEVDQTSGTLLIGDAIGFQTTAYGADDRFYIINTITNVAAAATYYEWQAGNGASQQVVFNNRATLTISPEKSRGTWDTRNSGSTSDIEIRTLFSQARLTGHDFLAVGTGNKTQTGYPNVNLANVIQGQETNVFGPGKVFFVSTDQGGNFRVGDFFSVDQLTGRATLDASAFNLSGLTELRLGAIGGQVGEAINEFSSDETLAGNSNTACPTEFAVKGFLTRGSMGIKAMTPPVGTTAQRPGGVDDEFNTGALRFNTTLGALEYYNGTTWIQPGVKTYSTVSSSFSATSGVTYFVNTGGGQVTATLPASPDLGAEITFMDVAKTFDSNNLVVSRNGRPIQGDNANLTVSTEGAAFTLVYSGSTYGWRIFSI

SEQ ID NO: 25726 - protein, 351 aa, Synechococcus phage S-WHM1
MVASTLSPPTRGWFDVLDDWLKRDRFVFVGWSGLLLFPTAYLAIGGWLTGTTFVTSWYTHGLASSYLEGANFLTAAVSTPADSMGHSLLLLWGPESQGDFVRWLQLGGLWAFVALHGAFALIGFMLRQFELARLIGIRPYNAIAFSGPIAVFVSVFLLYPLGQSSWFFAPSFGVAAIFRFLLFLQGFHNWTLNPFHMMGVAGILGGALLSAIHGVTVENTLYEDGEQANTFKAFDSTQEEETYSMVTANRFWSQIFGIAFSNKRWLHFFMLFVPVMGLWTSSIGIIGLALNLRAYDFVSQEIRAAEDPEFETFYTKNILLNEGLRAWLAPIDQPHENFVFPEEVLPRGNAL

SEQ ID NO: 25727 - protein, 351 aa, Synechococcus phage syn9
MTTSTLQAPTRGWFDVLDDWLKRDRFVFVGWSGLLLFPTAYLAIGGWLTGTTFVTSWYTHGLASSYLEGANFLTAAVSTPADAMGHSLLLLWGPESQGDFIRWCQLGGLWAFVALHGAFALIGFMLRQFEISRLVGIRPYNAIAFSGPIAVFVSVFLIYPLGQSSWFFAPSFGVAAIFRFLLFLQGFHNWTLNPFHMMGVAGILGGALLSAIHGVTVENTLYEDGEQANTFKAFDTTQEEETYSMVTANRFWSQIFGIAFSNKRWLHFFMLFVPVMGLWTSSIGIIGLALNLRAYDFVSQEVRAAEDPEFETFYTKNILLNEGLRAWMAPVDQPHENFVFPEEVLPRGNAL

SEQ ID NO: 25728 - protein, 725 aa, Synechococcus sp.
  strain ATCC 27144 / PCC 6301 / SAUG 1402/1
MTPTTNGISLSLSTTGTQAPQAFSTNLDKVWVTDLIGARLNLPEGKSFTQPNPVPGIESIAVSQVSENGVRIVVTGSDRPPIVTNSSRNGGSLQFELSTQTAIAAAPSPSAPLVGAAPRPNLRPPAAPAPQRTAQATPPTPIPVSPAPQPPVQPLDPRQVLQPTPSPAPGQLPPLQPRAVAPPLGDIAISNTVPQGTAVTFPNARPVPRIALRNASAREVLSIIATSAGLNLVYLDSNGQPTAAAPVVSNEPKVSVDLQNIDAQSAFNYVLQIAGLQASRRDNVILVGRNLPPSAGGLVSRTFRLNQAVAQNVAGYLTTLGANSVVSFTKKVCVSTGVQDTTATGGGAGTGAGQGQIQTLSQTSAQCFDEPEVKELKVPGTPAGPLPLKNISITADIRTNSLSIVGDPQAINFATGLIQQLDLRKRQASVNVKVIDLDLNDLNAIATSFSFGIGNTLFSGSGGLRTTVIDNAGSVIQPPNDSVFNPSNLPAGINPANPLLALPNQLTNNFLGALSASIINNKTKLLTDPTLIIQEGERSEVKLTSQVVQKIESETTTNGSGPPTVSRTIDLADVGLQLTINIERIDDNGFITLTVLPAISSPQDVVTFGDPNTNGVLTTLIKKREVSSGKIRLRDSQTLILSGIIQDEERERVAKIPLLGDLPLIGSLFRTSYTDRQRREVVVVITPKILADTDATVFGYGYQPSPPAQSVLNNTLQTPTVAPLP

SEQ ID NO: 25729 - protein, 430 aa, Synechococcus sp.; identical to SEQ ID NO: 25716
  strain ATCC 27144 / PCC 6301 / SAUG 1402/1

SEQ ID NO: 25730 - protein, 320 aa, Synechococcus sp.
  strain ATCC 27264 / PCC 7002 / PR-6
MFIRNATAIALLGLFWFQGAASNSNPVPQGPTPILLAQATIFEVGDKVDIERQGSWRPGEILAIQSAPEAAVRYQVRYLDVGFVEDNVSPERLRPTVATQPVAGRLPQINSVSEPIYVERDGVWVEASIRSYSYSSRTGNRFTVQYRDNGRLETDVVAQRVRSVAEAKAAGIEVSEFDLSTQAGIEQMLAAHNEWRSPHNLPDLVWSETLANHAQTWAERLAAQERVEHNTSDDYGENIAKSSNLVLSPTAVVNLWGNEIQDYDYGTNRCQPGKVCGHYTQIVWRDTEKVGCGMVRKDNGWEVWVCNYDPPGNYRGQRPY

SEQ ID NO: 25731 - protein, 430 aa, Synechococcus sp.
  strain ATCC 27264 / PCC 7002 / PR-6
MLDKSEAIIEAIDAREILDSRGRPTVEAEVRLESGAVGLAQVPSGASTGSFEAHELRDGDKARYGGNGVLKAVRNAKEKIAPELIGKDALDQTTVDYAMIARDGSDNKSNLGANAILAVSLAAAKAAAAELALPLYRYLGGPLANVLPVPLMNVINGGAHAANNVDFQEFMIVPVGASSFKEALRWGAEVFTALSKVLDSKGLLTGVGDEGGFAPNLGSNEEALEILVDSIKAAGYEPGTQVALALDIAASEFYADGQYTYDGTAHSPAEFIDYLTAMVEKYPIVSIEDGLHEDDWDSWTILTARIGHRVQLVGDDLFVTNKVRLQQGIEKKAGNAVLIKLNQIGTLTETLETIDLATRNGYQSVISHRSGETEDTTIADLAVATRAGQIKTGSLCRSERVAKYNRLLRIEDELGDRAVYAPKVGLGPQF

SEQ ID NO: 25732 - protein, 656 aa, Synechococcus sp.
  strain ATCC 27264 / PCC 7002 / PR-6
MTSFFTTQTICFTIVCFLCSSTAVFAQEENDLDDEQETVDFELTVIDQLLNQPVYAPSRQEETVQDATRAAYVINREQIEAQGYRTVNEALKYFPGIFIDSTAGSRLGAQSSQIFRGANSSSQTLILLDGRPLNRFDSGNFDLSNLTTDNVERIELIPGGSSVLFGSNAIGGVINIVTRQPGFNQPVAVEIGVDLGSFGYNRQNVGVSFGAETQAVRLAYDRTAAENDFDYDIAARGLSGVRDNAATNIQNVNLQVVNQLGDRHRLRFNGIYSSKDLEIPSSVSSPSPNATQYDNNWLLSLDLESRLGNSDDSLLTTRLFADLNDFRFFDENQFGTTDARYENNSFGAQIQHNWQLNETQNLTYGFDYRYLTAKAEDPGVFGFSYDENLSQGAIFARYGLDITPELTLNLGVRQDFNSLADGSVTSPSAGFAWQVGDSTRIRGNYARNFRVPTAVDLYFPGFSNPDLVPELGNSFDLGVDHRFSDRALVRLTYFNNTLDDAIVFDLGTFTPQNVRKARNQGLEAEVTLQLSRSLSAFANYTWNNSEILADADPTVVGNEVAFAGTDYFNVGLAYENPQGIYAGIFLKRVGDRLTNNANTESLAGYTNLDLRARYPISDTVNLTASVENLFDADFETFPAYPGVGRRFQIGVNAQFR

SEQ ID NO: 25733 - protein, 861 aa, Synechococcus sp.
  strain ATCC 27264 / PCC 7002 / PR-6
MSPDKAIAQTNPETNQLAQAQPATITGIRLDTRPNRVNIILETAAGQPLTLPGQPFIQRGTDLVATIEPAILTLPDGQTWQFTAPTADIAAITVEQQGGDRLEIIVQGQGELPTTAVSLETMATIATKDDMADLTEMPLDLDAMPVEELEITVLGTRSPRLVSRTPGSISVIDAEEIDDNLVQDLRDLVRYEPNVSVGNDRRYGLQDVNIRGLGGNRVLILNDGIRIPTQFTFGTPALGRDYVDLDSLQRVEIIRGPASALYGSDALGGVVSFQTIDPSDLLALTDKNNFTRISTGFETTDKSLNYGAVTAFRADSLEALIGYTGRSGFEARLPEGNEFVDDRYGDRDNFLGKLNFKLSENSTLGFTTEIFRSTNEFQVAPITAALLQGPRGFQGQNETLEADSYRERYSLAYLYDNPDGEGFIDNAKLQVYYQNAGVDELRTQDFLNFAGTERRFRNLSNTFTDELFGGEVQLQSNFRWGKIDNRLTYGFDLSKTNNERTRDGLETRFDSTGNVTSTTNQVGSDNFPVKDFPDSETTRFGVYLQNEMALSDTFTLLPGLRYDTYRLDTTIDELYQRNSPDAEAADFSDSALSPNLGFVWQTSPEIALVGRYARGFRSPLYSEINAGFTNLTSPFFRYKTLSNPNLKPETSDTFELGIRGDFPRGNFSVTGFYSYYENFIETFANAGTTLINGNLVNLFQSQNVGAARTYGVELAGEYRFSEQPHGFSLIGSLGLTVGDDLEDDEPLESVEPLKAVLGLRYRAKEDRWGTDLIATLVGEPRLRGDRPAGSYSPEGYAVVDLLGYYNINPNLKLNAGIFNLFNNQYFLYSDVRPLLNSPEPVDIARYAQPGISLRAGLTWQF

SEQ ID NO: 25734 - protein, 831 aa, Synechococcus sp.
  strain ATCC 27264 / PCC 7002 / PR-6
MNNHLCHWSALTILGVTGIAILNAAPVIAETQDFEVLPPTIEISSENADVLTDVQVQATESGLVITFETTAEALPAVTTTTVGDRLIIEIPDVILSLPGENIVEVLQPTAEIESVQISPGENGGGQLIITGLTAPPMVAPRLEGKQLILEVTPDESIAENLELVVTADRTANSYTVSEATTATRTDTPLAEIPQSIQVIPKAILADQGVSSLDDALRNASGVLQNSADARGQRFVVRGFDSASVLWDGFRPTFGFSGNIGYPELANIEQVEVLKGPAAILYGVSEPGGVINLVSEKPLSEPVYEATLELGNRNQVAVGVDLSGPLNEDGNLLYRLNALYRNSDYYRNFNVDLERTFIAPTLTWQIGDRTDLDLFVEYSADQRPYDTGLVAIGDSVADIPFDRNLSQLDDINEATYWRTGYEFEHRFSDNWKVRNGFNYIAYNTIFESSFTLGFDPTTGDLDRSYIQLDQPSSTYAVQTNVVGEFSTGAVDHTVLMGVDYIHRNQLGNKLRGFGPDSYFTQNIFNPVYGVVPQPDFETQPIIRFGDTYINAVGIYLQDQMDIGDRLHILAGLRYDTVSQRVVNPTSLTETTQNDDAFVPRLGVVYRPIEPISLYTSYSQSFAPNSGTNVDGDTLPPEVGEQFEVGVRAEALEGALVANLAYFDIRKNNVATSDPDNIGFSINAGQQRSQGIELDVMGEILPGWKIVANYAYTDARVTANNDGQAGNRLINSPYHSANLWTTYELQTGSLKGLSFGVGVNYVGDRFGDLNNSFSLGDYFLTNAAIAYRQDNWRAALNFRNLFDVEHITGTRNNRFEVYPGEGFTVLGTLAVEF

SEQ ID NO: 25735 - protein, 825 aa, Synechococcus sp.
  strain ATCC 27264 / PCC 7002 / PR-6
MHYWYRLLGFTGGVALFWAAQELSAVAASPQPSDATAVSAPMTLTQATTIITDVAIATEGDQVELQFTATAPLENATVIQRAATTEITIPNANVTQAEVLQEFAPESGLEQIEIRNQADNSVQILIRNGDRQIQTQLITTATGLTLNIEPVLVSTDEDNIEAFELVVTDAEQPYNPRSATTATGLETDLRDIPQSVEVIPQAVLQDRNVTELGEALETSGSIVSSGGRGTSVFGPGFLIRGFAAEESVFLDGIETFSLAALDTNDIERVEVLKGPASVLFGQGDPGGVINLVSKEPLAEPFFGIDAAIGSFANYRGNLDLSDALTENGAARYRLNFSYSNFGSFRDLVDGERVVVSPRLSFDLSEATSLDVYGQYAYTRETIDEGIPFTASGPVDVPRSRFVGEDFGEFSEKRFNLGYDLNHEVNENFSLKHQLQFLQYRPRRYAPLYTFFDETTGNVDRLEYFAGGSYQRFFTNIEAIAKFETGGIKHQVLGGVEYRNTLEQPEFQFSNDYTPINVFDPVYTGVPYAIAPEFFRDDTIKTVGVYIQDQIEFSPQFKALAGLRYDFVEQLRSTQDLGGPRNEFFQSDEALSPRLGVVYQPIEPISLYASYSKSFEPTFGTSRDPDGMNFEPERGRQWEVGVKADLSDRLSFTAAAFDIRKQNVIVRDGAFNGFQTGEQTSRGLEFNLNGALTPGWNVTAAYTLLDAFVSKEDINPDIEGNQLPNVPQNQFSLWTTYDIQQGALEGLGFGLGFFYVGDRPGNIDNEFTLPSYFRTDAAIYYRRDNWRAQLNFENLFDTEYFTAADEFQFATPGAPFAVTAKFAVDF

SEQ ID NO: 25736 - protein, 832 aa, Synechococcus sp.
  strain ATCC 27264 / PCC 7002 / PR-6
MKQQARDSFALAVGSMMPVLIATQPAQAQTSAITGIEIIETLTGAEVFLQTTTAQLLEISTTQSDNTLITEVTNAQLRLPEGQPLQSTSFSNTIESVEVLQATENSVQIQITGMDALPEISTDLTIDGLFLRAQGSESNWVTDDGTETLELVVTATRTPEDPEDISRSVTIITRDQIATQAALNQNLGDILGQLVPGFGPTSDRAFTAASLRGRTASILVDGVPLNVNNRDFDRELKTIAPNAIERIEVVRGPSALYGGEATGGIINIITRRAGEERLVTQVELGVDAALGNFEGESFGNFLRYGLSGQENNVDYLVDLSRTSSGAIFDAEGDRIPVIQGNDESETFNILGKVGIALGEQQRLQFSANHYNSKRTTDVISDPIVDAIPGVQKAQALEVGELQFPAGGGPQTDRNTVFNVSYNHADLWGSNVSAQVYYRDNLSRTDPRDRRPRPFGIFQGELNSENWGGRLGVQTPLTPKLSLLWGADYDQETTSNTFNLFDPNAFDASNGQVNVLTEQRALVPPFDLNSLGLFTQVQWEATERLQLVGGIRYEKIDLAVGDYTTFFGDFIEGGRKDFDTVLFNAGLVYDASDHINLFANFAQGFSVPDFGLVLGFPDPGFSVASDVTVNQPQKVDEFELGIRGNWRNIQASIAGFYNQSDLGSTFEFNPSTGFFDILRAPERVYGIEATVDAQLNDTWNLGGTISWSEGEADLEDNGTYLPLSSARIQPLKLTAYVENETLPGWTNRLQALYVGSRDRAFQEDIDPREIDSYFLVDWLSSVKLGQGTLQIGVKNLFDTLYFPAYAQRSAGFSDTFNSAGSGRTLSLRYSLTF

SEQ ID NO: 25737 - protein, 414 aa, Synechococcus sp.
  strain ATCC 27264 / PCC 7002 / PR-6
MLRKRLQAGLCSLLLVLVLVFGPMERAIAFTDEQDLLLQAWRYVSQAYVDETFNHQNWWLIRQKFLKRPLKTRDEAYEAVGEMLALLDDPYTRLLRPEQYRSLKVSTSGELSGVGLQINVNPEVDVLEVILPLPGSPAEAAGIEAKDQILAIDGIDTRNIGLEEAAARMRGKKGSTVSLTVKSPKTDTVRTVKVTRDTIALNPVYDKLDEKNGEKVGYIRLNQFSANAKTEIIKSLNQLQKQGADRYVLDLRNNPGGLLQAGIEIARLWLDQETIVYTVNRQGIFESYSAVGQPLTDAPLVVLVNQATASASEILAGALQDNGRAMLVGEKTFGKGLIQSLFELPDGAGMAVTVAKYETPLHHDINKLGIMPDEVVPQEPIGYAMMGSETDLQYQAALDLLTQDQAIAQISQAS

SEQ ID NO: 25738 - protein, 430 aa, Synechococcus sp.
  strain CC9311
MLDSLDLVIDTIVAREVLDSRGNPTVEAEVLLEGGASGRAIVPSGASTGAHEAHELRDGGDRYMGKGVTKAVDHIEERIAPALCGLSALDQGSVDAAMLELDGSDNKSGLGANAILAVSMATARAAANGLGLPLYRYLGGPMATLLPVPLMNVINGGAHAANNLDFQEFMLVPHGAPNFREALRMGTEVFHTLKNLLSERGMSTSVGDEGGFAPDLGNEEAGEVLVQAIEKAGYKPGEQISLALDVASTEFYSDGRYAFSGGSYSSAEMVDQLEQLVNRFPIISIEDGLAEDDWEGWALLTERLGKRVQLVGDDLFVTNTKRLQRGIDANTANSILIKVNQIGSLTETLQAIDLAGRSGYTSVISHRSGETEDTTIADLAVATRAGQIKTGSLSRSERVAKYNQLLRIEDELGDQAVYAGATGQGPRGRD

SEQ ID NO: 25739 - protein, 430 aa, Synechococcus sp.
  strain CC9605
MIDSLDLVIDTIVAREVLDSRGNPTVEAEVLLEGGAMGRAIVPSGASTGAHEAHELRDGGDRYMGKGVGQAVNHIEERIATALCGLSALDQAAVDAAMLELDGSDNKSNLGANAILAVSMATARAAANGLGIPLYRYLGGPMANLLPVPLMNVINGGAHAANSLDFQEFMLVPHGAPSFREALRMGTEVFHTLKKLLSDKGMSTAVGDEGGFAPDLGNVEAGEILVEAISKAGYKPGEQISLALDVASTEFFENGRYAFDGGSYTSAEMVGQLEQLVEKFPIVSIEDGLAEDDWDGWKLLTERLGGKVQLVGDDLFVTNTKRLQQGIDSATANSILIKVNQIGSLTETLQAIDLAGRSGYTSVISHRSGETEDTTIADLSVATRAGQIKTGSLSRSERVAKYNQLLRIEDELGSQAVYAGAVGQGPRGKA

SEQ ID NO: 25740 - protein, 180 aa, Synechococcus sp.
  strain CC9605
MTADDVLEFWFQQCRPWQWFRRRDSFDALVRERFGEAVERALAGDLNHWSCSPSSGLALVLLLDQFPRQIWRGEAKAFAGDPQALQLSLEALERGWIAAESQRPRRQFWLMPQLHSEDVSVVRAVIPLLERHVDEATASVACRHLAELERFGRYPRRNLALVRISSLEETAFLNAVPGSR

SEQ ID NO: 25741 - protein, 430 aa, Synechococcus sp.
  strain CC9902
MIDSLDLVIDTIVAREVLDSRGNPTVEAEVLLEGGAMGRAIVPSGASTGAHEAHELRDGGKRYMGKGVSQAVTHIEERIAPALCGLSALDQAAVDAAMLELDGSDNKSNLGANSILAVSMATARAAANGLGLPLYRYLGGPLANLLPVPLMNVINGGAHAANSLDFQEFMLVPHGAPSFREALRMGTEVFHTLKDLLNAKGMSTSVGDEGGFAPNLGNVEAGEILVEAIQKAGYKPGEQISLALDVASTEFFENGRYAFDGGSYTSAEMVGQLEQLVNQFPIVSIEDGLAEDDWEGWKLLTERLGSKVQLVGDDLFVTNTKRLQQGIDNNTANSILIKVNQIGSLTETLQAIDLAGRSGYTSVISHRSGETEDTTIADLSVATRAGQIKTGSLSRSERVAKYNQLLRIEDELGSQAVYAGAVGQGPRGKA

SEQ ID NO: 25742 - protein, 513 aa, Synechococcus sp.
  strain CC9902
MAKNKRNKSKRSRNGRAKNKRGKNRKGRNTQVNNEIANSEGTSADASNNKQLWNESKQNIVDVKWSNKIHENALLNTGIPLEENGWVRPGIPAKWISDSSFKKQKNTTLLTYSFMTTKSKLDYGDDRRETIVPYANFSEKQQNDIAKLFESLSDYANIRFIKVPDNNTVGTIRIGFNTITDEAGKWRPGIYATADTPNPEPRGGDIWFNKNFTKDNFSTGLVENVGPATPSAVMLHEILHALGLEHPDNPKRVTPKFARNREYTLMADEFSHRAEFTQYFKDNGEIASSLAEFGRSEIRKDYGVSSTPMTWDIAGLQYLYGANTKFQQGNTIYKYSNTIPFYETIWDASGIDTINLSNFKKDLVVNLNGGQLSTLSFDVADQNWSDKQHGNLGIAFNTVIENGIGGSGNDSIIGNSANNTLKGNAGNDTLSGKDGIDVLIGGSGQDIFKLQQGKGHAIIQDFNSGIDKILLQQSSGVKLISVNAGIEINQNNDLIAIVQNYEGRLNQSGVNII

SEQ ID NO: 25743 - protein, 809 aa, Synechococcus sp.
  strain JA-2-3B'a2-13
MRMNGRWWRVVSLGLSLGVGWGSLSQAQPNARIPDSTTPPLLAQATPAPTTLPEQIRELKAQIEAARQRGDQAEVERLQAELRALQQEGTPIFNLQQVTVTGTRTERTLADSPASITVIDRERLRRELVQNIQDLVRYEPGVSVRRSVRYGLQDFNIRGLDANRVLIQVDGIRQPERFSFGPFTIGRDTFELEALKTVEIIRGPASTLYGSDALGGVVTYTTLDPADLLGERDSHVGLSSQYDSKNQGYVNTLSLAGRQDNLEALLIYTRRDAREPDIQADPSFKDRQTVEGDNVLAKLVYRFSPFDSLTLTAEYFHNRTTTTFSPRNLDPGIRFFRETIETERSRLSLEYRYANPDTPAFELATVQIYYQPARTQEPSVEERTLTVQGRPVPVRRDTFNELVSNILGASVQAQSRFQTGDLSHRLVYGMEISTTRNERPRNRFQTNLLTGAVTQNIPPDTFPTKDFPDSDTVRFGLYLQDEIDFGGGNFTLIPGIRYDTYRLTPSPDEAFLKSGAEAASLFADAISPKVGLVWRINPNLTFTAQYNTGFRAPQYNEINSGFTNLVSPFFRYRTLSNPNLRPETSQGFEVGLRGIYPQASFSLAAYYNTYNDFIEAFREVGSEPSPPGPPGSPPPPPVTLFQSQNVSRARIYGVEATGQYFFSPDLTGWSLNGSFAWAVGDNLTENKPLLSIEPLTAVLGLHYDDPSQIWGARLVATLVADPRDPQREVVQPNPNAPPQIPFVPKGYTVVDLLGYYNLDDNWQLNFGVFNLFDEKYFLYSETRSLFVGPEVERRAQPGRHAALSFSTRF

SEQ ID NO: 25744 - protein, 427 aa, Synechococcus sp.
  strain JA-2-3B'a2-13
METAIEWITAHEILDSRGRPTLEALVGLANGATGLAQVPSGASTGTFEAHELRDGDPKRYGGKGVLRAVENILGPIQSELQGEDALNQARIDQLLIDLDGTPNKSRLGANAILAVSLATAKAAAEAVGLPLYKYLGGPFANLLPVPLMNVLNGGAHADNNVDIQEFMLVPIGAASFREALRYGAEVFAVLKQVLQQKGLSTGVGDEGGFAPDLDSNAAALDLLMTAIEQAGYKPGADIALALDVAANELLQDGQYHFEGKAHSAADMVAYYQQLLANYPILSIEDGLAEEDWAGWQAMTAQLGSRVQLVGDDLFVTNLTRLQKGIDSAAANAILIKPNQIGTLTETVSAIQLAVQAGFRTIISHRSGETEDTTIADLAVATRAGQIKTGSLCRSERIAKYNQLLRIEDELGEAAVYAGRVGLGPRAR

SEQ ID NO: 25745 - protein, 392 aa, Synechococcus sp.
  strain JA-2-3B'a2-13
MTSLSRGAHRLKGWIALGLLTLLLLGGLGGVAPSQAQNVNQLQQRQQQIQHQIQSTQRRLGELRQAEEEARRRMGSLRQNLRQTESSLRDNQYRLEQAQKALEQAQKELQELEDRLRRQQQGTAARLRYMQRQGAEHWWALLLTSRDLNEFFDRRHQLQLLIEADRQLIQELQAMAKEVDQQRIALEMQRNEISLILQELAAQKNQLQQQAVAQEQLLSRLANERAAYEAAQRRLEADSQQLTLLIQQLIAQQAQQQGGRDPVQGTGRFIAPVRGPITSGFGWRVHPIYRSRRFHAGIDFGVPTGTAVRASDRGTVIYAGWYGGYGYTVIVNHGGGITTLYAHNSRVAVGVGQQVQRGQAIAASGSTGLSTGPHVHFEVRVNGQPVDPRRYL

SEQ ID NO: 25746 - protein, 656 aa, Synechococcus sp.
  strain JA-2-3B'a2-13
MNPILGLSLALGGLALGIPAWAQPAASSPSAQEVLETGVSAEILNQPVTTPFRRPGLLRDSSRPVYVITRQQIREQGARTVQEALRYLPGILSDGTAGTQLGALSSQFMRGGRTAQVLVLLDGRPINDLGFFGGFDLSQITTDVVERIEISPGGGSTLYGSDAVGGVMNIVTLEPKPGSETVLEAAIGSYGLNEQGIQNRGQAQDLGWVVSYRRLQSNNDFPFEIRRLGKAGRRENSAVEYHNLQAKLTWQLAEGQVLTGNALYLNKAFQVPGSTEFPSPDAVQNTNDLLLDLSWLWDQERGSLQARVFFDDLNYRFSAPQSQGSRDEILRTGWGSQLQYTWKAAENLELTLGADYRSISARNTTFSFARGSTNVNYDNTVNQGAFFARLDYRPQPNFYLNLGVRQDSSNLVNGSATSPAAGIRWVLAEGTTLRANYAGSFRTPLISNLFFRLRGFFEVDGNPNLRPERGESFDIGLDQALGDFGLLRLTFAHNRIRDGITFVSTGPRRGTYENIELVEYTGLEAALDLRLGENWTLFANYTLNDPIIRSALDPKAVGKQLAFVGADSFNLGLSYRDAEDRYASVFLHHIGTFFTNNANTQSLPGYTNLALRGGIPVAENLALEVGVDNLLDEQYEVFPGYPGVGRTVRLNLRGQF

SEQ ID NO: 25747 - protein, 696 aa, Synechococcus sp.
  strain JA-2-3B'a2-13
MMNRRVAYGCALGLILSLPPLALESRVNEAAAQQLTSANPQRLSRITDIRLVPNGNRMQLEINTEGGARPQVFFTQQGQSWIGDITNAQLSGSQGRYRQESPLPGVRFIEAWQLSNDSVRIEIAGVAAAPQGLLARRSPTQLVFDFEGLPSAPPAPLAAVPPQPSSNPVAPGQPASLNRPQPVAPAPQPAAPAPASQPVAQNPAPPQTTQAAPPAPAVPAAPVISQVPPVGQLNQPQLPPGSLPTESPFQGRAVAPPAGDIAVGTILPDPPTVDLGSNARISLTLKDAPVGDVLSLLVRRAGLNVVLNDVPPDLTISLDVQDSPLQETFNFILRLKQLQAQRRGQTVFVGQNLPGVTGILVRNYRVNQAVATDLASRLEEVLNAVAPGAQFVVDERTNSITVIGNSRQQDIAAAQIAQLDVRRRQVLISLRAVDIRLDKNESLSVNLGGASGNFALGTLGDANFGGRPLNQPAGSSVSSIGPAGPSGSITGIFNTLNRLQQSLALRVQSAIQNGTGKILTDPKVVVADGGSSRISIATSVPVNVETITIPQGENQPPVVTQRLQREDAGVILDVSEVRIDDNGFVTLTIQPEISIPVPSQILGGGDFAGILLFNIDRRQLQASQLRLRDGQTFIIAGLIQDRDIVDVQKVPFLGDLPLLGALFRSQSVNNERNEVVFMLTPYIMDDNVAFGLPPNP

SEQ ID NO: 25748 - protein, 86 aa, Synechococcus sp.
  strain JA-2-3B'a2-13
MLGILSPASPMLSTGGSRRAAFAQSFALGIPIKEAIRIARSAVPNAVIKEVELEREDRRLVWEVKFTNDIEVKIDATTGNIVDIDD

SEQ ID NO: 25749 - protein, 432 aa, Synechococcus sp.
  strain JA-3-3Ab
METAIEWITAHEILDSRGQPTLEALVGLANGATGLAQVPSGASTGTFEAHELRDGDPKRYGGKGVLRAVENILGPIQSELRGEDALNQARIDQLLIDLDGTPNKSQLGANAILAVSLATAKAAASAVGLPLYRYLGGPFANLLPAPLMNVLNGGAHADNNLDIQEFMIVPIGAPSFREALRYGAEVFAALKQVLRQRGLSTGVGDEGGFAPNLDSNAAALDLLMTAIEQAGYRPGEDIALALDVAANELLQDGQYHFEGKARSAEQMVNYYEQLLANYPILSLEDGLAEEDWAGWQAMTARLGSRVQLVGDDLFVTNPARLQKGIDSGAANAILIKLNQIGTLTETVSTIQLAVQAGFRTLISHRSGETEDTTIADLAVATRAGQIKTGSLCRSERIAKYNQLLRIEDELGEAAVYAGRVGLGPRGLPARSR

SEQ ID NO: 25750 - protein, 149 aa, Synechococcus sp.
  strain JA-3-3Ab
MKRISAVNGLPIREFFDEPTDPNDNPGIPWPGGAATFLQGAINQPVRPGARLQFAIYFLLDSPGSRLTVCDPLAPGLGYVPGSLSVTPAGGSPVALSDAVDGDAGAFIPPGQAVPPACGGITNPNGLVVVNVGQAGSAGAIRFEAVVPR

SEQ ID NO: 25751 - protein, 806 aa, Synechococcus sp.
  strain JA-3-3Ab
MRVTGWGWKAVSLGLGLGLSWGSLAQAQPAARIPETPLLAQATPRGATTIQEQIRELEAQIEAARRRGDQAEVERLQADLQVLRQGTPVFNLQQVTVTGTRTERTLADSPATITVIDRERLRQELIQNIQDLVRYEPGVSVRRNVRYGLQDFNIRGLDANRVLIQVDGIRQPERFSFGPFNIGRDTFELETLKTVEIIRGPASTLYGSDALGGVVTYTTLDPADLLGERDSHVGLSSQYDSKNQGFVNTLSLAGRQGNLEALLIYTRRDAREPDIKADPSFKDRQTVDGDNVLAKLVYRFSPLESLTLTGEYFNSRTTTTFSRRNLDPGISLFRETIDTERSRLSLEYRYANPENPAFELATAQIYYQPARTREPSVEERTITVQGRPVPVRRDTFNELVSNILGASLQAQSRFQTGDLSHRLVYGMEISTTRNERPRNRFQTNLQTGAVTQNIPPDTFPTKDFPDSDTVRFGLYVQDEIDFGGGNLTLIPGIRYDTYNLTPSPDEAFLKSGSEAASLFADAVSPKLGLVWRINPNLTFTAQYNTGFRAPQYNEINSGFTNLVSPFFRYRTLSNPDLRPETSQGFEVGLRGIYLQASFSLAAYYNTYNDFIEAFRRVGSEPSPPGPPGSPPPPPVILFQSQNVSRARIYGVEATGQYFFSPDLTGWSLNGSFAWAVGDNLTENKPLLSIEPLTAVLGLHYDDPSQVWGARLVATLVADPRDPQREVVQTNPNAPPQIPFVPSGYTVVDLLGYYNLDDNWQLNFGVFNLFDEKYFLYSETRTLFVGPEVERRAQPGRHVALSFSSRF

SEQ ID NO: 25752 - protein, 647 aa, Synechococcus sp.
  strain JA-3-3Ab
MKVTVCLSLGLGILSLGIPAWGQAILDTGLSAEILNQPVTTPFRRPGLLRESSRPVYVITRQQMRQQGARTVQEALRYLPGILSDGTAGTQLGALSSQFMRGARTAQVLVLLDGRPLNDLGFFGGFDLSQITTDVVERIEVSPGGGSTLYGSDAVGGVINIVTVEPQPETETVLEAAVGSYGLNEQGIQSRGQAQDLGWVLSYRRLQSNNDFPFAIERLGKSGRRENSAVEYHNLQAKLTWQLAEDQVLTANALYLNKAFRVPGSVEFPSPDAEQNTNDLLLDLSWLWTQETGSLQARVFLDDLNYRFSAPQSQGSRDVILRNGWGSQLQYAWQAGENLEGVLGADYRSISARNTTFSFARGSANINYDDTVNQGALFARLDYSPDPQFHLDLGIRQDFSSLANGSATSPAVGIRWAVAEGTTLRASYAGSFRTPLISELFFRLRGFFEVDGNPNLRPERGESLDIGLDQTLGDFGLLRLTFAHNRIRDGITFVSLGPRRGTYENIGLVEYTGLEAALDLRLGENWTLFANYTLNDPIIRAALNPATVGKELAFVGADSFNLGLSYRHEQGWYGSILVHHIGSFFTNNANTESLPGYTTVALRGGIPLAEALSLELGIDNLLDEQYEVFPGYPGVGRTLRVNLRGQF

SEQ ID NO: 25753 - protein, 118 aa, Synechococcus sp.
  strain JA-3-3Ab
MWLLKQLEVKLSKPSVASLLLLGVLPLSSPMLGVGESTEAAFAQSPAPAVRIEEAIQIARSAVPNAVIKEVELEREDGRLVWEVKFTNDVEVQIDATSGDVVDIDDCTNWGKRCRKKR

SEQ ID NO: 25754 - protein, 723 aa, Synechococcus sp.
  strain JA-3-3Ab
MMNRRVAWGCALSLILSLPLLAVESQLDEAAAQQLTSANPQSLSRITDIRLVPHGNRMKLEINTAGGARPQVFFTQQGQSWIGDITNAQLDGGQGRYRQESPLPGVRFIEAKQMGNDSVRIEIAGVAAAPQGLLAQRSPTQLVFEFEGLPSAPPAPVAASPSQVAPNQPASPARPQPVAPPPAPASPPAAQNPPSPQGTAPNPQPLAQTPPSSPPAQAAPTPQPASPGPVISQVPSVGQLNQPQLPPGSVELSTSPFQGRAVAPPAGDLAVGSIIPAPPPVDLGSNAKITLTLRDAPVGDVLSLLVRRAGLNVVLNDVPPDLTISLDVADSPLQETFNFILRLKELQATRVGQTVFIGTTLPGVGQQIVKTYRLNQLRIEETEQTFVFNASGTAGGGGTVEIDARQLSITPSEIRSRILAILEASNIPLAQESAIQADPRTNSLTIVATPTQHDVIAAYLAQIDLRSRQVLISARFIEINLDNNSSLGVALGSASGNFALGSGDNTVFGGTPLDQPAGSSVPNVGSFPAAGTGGSLVFNTLNRLQQSLAARIDAAIASGTAKILADPKVVVANNTGAAIVVGQEVITNRRLQTDPATGISTVVFEKGNAGVNLLIQNVRIDDNGYITLNLLPQISSIGSQITLSDGTVISLLNQRSVGTLQTRLKDRETLFLGGLIQEEDRVSVDKVPLLSEIPLLGSLFRRQNTTNTRSEVVVLITPVILED

SEQ ID NO: 25755 - protein, 760 aa, Synechococcus sp.
  strain RCC307
MHRLFPVALAAAMAMPIVEVRAAARADLKIIRFPGSIQLRLVGMGMNPDVRQIKTARGWTIEVNTGQSLAPLGSPKFFTMPDAGMDSITFDGTGTLWRLEVNALQGNTLAPPVITANGRDVEVSFQAQPLPSMEAGSYDLNTPGRVRRNTYVPPLRKRATAPPVGDMAIASIAIKGNEVRMPGAGKVERLTLRNAPARDVLMTLGRAGGYNVAFYSKQGEEGSATSGGNPISVDFQDEPIESAVNLVLTLGGLQAKRQGNTLIVGEKLPSFARQLMSRTVRLNQVSAARATEFLMSQGATLYRTKVLEEKQEGVEAVDVIGSSGNQVNTGPKTELTGKSVSIQTVEADGSASGALPLTGLTISPDDRLNSVTLTAEPALVSIAEGYLKTIDLRKRQVAVRVQVLDVNLDNVKTMNNSFALRTGNTFLVNREGEMLVNFGDLKPPDTERAGVPSLYDGSTGSPLVGAGAFSMPGEDQVFLDQPVRQFPYQGAGSRYPYGFRRTSPPSPVQGSNLRGNLYSRPGFGPFSSPGQPGVVEVDKDGLVTFEPPKNFQYPKDQFFDFVKALIRSSSAKVVADPTLLVQESESSSVGVGTTVFVNCSSSTSANGTRNFTPKKETAGLQVDVSVSRIDDNGFVSLALNPVLKAPSGLPVPVNCGGIDLPTRDLAVRELRSGEFRVRDGQTLILTGVIQEEVLESVDKWPLLGDVPLIGQFFRKSSNTRQKRELVIVVTPRILDDNQGGNYGYGYQPSTQEAKKLIYQP

SEQ ID NO: 25756 - protein, 789 aa, Synechococcus sp.
  strain RCC307
MAYFVDSQYEHYGTARATGINRELTESERSENQLRINAGATSDNGGGTGTTNIAIASAVLNTTLDTRATDIDISASAWGYEAYSYGLSGSTLNATNNAGVDLDIQTHSTVRGYDPANGLDNSHISTGEGNDRIEILASASGSSQGANLQSNQQLFARGMTAGSSINSGGGDDNIIINASAAQQSYSANAVLSATGVERSMIDTGDGNDTLHILASASTYYGSELGVGLSSSSVTLGSGDDNFYLHGNYENSSVDGGTGFDTLTLSRGTASSVVSRQDGSLSVSNGNQSLILQGIERINFADGTSYEAPPAKPGVTVEYGSTLISENGDSTTISYKLDSPPSETVAIWLRNSDTAEASLSHEYLEFDATNWNQEQVVTVTGLSDREVDGAKAATITHEIVSNDFDYAPRADGTGGVVIENIVFTNADADEHQTIYGDREVGRYNDRLIGEDGNDRIYGGWGRDQVNSGWGGDRIYGGYDDDVLYGEEGNDQLYGEADDDRLFGGSGNDVLNGGTGADYMSGGAGNDTYYVDNENDIIDDRGLSSDVDTVVLQGAVRFTLGNGIESAVGNNANNTLNGNSSNNNLDGGAGNDSLQGASGNDQLIGGAGNDTLNGGSGRDTAVFHGQSNRINLNISGWQNTREGRDRLVSIESVNAGGGNDVVTGNRGNNTLSGQSGNDSLRGAAGSDYLLGGNGSDRLIGGSGNDRLVGGSGNDRLVGGSGRDTFVLSEGAGYDRISDFRNGQDRIQVGAGVDNLRVQNRNGHAYVYEGRDLMAVVQGGAGDLQERGNFLI

SEQ ID NO: 25757 - protein, 440 aa, Synechococcus sp.
  strain RCC307
MSPPDETAVFDSLDLVIDTVVAREVLDSRGTPTVEAEVLLEGGASGRAIVPSGASTGAHEAHELRDGDAMRYFGKGVNQAVSNVEERLAPALCGLSALDQVAVDGAMNELDGSANKSSLGANAILAVSMAVARAAANGVGLPLYRYLGGPSATVLPVPLMNVINGGEHATNNLDFQEFMIVPHGAGSFREALRWGAEVFHTLKGLLNEQGLSTAVGDEGGFAPNLDGNDAAGDLLVRAIEKAGYKPGEQIALALDVASTEFYKDGRYSFGGGNYSSAEMVDQLAQLVSRYPIVSIEDGLAEDDWDGWKLLTERLGSSVQLVGDDLFVTNSTRLQRGIDLGVANSILIKVNQIGSLSETLQAIDLGGRNGYTSVISHRSGETEDTTIADLAVATGAGQIKTGSLSRSERIAKYNQLLRIEDELGSQAVYAGTQGRGPRGRR

SEQ ID NO: 25758 - protein, 773 aa, Synechococcus sp.
  strain WH7803
MRFSPSRFTALVLIAGLSAADVGALDGLMNNVSRQVQAQGALALRIRRGPSGVEVVVEGVGAQPVLQQRINGGVWEGRLQTQGQPGVRNGSQQLSDPGASLAKVAISGSGQTYQLEVVPVPGQTLQEPVVSADGRNLILQFNGLATAPTLQTGRLDLNTPGSVPQARYAPPLRPRAVAPPLGDMAVGTMVLQNRSFVNVSGPPVTLTLNNAPAKDALMALARLGGYGFVFVGEDSAASGSAEPSSVATVSMAFQNESYARALNGVLLASGLQGKLDGRTLLVGKGAATKTFGPQMSKVIRLNQVSARSAAEYLGNLGATFNLTNTITTTTGEPASAGTSQLSNQTSQINSTILESESFGASTGPLRGLVVTTDSRLSTVTLVGDSQLVAIAEGYLKQIDLRQRQVALNVKILDIALSNDSQINNSFAFRSGNAFIVSENGQLLANFGAYKPPGSEQGGLPGRYNADQGTTPIPGTGALDGGEGFVDSPTSPFPLPGSVTRIGPDGVTERGPFRPDFGTFDNPLQPGIDEIDEDGRVTYRSPTRFQYPVNQFFDFLAAQIQSSSTKILASPTLIIQEGSESTQGSDASKISADGKVGRERTNEALVSVGTKLVTSFEVKQDENGNNFCQPVFSNAGLTFGARVEKIDDNGFVTFSLSPEISAAVGVPETIGNCGNINIINSRTLDTGKIRVRDGQTLILTGVISDTDVQAVTKWPILGDIPFIGQFFRSSSGDRTKNELVILVTPRIIDDTQGGSYGYGYRPSLPAARQIMSGS

SEQ ID NO: 25759 - protein, 430 aa, Synechococcus sp.
  strain WH7803
MFDSLDLVIDTIVAREVLDSRGNPTVEAEVLLEGGASGRAIVPSGASTGAHEAHELRDGGDRYMGKGVIQAVNHIEERIAPALCGLSALDQAAVDAAMLELDGSDNKSSLGANAILAVSMANARAAANGLGLPLYRYLGGPMATLLPVPLMNVINGGAHAANSLDFQEFMLVPHGAPSFREALRMGTEVFHTLKKLLSAKGMSTAVGDEGGFAPDLGNVEAGEILVEAIEKAGYKPGEQISLALDVASTEFFADGRYAFDGGSYDSAEMVGQLEKLVEQFPIVSIEDGLAEDDWEGWKLLTERLGSKVQLVGDDLFVTNTKRLQQGIDSSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGNA

SEQ ID NO: 25760 - protein, 285 aa, Synechococcus sp.
  strain WH7805
MQELNLDSSLSFNNFINLGVFQNNQLSRVVIPEGIEVIKGGAFSGNSLTSAEFPDSLVRIEGGAFQDNNFTTVVVPDNTSLSGFAFDLDVEIFRESFAPATVVKDVNYTLQSNEDNLILTGVEPLRGNGNEFINIIEGNAGNNKLRGFFAPDILKGNDGRDKIKGDEGADTLIGGVGGDILTGGSGSDSFVYETITDSGVTRKTRDKITDFQVGEDLIDLSQIDANPNLFGDQAFEFIGAAKFSEAGQARFKNGLLRLNVDDDRRAEFQVKLKGVTELFVDSLIL

SEQ ID NO: 25761 - protein, 430 aa, Synechococcus sp.
  strain WH7805
MFDSLDLVIDTIVAREVLDSRGNPTVEAEVLLEGGASGRAIVPSGASTGAHEAHELRDGGDRYMGKGVIQAVNHIEERIAPALCGLSALDQAAVDAAMLELDGSDNKSSLGANAILAVSMANARAAANGLGLPLYRYLGGPMATLLPVPLMNVINGGAHAANSLDFQEFMLVPHGAPSFREALRMGTEVFHTLKGLLNDKGMSTSVGDEGGFAPDLGNVEAGEILVEAIEKAGYKPGEQISLALDVASTEFFADGRYAFDGGSFNSEEMVGQLEQLVEKFPIVSIEDGLAEDDWEGWKLLTERLGAKVQLVGDDLFVTNTKRLQQGIDSSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGKA

SEQ ID NO: 25762 - protein, 765 aa, Synechococcus sp.
  strain WH7805
MRFSPSRLTALVLMAGLSAADVGGLDGLMKNVSRQVQAQGALALRIRRGPSGVEVVVEGVGAQPVLQQRLNGGVWEGRLQTQGQPGVRNGGQQLADPGASLAKVAISGSGQTYQLEVVPVPGQTLQEPVVSADGRNLILQFNGLTTAPTLQTGRLDLNTPGSVPQARYAPPLRPRAVAPPLGDMAVGTMVLQNRSFVNVSGPPVTLTLNNAPAKDALMALARLGGYGFVYVGDNSAASGSEEPSSVAPVSMAFQNESYARALNGVLLASGLQGKLDGRTLLVGKSAASKTFGPQISKVIRLNQVKAQSAAQYLGNLGATYNRANSITTTRGEPASVGTAQLSNSTSQQSSTTLLSESFGSSSGPLRGLVVTIDLRLQTVTLVGDSQLVAVAEGYLKQIDLRQRQVALSVRILDIALDNDSQISNSFAFRSGNAFIVSDQGQLLANFGAFKPPSSPQGGLPGQFGAAEGTTPLSGTGALREENAFLDQPQAPFPFPGSPTVPGGTFRPGFGTNQNPLQPGVSEVDEEGKITFESPTRFQYPANQFFDFLRAQIQSSSTKVLASPTLIIQEGDDESLGSDDRSISSDGKVGRSRSNEALVSVGTRLVTSYRVRQDDNANIFCEPVFKNAGLTFGARVDRIDDNGFVTFSLSPEVSAETGIRVIENCGNISLINSRELDTGKIRVRDGQTLVLTGVIQDSDVQAVTKWPILGDIPFIGQFFRSSGGSRTKRELVILVTPRIIDDTQGGNYGYGYRPSLPAARQVMSGS

SEQ ID NO: 25763 - protein, 430 aa, Synechococcus sp.
  strain WH8102
MIDSLDLVIDTIVAREVLDSRGNPTVEAEVLLEGGAMGRAIVPSGASTGAHEAHELRDGGDRYMGKGVSQAVTHIEERIAPTLCGLSALDQAAVDAAMLELDGSDNKSSLGANAILAVSMATARAAANGLGLPLYRYLGGPMANLLPVPLMNVINGGAHAANSLDFQEFMLVPHGAPSFREALRMGTEVFHTLKGLLKAKGMSTSVGDEGGFAPDLGNVEAGEILVEAITKAGYKPGEQISLALDVASTEFFENGRYAFDGGNYDSAEMVGQLEQLVEKFPIVSIEDGLAEDDWEGWKLLTERLGGKVQLVGDDLFVTNTKRLQQGIDNSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGNA

SEQ ID NO: 25764 - protein, 430 aa, Synechococcus sp. BL107
MIDSLDLVIDTIVAREVLDSRGNPTVEAEVLLEGGAMGRAIVPSGASTGAHEAHELRDGGTRYMGKGVSQAVTHIEERIAPALCGLSALDQAAVDAAMLELDGSDNKSNLGANSILAVSMATARAAANGLGLPLYRYLGGPLANLLPVPLMNVINGGAHAANSLDFQEFMLVPHGAPSFREALRMGTEVFHTLKGLLSAKGMSTAVGDEGGFAPDLGNVEAGEILVEAISKAGYKPGEEISLALDVASSEFFKDGRYAFDGGSYTSAEMVDQLERLVEKFPIVSIEDGLDEDDWEGWKLLTERLGSKVQLVGDDLFVTNTKRLQQGIDNNTANSILIKVNQIGSLTETLQAIDLAGRSGYTSVISHRSGETEDTTIADLSVATRAGQIKTGSLSRSERVAKYNQLLRIEDELGSQAVYAGAVGQGPRGKA

SEQ ID NO: 25765 - protein, 906 aa, Synechococcus sp. PCC 7335
MTATRMRWGGWLVQLMAGCGLLLGPAAIASESVLKENASAMDMTVSDAKPDEASTPTVTTDRWLRERWLTQSDLAEPAAEVVEITDIQLEETAAGIALQLETTGELITPELSVAGNAAILDIPNAILNLPEAERFAISAPNADIAFIDINNRPDNQVRIAITGTEAPPTLSVTTVATMLTVRAIARASTAQDSMPDPMPEPMPDPSEDAIAGDPVPGSSGSDDAIQIIVTGGQVQDNYFVPNASSATRTDTPILETPASVQVIPRQVLEDQQVRDLGDALRNLSGASVNSTEGRGFQISLRGFNGVSVYRDGFRLYSPNDNGDAAGQGFPEIANIERIEVLRGPASVLFGQSEPGGILNIVSKAPLEQPFYEIGLQTDSRGSVRPQIDISGPLTEDNRLLYRLNAVYQNENEFQDFDERSERFFVAPDLAWRINDRTDLNLQLEYLNDDRPFNPGLVALGDEVADIPRDRILGEPDDSISSEFSNVGYDLEHRFSDTWKIRNAFRYLNQSDDISATLSFPFIGGLDEATGDLNRVFAEQDVNNKTLALQTNVVGEFSTGPVDHTLLVGVDLARYSLDSDSFTDFSPGPSRTPINIFDPVYGTPPRPERGDVPTRSDRIDTNSLQIYAQDQIDLLDNLILVAGFSYETVEQTTVTTSRGVTTEVDLTEDAFSPRIGLVYQPIENLSLYANYSRSFFPSAAVTVDGEPLAAEEGEGFEVGLKTELFEGNLLATLAYFNLTKQNVATTDLNDPRFSVATGEQQSQGIELDVIGEISPAWNVVASYAYIDSALTEDSSIETGNPLPGVPEHSASLWTNYEIQSGDLTGLGFGLGLNWVGERQGDLSNSFDLDSYFLTNAAVSYERNRWKFGLNFQNLFDVSFIEGTPRTRTRGIEPGDPFTVLGSVSYEF

SEQ ID NO: 25766 - protein, 658 aa, Synechococcus sp. PCC 7335
MNSFLTLLVNEIVGSLFKDAPTIDDLGDIFIGGNGDDNLQGGDRDDIFLTSGGDDTVLGGDGTDVVFAGNGNDIVIGQTGDDVAFLGSGDDRFIWNNGDGSDFIKGGAGFDITEVNGADGAGDEFDLRAVDGQAIFNRLNLGLFTLTNEKIEQFEINGQGGDDSLTVGDLSGSGVKKVVFSGGKGNDVLDARESSTTLKAFGGKGDDLLQGGSAEDTFLAGGGDDLVVGQRGDDTAYLQGGDDRFIWNNGDGSDFINGGRGFDITEVNGADGAGDEFDLRQVGRQTIFNRLNLRLFTLTNNKIEQFEINGQGGDDSLTVDDLSSKVQKVIFSGGDGNDVLDARESSTTLEAFGGEGDDLLQGGSAEDTFFAGGGDDIVVGQRGDDTAYLEDGDDRFIWNNGDGSDFINGGADFDVTQVNGADVAGDEFDLRAVDGQAIFNRFNLGLFTLTNEEVEQFEINGQGGDDSFTVGDLTGGGVQSVLFSGGDGNDFLNGSGTATPITADGGAGDDILIGGDGDDILIGGDGADLLIGAGGNDILIGGGGSDLFGFDTGAAFNAADIGTNMIQNFESTDSIVLDATIFTALTSKIGGGLSASEFAVVDSVEAAAVSDALIVYGANTGHLYYNSNGADAEFGGGAQFATIEGAPTLDANSFVVQA

SEQ ID NO: 25767 - protein, 839 aa, Synechococcus sp. PCC 7335
MTMPVLASGQVDGISQSEAISDLSERETWLVQTDLPTDSAASTDSIEAPTEVSEITDIQISAAETGITLTVVSLNPLSVENTQVSGNALIITLPEATLNLSDAAAADQFAPAEGIALVQTTARADNSIQIAITGTDAPPDVQVGVVGENLVLSVVPGMAPSANAEDAIQLTVIGDQDEGYSPNSASVGTRTDTLLLDVPASIQVIPEAVIADQGALDLLDVLRNTPGINTNSSPRDIFSDFTIRGFNTGNTFLRNGVADNDLGRTGLDLSNVERVEVLRGPASVLYGQIAPGGAVNVVTKKPLSVPFYDVEVTYGSFDTYQGAVDLSGPLTEDGSVAYRLNASAYSTDTFIDEIGLERYFVAPVLSWDISDDTNLIFEAEYIDARYPNERGLPIEGTILPNPNGELPRSRYLGEPSFDRNDRTTLRLGYELEHRFGEDWRLQNTFRFSWEEDYQDSVGPGSLEADFRTQPRTAFITSPGAGYSFAQNSYEATLAAIGEFKALGAEHELIMGVDFAYEVGISPFYLQQEIGSIDIFNPVYNQPLGEITDVFDPSRDTATSIGGYVQDQITLSDEFILLLGGRVDYVNQSSLDVLNDDRSSQSDTAFSPRVGLVYQPTEDVSVYGSFGRSFEQAAGRSLDGELFDPSRGTQYEIGAKANWLNDRLSTTLSLYNLTRTNVLTTDPRNVDFEVQTGEQRSRGIELNVAGEILPGWEVIAGYAYTDAEVTEDNDIPVGNQLINVAENTANVWTRYTLQSGDFEGLGFGLGLFYVGSRPGDRENTFDVPSYLRTDAAVYYNRDSFRAQLNFKNLFDTRYFESANGRDRIFPGSPFEVLATVGWEF

SEQ ID NO: 25768 - protein, 823 aa, Synechococcus sp. PCC 7335
MTTVLSLFALTATGAKAEIADSRIGEASYTVTANWMAQTETAPVQIVGIQVEESETGLQITLETIETALNMRVTTASGNALIAEFSNAVLVDNPLEQFEPAEGIALVQVSALPDERVRVVVTGSNAPPIADFESTASGLAISIAPGAAQADDTSDTIRLVVTGEDDEGYNPSSASTAIGTDTPIRDTPFSIQVIPEAVLEDRNVTELGDALETAGGIVENGARGTSAFGPNLLIRGFRLNDTIFRDGISAFSLAPLSTNDVERIEVLRGPASVLFGQGNPGGVVNLVTKQPLSKPFHEVSGSAGSFESYDGALDLSGPLTGAGDVRYRLNLSYENYGSFRDFVDGERLQVSPTLAWDINENTSLDVFGQYTYDRETTDEGIPFDSNGEPIDVPRSRFLNEDFGEFTQDQFSLGYRLNHDFNDNLSLRHSSQYFQYEPERYYPFVNSFDEVTGEAERVEYFAEGTYQRFFTNAELVGQFNTGSVEHELLFGLEYRHDAEDPAFQFDNEFPPINAFNPVYTNEPFEKSPTFFRDDNVDTISAYIQDQITIIPELILLAGLRFDYVDEFRTERNSGEPRQEFEDQSEAFTPRLGIVYKPIEPITLYASYTTSFLPNGAGFLNGNGSTFEPEEGRQFEVGIKTDVTDRLSLTLAAFDIRRQNIVVSDPDDPLLSIQTGEVASRGIDLNLNGEILPGWNVTAAYNYLDAFVSEDTTDIQGNQLEGVPDNQFSLWTTYEIQQGNLAGLGAGLGLLYVGDRPGDIDNSFTLPDYFRTDAALFYKRDNWRAQLNVENLFDIDYFPSTSYGSSLYVNPGAPFGISASFAVEF

SEQ ID NO: 25769 - protein, 702 aa, Synechococcus sp. PCC 7335
MLGGALAVLTGPLIVAQSAIGATIVEGIALKRTAAGLELKLETRGDSPQVVTASLGEILQADIAHAQLKLPEGESFTRKNPAPGIASVKLEAIAPERVRVTVLSKTKAPVSQIQKSTDDDFVLALDTRSHAKAAPSNLPKSLITVPGKANSAEASLSEASLNEATLTEAIPIEAEGSSASTFELAQAIEDEAAPEILVPNPEVMIDGTPITTPTLNGAPPLLPRAIAPPVGDLSVSDIDSTLDEIDLGTTERVPRLVLRDASAREVLALLARATGLNLAFSNEGEGEEAFDALVSLDIENESVQNVFNYVLQLSGLDANKVGQTIFVGPRLPNSARNVLVRSIRLNQIDVSNAVNFLVSMGAESAVNSESSVTSVSAVEVGEGTDVTESTVTQSSLTNQRIDFADADPLLRGLQVIGDERTNSLTLIGTPRQIEIATAQMVQLDIRRRQVAVNLRVIDVNLNDSDSFGSQFSFGLGDTAITQSGGIGLINFGVAGGALGIARQFLAQLEASVQSSNAKIVTDPTLVIQEGQTAAVQLTQEVVTNITTDIETTEVGVLRTVTFEKEDAGLNLQVQIDRIDDNGFVTLAVAPSISAPTDTFNIGTEEAVLLANRQLTSGQIRVRDGQTLVLSGIIQESDRNTVTKVPILGDIPLLGALFRNSDRENIRRELIVLLTPQVMNDSDQSVYGYGYVPSEDVQQLLER

SEQ ID NO: 25770 - protein, 429 aa, Synechococcus sp. PCC 7335
MIDSLDTAIEAIQAREILDSRGRPTIEAEIYLSGGAFGIAQVPSGASTGSFEAHELRDGDKSRYGGKGVIQAVENVNDAIARELMGANALNQIEIDRMMIALDDTSNKKKLGANAILAVSLATAHAAAAAQAMPLYRYIGGPLANVLPIPMMNVINGGEHASNNVDIQEFMIMPVGASSFREALRWGAEIFAQLSKVLDAKGLLTGVGDEGGFAPNLSSNQEALDLLMSAISEAGYTPGEQVALALDVAASELYENGEYTYDGAAHSPVEMISYLESLASNYPIVSIEDGLHEDDWESWETLTERIGSKVQLVGDDLFVTNPTRLQKGIDQASANALLVKLNQIGTLTETLEAIDLAKRNQFNCVISHRSGETEDTTIADLAVATRAGQIKTGSLCRSERVAKYNQLLRIEDELGDQAVYAGTTGMGPR

SEQ ID NO: 25771 - protein, 1041 aa, Synechococcus sp. PCC 7335
MDNIFTLPSAKSLSHDEPSQTESSDDACGCEVVDGQTVNTTWLDGDGPNALENLEQRGLLEEPAASRIKLPEYDGSGVFDIYVEAGLLSGIEEAVDTYVDDLEGEGYQISVQEFSGDAEALKTRLQSSWQEKGLEGTLFIGDLPHVEFTSEDNFNASGRQVTYPHDLYFMDLDGDYDLNDVGLDGHTGEVSPEIYVSRLTTGNLSGITGQTETDLINDYFARNHAYRTGELTFRNRGIVFADDDWSHWGADRMQALYEEVLVLNNASETTKDNYLNTLGLNYESILEAIHSSPTSHSLKVNDRWERISSQEIVETNPRVGFYNLFNCSSADFTVPNNLIGAYVYGGEFGLNAIGSTKTGSMLNFFDFYQPQGENDSVGQAFLQWFDQYAASTDNPSQDWRLDWFNGMTMQGDPTLKPASMGDAPGELIGTKWNDLNGDGIRQAEEPGLAGWVIYLDQNQNSQLDENEASTVTDSDGNYRFSALLPGTYTVTEQPQPDWSQTKPIGFDYDWSDSDSTELPFDWVEISEVGTALTLGDDEGIQIDLPFEFPFYGETQKTVKISSNGYLSFGEDAFQFDNESIPQPTQPNQIIAPFWDDLNPTQGGNVYYHYDADNDCFIVQYDEVPHYSDEGAYTFQAILNADGTILYQYDTLTGILDSATVGIENKDGTDGVQIAFDQSYLHDDLAIALNPVPNSPQPYTVSVVSGETITDLDFGNQQRALNIINGTSGDDTLFGGKRDDILFGLAGNDFLDGGNGDDTLDGGRGNDTLFGGNGNDILIGGADNDTLDGGKGNDTLDGGRGNDLLTGGRGSDSLLGSDGNDTLFGGGDNDTLDGGKGNDTLNGDKGNDTLDGGRGSDALFGNDGNDILSGGADNDTLDGGKGNDTLDGGRGNDLLNGGRGLDVLFGNDGNDILSGGADNDTLNGGNGNDTLNGGKGNDTLDGGKGRDLLLGNDGNDTLIGGGNNDTLTGGNGRDTFVLSLGDGFDTITDFDTKDLIGLAGGLSLGALSFVGNDIFVTDTSEMLATLTGIDTSSLNSSQFVLV

SEQ ID NO: 25772 - protein, 838 aa, Synechococcus sp. PCC 7335
MSVVNPFAQSASVLDGAQEVAAGDSNAAGVDTLILGSNGESLSYELTVSGLDFGAFFSDGKPQTEDTGDDVIGLHIHSGSRGENGPIAFGLIDIGLVDRQFDGQDVDDITFSLNSDGSTTIRGVWDETDPASIALSQFVDDIQNAAPGEDIPLYWNVHTNDFRGGAIRGQFLGENAPIVGTAAAEELQGTEGNDILDGLGGGDTLVGLGGNDVLLGGGGADINDGGEGIDTANFSDIGAPVTALLGQGLASYVPASGVTVIDTLISIENLSGTENDDQLFGDRGTNVIDGGGGNDLVAGGGGDDVLQGNEGDDVLRGGGGNDTLNGGNGNDTADFSDIGFEVTANLAQSSANYVVASGANVVDSLSNIENLSGSSNDDHLTGDDASNLIAGAAGDDTLLGGDGDDVLRGDEIGDGTALVFTVENLQTNGGTFYTPLWLGVHDGTFDLYDRGGPARQGLERLAEDGTIAPISAEFVAEQLAVGGVDGTIFGGQGVPGPIDPGETAQIVLDVDDPSVARFFTWGTMVIPSNDAFLATTGNPLGEPIFDADGNFLGPITIERTGNDVLDAGTEVNTEEGAAFLNQTAPDEGTPENGVVIAHPGFNGSERNPDGTPVNILGGLTAPGAMIDPVVGDFTQNGGEDLLLRITIDELAAQGGNDVIDGGLGDDLIEGGAGSDLLAGGLGDDVLFGGKGDDTLRGDLNNRNPQVGVGGNDVLRGGAGNDAIGGKGGNDQLFGDDGDDLLFGDDGDDILTGGAGNDRLQGDDFSGGSGADTFVIEAGAGTDTIVDFQLGTDLIGLGAGLSFAQLSLRGNSILFGDETLATLSGIQTASLAESSFITI

SEQ ID NO: 25773 - protein, 589 aa, Synechococcus sp. PCC 7335
MTYGQLTPTTSNTATGERNIDSLISAKRYLHESKQSSGGMGGDPEQPPYGGDEPPIGGGEPPIDPIDPPDESDEPVGIKTRITYSFPDEFRDKDYESDYGGFDGFNAFNSAQKAATRSIMKMYESVANFDLDELTDNKDRDATIRLANADGTNRFDGIAGFPSEPDFMQGDVWIDSVNDPRNTNPKIGNKGYWVLMHEIGHALGLTHSHETHANLDGPMDSWLDSKEFTVMSYKAHVGGELIPNPVDEVDQPQSLMMYDIAAIQAMYGANFDTRSGNTTYTFSTSTGEMFANGQSLGKPENNTIFRTIWDGNGRDTYDFSNTGRSQSINLRPGAWSDLSADSTAQNARLKIEWGGVVTKRARGHIANALQHNDDPRSLIENAKGGGGSDTIQGNIARNHLYGNVGDDRLWGWDNNDTLDGGSEDDLLFGGRHNDILKGGPGNDILVGADPYSNTPHNEVDVLWGGADADRFVLGLASDYSVPTVGGPPANRILYDDNVVWTEGQNSYALIMDFELGIDRIQLRGDSRDYNWRSVEVVHDNQTYLGTGIYVDNPVPHRDELIGVLVGVNASQISVYDSSQFSYVYATTEF

SEQ ID NO: 25774 - protein, 430 aa, Synechococcus sp. RS9916
MLDSLDLVIDTIVAREVLDSRGNPTVEAEVLLEGGASGRAIVPSGASTGAHEAHELRDGGSRYMGKGVTKAVDHIEDRIAPALCGLSALDQAAVDSTMQELDGSENKSNLGANSILAVSMATARAAANGVGLPLYRYLGGPMASLLPVPLMNVINGGAHAANSLDFQEFMLVPHGAPTFREALRMGTEVFHTLKGLLHDRGLSTSVGDEGGFAPDLGNIEAGDVLVQAIEKAGYKPGEQISLALDVASTEFFKDGRYAFDGGSFDSAEMVGQLEQLVNRFPIVSIEDGLAEDDWSGWKLLTERLGSKVQLVGDDLFVTNSKRLQQGIDQGVANSILIKVNQIGSLTETLQAIDLAGRSGYTSVISHRSGETEDTTIADLSVATRAGQIKTGSLSRSERVAKYNQLLRIEDELGSQAVYAGAAGQGPRGNG

SEQ ID NO: 25775 - protein, 771 aa, Synechococcus sp. RS9917
MLSSCLGGTALLGAFGLYELAAAPVLAEADGVMQLQARRSAEGLEIVVVGVGAQPVLQQRLESGQWQGRLTTQGTPGVRGGVSRLSLPDLGIQRFSLEGSGSTYLLRFDAVNGVTPPDPLVSADGRNLILSFPGLASPTLQTGRLDLNTPGRVPQARYAPPLRPRAVAPPLGDMAVGTMVLQNRSFVNVSGPPVTLTLNNAPAKDALLSIARLGGYGFVFVGEDLPGTTTTPGVPGTTPPSGQGLGGLIPVTMSFQNENYARALNGILLASGLQGKLDGRTLLVGTSVSAKTFGPQVSKVYRLNQASATSAADYLASLGASMSKVNTTSIITGEPASAGTSQLSTQTSQTRSTLTNVETYGSSVGPLRGLTGTTDARLQTVTLVGDSQLVAIAESYLKQIDLRQRQVALTVKILDINLENDKQIANSFAFRSGNMFVVSNNGELLANFGSYKPPGSEAGGLPGQYSAQEGTTPVPGTGSLAGDNTPFFDQPTSAYPLPGSSTRLGDTTRSPTRPDFGTYNNPLQPGVSDVTEDTVEYTAPTKFQYPTNQFFDFLRAKIESSSTKVLASPTLVLQEGGEKSMGTDKGKISEDGKIGREYSNEAYVRVGTQFVTSYEVKQDINGNNFCQPVFANAGLTFGARVDKIDDNGFITFALSPEISAPVGSEQVGNCGAITIINDRSLDTGKIRVRDGQTLILTGVINDTDREVVSKWPILGDLPFVGQFFRSSGGQRSKSELVILVTPRIIDDRSGGSYGYGYRPNLPAARQIMTGN

SEQ ID NO: 25776 - protein, 430 aa, Synechococcus sp. RS9917
MFDSLDLVIDTIVAREVLDSRGNPTVEAEVLLEGGASGRAIVPSGASTGAHEAHELRDGGSRYMGKGVTQAVDHIEERIAPALCGLSALDQASVDAAMQELDGSANKSALGANAILAVSLATARAAANGVGLPLYRYLGGPMASLLPVPLMNVINGGAHAANSLDFQEFMLVPHGAPSFREALRMGTEVFHTLKGLLQERGLSTSVGDEGGFAPDLGNHEAGDILVQAIEKAGYKPGEQIALALDVASTEFYADGRYAFGGGSFSSAEMVDQLEALVNRFPIVSIEDGLAEDDWDGWKLLTERLGSRVQLVGDDLFVTNSQRLQQGIDHNTANSILIKVNQIGSLTETLQAIDLAGRSGYTSVISHRSGETEDTTIADLAVATRAGQIKTGSLSRSERVAKYNQLLRIEDELGSQAVYAGAVGQGPRGRG

SEQ ID NO: 25777 - protein, 431 aa, Synechococcus sp. WH 5701
MFDSLDLVIDSIVAREVLDSRGTPTVEAEVRLEGGAQGHAIVPSGASTGAHEAHELRDGGSRYAGKGVLQAVANIEEKIAPVLCGLTAIEQVAVDTTMIELDGSDNKSALGANAILAVSLAVARAAADGVGLPLYRYLGGPMATLLPVPLMNVINGGAHAANNLDFQEFMLVPHGAPSFREALRMGTEVFHVLKGLLSDQGLSTAVGDEGGFAPNLESNDAAGALLVAAIEKAGYKPGEEISLALDVASTEFYADGRYAFGGGSYSSAEMVDQLDALVSRYPIVSIEDGLAEDDWEGWALMTERMGSRLQLVGDDLFVTNTSRLQRGIDAGTANSILIKVNQIGSLTETLQAIDLAGRAGYTSVISHRSGETEDTTIADLAVATRAGQIKTGSLSRSERVAKYNRLLRIEDELGSQALYAGAEGRGPQGKL

SEQ ID NO: 25778 - protein, 911 aa, Synechococcus sp. WH 5701
MDALMGSAGLGFRAGLWLGASSTLLAILSLAVTPAPALAQAAIRSDGLQLKLRRLPDALELLIQDVGTGSDLRQQMQGQVWLGELRTPQIRGLKAGPQSLSMTDAGVDSITFDGTGTEFQLKVTPMPGRNLGTPVVSSDGRDLTVRFIAPQLPVSQTAQVDLRAPTRVPTSSFVPPLRPRAVAPPSGDIAVGTMTIRNRGYLSLYGPPVTLTTRSANPRDVLMVLSQMGGYGFAFSDASMSGGSNGQGGMRPAPPAQVTVAFQNEPYERAFNFVLLSSGLQARKEGNTILVGSDVLGKTIGPQMSKVYRLNQVAPNSAADYLANLGAQVTKTSSITTAVSQGVPLGAQPAGTGLTATSQSTTSTQQTVEAFGASSGPLVGLRATTDPRLGTITIVGEPSLVAIGEQYLKQLDLRQRQVALSVKILDVSLTNDTEIDNSFAFRFGNNFIVNDGGRLLAAFGRNLPANAQDFSDANTREFFGSSSNSSRNSSSSASNNSASGSTSNNQSGSTSGSGSDTSYSEDLTLSLANGRSLEQSQISNVNRQLFRETGTEIQPFEVTRFIPNPNAGVEGELPNIEVTDTEYRIVPIGRTTRAITDDLTSRISQIVTSQVNSGVNIARSRGGFTNSGSSSSSASGSTGSNNSSSGSNSFSDSSSDSFQNYSGSRRRNPGLNYPDNEFFSFLQAQIVSENAKVLASPTLILSENPEQIFGGAEVGGGGLGGQAGDSSGLSPATIGRTRANESFVTVGRQVVSAYDVTTTANVGVSCEPTFSTAGLTFGARVSKIDDNGFVTFTLSPAISGVVDRQPVPGCGFIDILRLRRLDTGSVRVRDGQTLILTGVISDDDFQVVSKWPILGDLPLLGQFFRKTSGSRNKNELVILVTPRIIDDEQGGTYGYGYTPSARDARRLIYSP

SEQ ID NO: 25779 - protein, 843 aa, Synechococcus sp. WH 8109
MNVPELLSPAGDWAAMKAAAASGADAVYFGVDAFNARQRAENFRLQDLPEVMQWLHQRGLKGFLTFNVLVFSDELEAAAQLLIAADRAGVDAVIVQDVGLCRLAQRLVPNLCVHGSTQMSITSAAGITQAAALGCQRVVLARELALRDLERLQTQLIQRNLAMPLEVFVHGALCVAYSGQCLTSESLGQRSANRGECAQACRLPYEMVVDGQPHTLEDQRYLLSPQDLAAWELLPELQRIGVASLKIEGRLKDAAYVAAVTDAYRQRLDQTPASAPQVQRQLELAFSRGLSTGWLEGVNHRRLVHGRWSKKRGPLLGQLLRVERGGWLHLRSREKLHSGQGLVLEQLSSDPLQPPREIGGRIMVCERLGDERWKLRLGPDRVDGSGLRPGASVWLTSDPDWQSRWQRAARRTVEARSRDLALRVSGRLDAPLELHVLEPQGFELKLCSTMPLESASQRPLERERLEQQLGRLGGTGWSLQHLEIELEGDLFLPVAELNRMRRALLEQLEVSGDDSTDSGPVPAATKTPNPTELLAQMYPPAVAPLSETKPGLVVLVRSLEQLQALVDLSGTDLPIRSVVADLEQPWELREAVAIGRGCWPEGVWLAGARITRPDERWSLEPLIRARPDGFLVRNADQLEVLTPLAPCIGDFSLNTANPLSFHWYRDYWTLQRLTASYDLNLQQLLDLAAAVDPALLEVTLHQHMPLFHMEHCLFCAFLSAGKDHTDCGRPCEKHHVTLRDRSGVEHPLRADLGCRNTLFNGTAQSGVEALPSLLRAGVRRIRLELLDEDASATRRRVSLYAEALAGRMATQEVWSQEQIHHQLGVTRGSLRSKGPERTSRFSR

SEQ ID NO: 25780 - protein, 430 aa, Synechococcus sp. WH 8109
MIDSLDLVIDTIVSREVLDSRGNPTVEAEVLLEGGAMGRAIVPSGASTGAHEAHELRDGGDRYMGKGVGQAVNHIEERIAPALCGLSALDQAAVDAAMLELDGSDNKSNLGANAILAVSMATARAAANGLGIPLYRYLGGPMANLLPVPLMNVINGGAHAANSLDFQEFMLVPHGAPSFREALRMGTEVFHTLKKLLSDKGMSTAVGDEGGFAPDLGNVEAGEILVEAISKAGYKPGEQISLALDVASTEFFENGRYAFDGGSYTSAEMVGQLEQLVEKFPIVSIEDGLAEDDWDGWKLLTERLGGKVQLVGDDLFVTNTKRLQQGIDSATANSILIKVNQIGSLTETLQAIDLAGRSGYTSVISHRSGETEDTTIADLSVATRAGQIKTGSLSRSERVAKYNQLLRIEDELGSQAVYAGAVGQGPRGKA

SEQ ID NO: 25781 - protein, 409 aa, Talaromyces pinophilus
MTIISKFGIGVLIAMVSEATAQQTVWGQCGGIGWTGPVSCVSGSYCAPGNAYYSQCLPGSGPSTTTARTTITTSSSFTTSVSTTAIPTSTGKVQFAGVNIAGFDFGMVTSGTQDLTQIVDESVDGVTQIKHFVNDDTFNMFRLPTGWQYLVNNNLGGQLDATNFGQYDKLVQGCLSTGAHCIVDIHNYARWNGAIIGQGGPSDAQFVDLWTQLATKYKADSKVVFGVMNEPHDLTISTWAATVQKVVTAIRNAGATSQMILLPGTDYTSAANFVENGSGAALAAVVNPDGSTHNLIFDVHKYLDSDNSGTHAECVTNNVDAFSSLATWLRSVGRQALLSETGGGNVQSCATYMCQQLDFLNANSDVYLGWTSWSAGGFQASWNYILTEVPNGNTDQYLVQQCFVPKWKS

SEQ ID NO: 25782 - protein, 297 aa, Talaromyces stipitatus
  strain ATCC 10500 / CBS 375.48 / QM 6759 / NRRL 1006
MRLFFFLFALLSSTLTSAAITRGQFSQVTDSWGSNPTNTGFYIYVPRNLASKPGIIVAIHYCTGTAQAYYQGTPYAQLAEQYGFIVIYPSSPYSGTCWDVSSHAALTHNGGGDSNSIANMVTWTTSQYNADTSKIFVTGSSSGAMMTNVMAATYPELFKAAIVYSGVSAGCFYSAAGQVDAWNSSCAQGQVEASPQAWASIAENMYPGYSGARPKMQIYHGSIDTTLYPENYNETCKQWAGVFGYNYGAPQQVEQNNPQSQYTTTIWGPNLHGIYATGVGHTVPVNGARDMQWFGFA

SEQ ID NO: 25783 - protein, 422 aa, Talaromyces stipitatus
  strain ATCC 10500 / CBS 375.48 / QM 6759 / NRRL 1006
MRILTLRSLLLAPVALGYVVNEGTTYQIYPEALTHNGQAVDDAPSIHQAFDLCGINGTVIFTNNTFHINSILNTTNLLNCNVSLRGELRFSTNTPYWKSHVYSVIYQNQSTAWLFGGINTWYTENKNQANQPGRPISITFYNSTNLLADGLTIFQPQFWATLVWQSTNVSLRNFYVNATSNDEWGTVNTDGYDSWRSSNLLVESATIINGDDCVAAKGNTTNLLVRHVTCHGSAGMTIGSIGQYPEWPDYVENVTFDGVRCINSSTGAYIKTWQGIPVDQDSNGDVGGGGLGLVKNVTFKNFEMINTSLPIQISQCMYSESSGACNTSKLQIEDVSWVNITGTSRYNVVASLYCSDPVPCPGIIFDNVTFESVNHTLGLPMWNTTMQDEVYQCANIDGQNSSGIPCNRVAPDSFGGVSHNVQ

SEQ ID NO: 25784 - protein, 193 aa, Talaromyces stipitatus
  strain ATCC 10500 / CBS 375.48 / QM 6759 / NRRL 1006
MSHSEVPGKNGVDGSVGPPGPPGRDGSDGARGPPGPVGLRGQDGTDGARGLPGKDGQRGTDGRDGRDGRDGRDGVNGAQGPPGPMGPRGQDGVAGARGSPGQDGQRGKDGRDGKDGKNGVDGAQGPPGAMGPRGRDGMDGVRGPPGQDGRDGRDGANGLPGPPGQNGRDGRDVHDNRNNVIRFTGRIQGSAIS

SEQ ID NO: 25785 - protein, 394 aa, Talaromyces stipitatus
  strain ATCC 10500 / CBS 375.48 / QM 6759 / NRRL 1006
MTPRPTIVAIASFAVLAVTFVQAQQSGYGQCGGANWTGATSCVSGWTCTFLNDYYSQCLPSSTTLTTSSHSTTSTTSSTATSTPTNTNGGKLKWFGVDESCAEFGTAMPGTWGVDYTFANTATIGEFINQGFNIFRIPFAMERMARGSVGATLDNAYLTNYSVAVDYITSNGAYAVLDAHNYGRYNGNIITDTSAFKTFWSNMATAFKNNSKVIFDTNNEYHDMDESLVFDLNQAAIDGIRGSGATTQYIFAEGNSWTGAWTWNTTNDSLKNLKDPENLLIYEMHQYLDSDGSGTSATCVSSTIGVERIEGATAWLKANGKIGVLGEYAGGPNSVCQEAVTGMLDHLTANNDVWFGAVWWAAGPWWPSSTWSSIEPPSGQAYVYYDNILQAYTP

SEQ ID NO: 25786 - protein, 397 aa, Talaromyces stipitatus
  strain ATCC 10500 / CBS 375.48 / QM 6759 / NRRL 1006
MHAFLYIIPTCLISPAIAENGLDGWLRYALLPASLTSHFLTGFPSNIITLNSSINSLVYTAARELQKGLRGIRHKDVDIICSNKSQSQFASIVIGTVDIFTKTFGIGNSWDDLIQDGFSLNISENSVRIIGRNERGTFNPHAPIRCVNQWDNLDGSIERGYEGSSIFFENGVIVRDLTRAAEYARLLASIGVNAVVVNNVNANSSLLTPENIQGLSRIADVFRPLCFAAGGWGLSIYDPLDPGVIKFWWNITNQLYEAVPDMVGYLVKADSEGQAGPLVYNRTLAQGANLFANSLKPHGGVLMFRSFVYNKLNESDWKADRANAAVEFFKDLNGEFDENVIVQIKYGPIDFQVCEPVSPLFANLPHTNTALELQITSGIPRSAMSFGLYASIMEDDS

SEQ ID NO: 25787 - protein, 151 aa, Talaromyces stipitatus
  strain ATCC 10500 / CBS 375.48 / QM 6759 / NRRL 1006
MDGVNGPGRIGQASKLQSGKTVIQHFYDAHYTGAAAAQTFPTKWETLKDKIDDERPVVWRDAITEFYHNLSGIPDDTGRVGTENYPWRIQGENMDLVGYTPYVVNPFETASNFTTIITTSNTTAGTASTHINFPTGKYDIAVNYYDVIGGI

SEQ ID NO: 25788 - protein, 336 aa, Talaromyces stipitatus
  strain ATCC 10500 / CBS 375.48 / QM 6759 / NRRL 1006
MSYQYSHQDHGHPPLPPDWRAQWVPEENQYIFINERTGQRSWHHPEVPPGNHGSGTRDIGGPPGPGNYGGPPPPGPGYGGPPPPSGRGYGGGPPPPGSGYGSPPPPGGRGYGGPPPLGGRGYGGPPPPGPGYGGPPPPVGRGYSGPPPPGPSYGSPSPGGRGYGSPPPSQGYGTPPPHGYGSPAPAPAPAQQKSHGLALGIGGGVLGAAVGAWAMHEHDKHKEEEKEEEWREEEKRLQEREHAREREQEREIEAQREELYEEQREIQRERDERYEAEALYENERRYDDERRFEEERYEDERRYDDERRYEDERRFIEDEQIIDDERRYEDRYDDRW

SEQ ID NO: 25789 - protein, 405 aa, Talaromyces stipitatus
  strain ATCC 10500 / CBS 375.48 / QM 6759 / NRRL 1006
MKISSALINLVLAASVVDGAPHKLQTRSPGGEVVVYWGQNAAAASENNDLSTYCTADSGINIVVLAFLYEYGNNIVIPSGVIGKDCSISTSGEGINCDALASQIATCQSNNVKVILSLGGAVGAYSLTSQSEAEKIGQNLWDAYGKSAGGSIPRPFGSISVDGWDFDLESNSGNQYYQYMISKLRSNFKSDSGNTYYITGAPQCPIPEPNMGEIIQAAQFDYLWVQFYNNEYCSYPNTLNYAEWVSYISRTPSNNAKIFIGVPASELGSTGTESGATYYQSPSILANTVASFDTSSNWGGIMMWDAAFSNANVVDGCNYAQQAQSILKTGSPCGGNDNNSPMFLASTVTSTTTTATPSTSSTTATTASVLVAQWGQCGGDGYTGSTVCASPYRCIRESKYWSSCQ

SEQ ID NO: 25790 - protein, 633 aa, Talaromyces stipitatus
  strain ATCC 10500 / CBS 375.48 / QM 6759 / NRRL 1006
MATVRICVCGDEGTGKSSLITSLVKGVFVTNKIQPVLPQITIPPTIGTPENVTTTTVVDTSALPQERTNLAREIRKSNVILLVYSDHYSYERVALFWLPHFRSLGVNVPVVLCANKADLATDTTDAQVIEEEMLPVMAEFKEIDSCIRSSARQHRNVNEAFFLCQKAVTHPIAPLFDSKESVLKPAAVAALQRIFYLCDKDRDGYLSDKEIEDFQLKCFGKPLSEEDLVHIKETIQKAYPDAVAPAGITSRGFLHLNKLFAEKGRHETVWIILRTFQYTDNLSLQETYLHPKFEVPPFSSAELSPEGYRFFVDLFLLSDKDNDGGLNNSELASLFAPTPGLPSSWADDSFPSSTVRNEAGHVTLQGWLAQWSMTTFTSPKTTLEYLAYLGFESSDRSNPSTTAALKVTKPRKRRRRPGRVGRNVVLCHVLGAAGSGKSSLLDAFLSRGFSNTYHPTIQPRTAVNTVELPGGKQCYLILDELGELEPALLENQSKLLDQCDVIAYTYDSSDPDSFAYITKLRAKYPHLEELPSIFLALKADLDRTTQRAEFQPHEYTARLGLPAPPLHVSVTWSSIQEVFVHIAEAAMDPSTTFPRTEEDLESKWMSWGIALGAVVCAGAAAVAIWHRVNSSSS

SEQ ID NO: 25791 - protein, 472 aa, Talaromyces stipitatus
  strain ATCC 10500 / CBS 375.48 / QM 6759 / NRRL 1006
MLEFMDYVQLAFAEATRWNQDNSYSSLTAIAESLLDFHVPERLQVHLSSLSTPHFATSYTLGTVGLIDGSVSYLFSTVPLNNTPSQSGVIPLRRLVRGYRQIEAPVPPIRNWGWDAIPSHDSSQIIDSADINQDDIVRKATLLHATLHLPPPSTLNALFQRRISPTTQITAALVSTQGPPLIKSAPSAALLAQISHDTGTFSNEYLFSTDNALFGWRGLWNIGLDPSPGKQSTDKVSLLSAGAEAYYSPISSLVGLSTGLKFTTLPAAGRALSSSSSSSPGSNPSPISSFPYTLTLTLTPLTGSLSTTYSARASPNLAFSSRFGFNVYSWESEMVAGCEIWRKSPRTQPAEADDGLDWARRKMGIVKERAAEKISALSSSSSTPQAVEESEGDSVVKIRVDQSWNVRLLWEGRVKSLLVTAGVSLGPGTFTALSSGPASPTSSSAPVAMAGAPPTSRPSYWQGVGVSILYSS

SEQ ID NO: 25792 - protein, 384 aa, Talaromyces stipitatus
  strain ATCC 10500 / CBS 375.48 / QM 6759 / NRRL 1006
MVNVFSTCAVFLALTTSVIAKPVAEPAITPAPKLLDKRATSCTFSESNGASSASESQKSCSTIILSNVAVPSGQTLDLSDLPDHTTVVFEGETTWSYQEWDGPLLQISGNGITVEGASGAYLNPDGARWWDGKGSNGGKKKPKFFSAHDLTSSSITNLLIQNTPVQAVSINGCNGLNITDMTIDNSAGDTEGGHNTDGFDIGSSTNVVITGANVYNQDDCVAVNSGTDITFSGGVCSGGHGLSIGSVGGRSDNTVETVKFENSEVKNSVNGIRIKATEGDTGTITGVTYSQIILQDISGYGILIEQNYNGSDLNGGTPSSGIPITELTVEHISGSGAVESGGYNVVIACGKGACSNWTWEDVVVTGGKDYGSCSNVPSVASCSA

SEQ ID NO: 25793 - protein, 475 aa, Talaromyces stipitatus
  strain ATCC 10500 / CBS 375.48 / QM 6759 / NRRL 1006
MATKVLGFAAIAALFHKVTCQQAPTPDNIASLLTWKCTNSGGCIQQSTSIVVDWVYHWIHTVNGSTSCTTSSGLDSNLCGSEQECYANCEISPATYDSLGIKTSGNALTLNQYVTSNDNAGKNYEMLQLLSQEISFDVDVSNLPCGENGALYLSEMDVTGGRSQYNPAGASYGSGYCDAQCGTGTWFNGSINSGGLGSCCNEMDLWEANSKATALTPHPCSVEGPYGCSGSACGSTGVCDKNGCGFNPYALGDQSYYGQGFIVDTSKPFTVTTQFVTSDNSKTGTLTEIRRSYVQNGKVIANAVASASSGFSGANSITESFCTTMDSEAGTLGGLNTMGEALSRGMVLIFSIWNDAGGYMNWLDSGNSGPCSSTAGIPSTIEANDPGTSVTFSNIKWGDIGSTVSDTGGSGSSSSSLISTKTSSTTTTSATRTATSSGATQTHYGQCGGMYYTGPTVCASPYTCHVQNQYYSQCL

SEQ ID NO: 25794 - protein, 306 aa, Talaromyces stipitatus
  strain ATCC 10500 / CBS 375.48 / QM 6759 / NRRL 1006
MPSLPVLIDTTTEFDVSSPQNVTQKRSLLLAPPSIAAHEEKLRDIFTTFDRSVTDLQMLDRLSAGFVTLPASTYDLVLVLTDTNGARRNEALELLTRDIFNILTPSMKPSAQLQLQDGPFQANEGREAILAGLVEKHGAFEKPQYQEAAVPLRFGANKRKNKISPEPVKIESVGFVDNYDDDELINEDDLLDEEDLGKPVQQPAECQPETAKKRRRACKDCTCGLAAQLEAEDAERREKANADLNVLKLKTDELNDEVDFTVQGKTGSCNSCSLGDAFRCASCPFIGLPAFKPGEEVRIMNDMAQL

SEQ ID NO: 25795 - protein, 268 aa, Talaromyces stipitatus
  strain ATCC 10500 / CBS 375.48 / QM 6759 / NRRL 1006
MKLTKATSLLALITLPLLAFADVEFIEPRAGSTVKSGDILTAYWKDSGDLPSLLELHEYDLFLCAGGPEIEYSEELALLVPNGLFDKGNSVSFQIRSDLGSEYPDAYFLKMTSRGTNNMTLVNYSERFSVTGMTGTFSELVQYGLLLAANDTAKYHQELKLRKRQVATAIIPAKDVYNVPYPQQTRGLTKYAPMGKRPATTITAKSGPPQFPTSAFEVAHTFLPIPTWQTTLTASRTWTTSGMENPATPAPHPKDDMQIYLRRWADDE

SEQ ID NO: 25796 - protein, 491 aa, Talaromyces stipitatus
  strain ATCC 10500 / CBS 375.48 / QM 6759 / NRRL 1006
MSIDLNWEAATSGPDGEQLAERIRSFIHDKFQQVPLPRFIRSVNVHSFEFGSIAPELEIKDICDPFVDFYEESDSSEDEDGEGHDAESDTSSDRAADSTADKRDMRYGHDDRGNNGHIPNHHDHLRTSQWVAGGTDGHSTQSPLRSPIGLGDHLNAHFRSTTPNILPGVTSNLGYHLMMGNLSGTQTPLAAVAGGTPFGPGWPDAVMNQGSRMTDHTTGRTRREDHNKNETGSPSRPSTAHTNPTQLSHGRSAASSSNNTSNDPTVIYNDHTSSTTATTYGLHEGGDRPRDKHGHRIDQEEPPPSPTPHMRERRPEDFQVICRVKYAGDVKLSLTAEILLDYPMPSFVGLPLKLNITGITFDGVAVVAYIRRRAHLCFLSPEDADALLGDEDDIQHPSYSTANTTTAASGSSTDNNNNNNESNDHPNHPPQPRRRFGSLLQQIRVDSEIGRKENGKQALKNVGKVERFVLDQVRRIFEDEFVFPSYWTFLV

SEQ ID NO: 25797 - protein, 491 aa, Talaromyces stipitatus
  strain ATCC 10500 / CBS 375.48 / QM 6759 / NRRL 1006
MRLSISTLSVAVIWQVTTAQLVGPVGPTTTLEEKNIECNILHYGAKSDNSTDISTALEETFTQCVLKQPGSRLIIPEGEYLLNRSVVLSNGTDWALQLDGVITAAYGGNWTVDRELILQGFAGVDVLNSTINGEGDNKFLLDVLVIVNAVDFEFYSSNGRGAIQGQGYIYRNLNNTDRPRLVRLISPTNASVHDLILVDSPKFHIVLDFALNVEAYHITVRGGNLGSYDGIDAIGTNYWIHDNEVTNRDECVSVKSPSHHALVENLVCNQAGSGVSIGSLNVSAEISNIVARNISIVQGNNIAFIKTYPGGSGYVTNVTFENFRSLTSLYGLSINQYWQNKLTPDTGSVALSNILFRNFSGSVANGTLRPPLYLIANDLTFATNITVEDFSVWTETGTQVLNQISNVFGHGDDSYGPNDGIPSLNPGETPYAYTSTYTITASPTSWQAPTTPKWAVPSTGYGTASPIPVYTPAPLWKPGGVDYDLHYWGSF

SEQ ID NO: 25798 - protein, 293 aa, Talaromyces stipitatus
  strain ATCC 10500 / CBS 375.48 / QM 6759 / NRRL 1006
MGISSVFVALSALVAGGAFALPAPEPVAPAGPFFELRSGNTSLSNLARRAEPVNYNQDYVAGGANVQYSPNQGAGSFSVNYNTQGDFVVGLGWQPGDANPINYSGTFSAQGVGILAIYGWSTNPLVEYYVMEVHDGYQTAGTHKGTLTSDGGTYDIWEHQQVNQPSIQGTSTFNQYISIRQSPRTSGTVTIQNHFDAWANAGMNLGTLNYQVMAVESWSGSGSGQISLSKGTSSGSGGNGGGSGGSGGSGGSGGSTTGAAQWGQCGGTGWTGPTTCQSPYTCKVINPYYSQCQ

SEQ ID NO: 25799 - protein, 483 aa, Talaromyces stipitatus
  strain ATCC 10500 / CBS 375.48 / QM 6759 / NRRL 1006
MATTLIFVMGLWSGLLWSTTVAQASCAAIWAQCGGSGFSGPSCCETGSTCTQLNSFYSQCTPTTQISSASPTGTNPSSVTSLVPSGSSYTSTTSLSTATATQVPYPAVNSSSCGAWALVENVCCPYYCTSNNESESCTSSCSGGCGSPDASMCKSGTMWGEQTTVGTDESWHYSRSTHFGLTSGGACGFGLYGLCTKGSSTANWTDPMLGDTCNAFCTAYPLLCRDPSNVTLRGNFAAPNGDYYTQFWPSLAAEGNPDNYLSCGECFELIRTKADGTDYTVGEDGYTDPIYLEIVDSCPCSANAKWCCGSGADHCGEIDFKYGCPIPKDSHHMDLSDIAMGRLQGNGSLADGVIPIRYKRVPCPKPGNVYIWLRDGAGPYYFSLSAVNTNGVGSVINVEVQGSGQTGWTALERDPNYSSSRPQERYGAWVVPQGAGPFNVPIGIRITSPDGQQIVNTEMITSFTAPASAPSGFWYIDMGVQFT

SEQ ID NO: 25800 - protein, 432 aa, Talaromyces stipitatus
  strain ATCC 10500 / CBS 375.48 / QM 6759 / NRRL 1006
MKSSIIVISSLAHFAVSQTADWGQCGGTNWSGDTTCNAGWYCSYQNQWYSQCVPQSSPSSSATTLSTVISSSTSSISTTSPAGSSSSGSASSFPSTSGTQFVIDGKKGYFAGTNSYWLPFLTNNADVDLVMGHLQQSGLKVLRVWGFNDVNSMPSSGTVWFQLLSNGQQTINTGPDGLQRLDYVVKSAEAHGIKLIINFVNNWNDYGGMNAYVKNYGGNQTGWYTNDAAQAAYKTYIKTVISSYIGSSAIFAWELANEPRCNGCSTDIIYNWAQSTSQYIKSLEPNRMVCIGDEGMGLKVGSDGSYPFGYSEGNDFERTLTIPTIDLGTIHLYPSQWSETDSWGSSWLTAHGQACKNAGKPCLLEEYGSTSHCRSEAPWQSTAVSSVGADLFWQWGDALSTGQSPNDEYSIFYGSSDYTCLVTDHVSAINSS

SEQ ID NO: 25801 - protein, 428 aa, Talaromyces stipitatus
  strain ATCC 10500 / CBS 375.48 / QM 6759 / NRRL 1006
MYWLTNLAPIAWICATALAAAASKGGVLKKGNVCTVTALGGKRDDVQNILEAFSSCGKHGTIIFPEDENYWIATRLNPVVSNVVIEWRGVWTFSDDFDYWRNNSYPIAFQNHHAGFILTGDHITIKGHGTGQIYGNGNAWYNAEQAVTQPGRPMPFVFWNVSEVLVEDFTVKDPPLWSLNIMNGTNMVFNNITCNATAVNAPYGTNWVQNTDGFDTMDANNIQLNGLTYQGGDDCIAIKPRSYNIRVSDVKCHGGNGIAIGSLGQYLEDASVKNVVVDNVEIIRYNEDMHNSAYIKTYMGGRVPQSSYESAGLPNGGGWGTVENILFSNFHIQGANTGPAITQDTGDNGTFKGTSLMAISNVAFVNFTGYLNNVANNRIASVSCSNVHPCYNIDFQNVKLNPSQNVSAYGNVSCSYIESGGVHGLLGC

SEQ ID NO: 25802 - protein, 358 aa, Talaromyces stipitatus
  strain ATCC 10500 / CBS 375.48 / QM 6759 / NRRL 1006
MAIPLVLLLAWLLPTVFAASLTQVSNFGDNPGSLQMYIYVPNNLASKPAIIVAMHPCGGSATQYYGMYDYHTPADQYGYILIYPSATRDLNCFDADTAASLTHNGGSDSLSIVNMVKYTISKYGADSSKVYMTGSSSGAIMTNVLAGTYPDVFAAGAAFSGMPFACLSGAGGADPAMSNQTCSRGQINHTPQEWAAYVHNAYPGYTGQYPRLQVWHGTADNVISYTDFNQEISQWTTVMGLSFTSNQTNTPLSGYTKMIYGDGSRFQAFSASGVGHFVPTDVSVVLDWFGITGGGGGNGGGSGSTTTTTSATTTSTGPTGGCTAAHWDQCGGNGYTGCTSCASPYTCQKVNDYYSQCL

SEQ ID NO: 25803 - protein, 253 aa, Talaromyces stipitatus
  strain ATCC 10500 / CBS 375.48 / QM 6759 / NRRL 1006
MHHSYFLKLILPTLLALTTAAPLTQRNTILNEFLTNLLKYLPAINTTINDATSIITDLDTLLAKLVGAKTTQNQLISASTSGSSCAEWTLIWARGTSEPGNMGVLVGPPLVWALQDIVGTNGLTIQGVNSYSASVAGYLAGGDASGSANMASLITQAHKSCPNTKLIAAGYSQGCQVTHNAISQLDAATAAWIDKVLLFGDPDNGQAIPHVNAANVYTVCHPGDDICLNGDLILVPHLTYAENVAAAAAFATA

SEQ ID NO: 25804 - protein, 465 aa, Talaromyces stipitatus
  strain ATCC 10500 / CBS 375.48 / QM 6759 / NRRL 1006
MKFKRDVLLGVVSLVCLAQPSLQQASACASSYSQCGGIGFTGATCCPTGWSCQTQDSYYAQCLSGTVFLQEFLTFLQPTSSAGSGGSTGPVTTSSPPTTRTTPYRTSTTFLTGAALASHTQVPYTTLECDNADCGSGTIYPDITTVNDSMPWHYSRSTHFGETPAGACGFGLYGMCTTASVSGIDLGDDCAQFCSMYPDLCADPANYTLRGNFAAPNGNYYTQFWPMLPSLDTRAEQDNYLSCGECFELVRTYPNGTLYTTSDSGYAPPIILEIVDSCPCSANTKWCCGPGVDQCQEVSDFKYGCPLPNGSIHLDLSDVAMTRAQAGVLVEGVIPTQYKRVPCPKKGNVYLWLRGSAGPYFFQITAVNAAGLGSIVGFEIRPDGQSDWLALVQEDDYPEGHPQERYGAWTLPANAGPINLPMGVRLTSATGEQIVNEAVITNWTAPNTAIAGYWYINMGINFSQL

SEQ ID NO: 25805 - protein, 242 aa, Talaromyces stipitatus
  strain ATCC 10500 / CBS 375.48 / QM 6759 / NRRL 1006
MRYLSFYFLSFHTVLASNYSLPQTLTRAPPTPTLEQRAGTIIVVTVTVTPSAAPVSPSYTNPELFEYDILNQTNYYRRQHNATGVIWNDTLATYAKQWAKPCNWKHSGGPYGENLAEGYSNVTAAVDAWAIESKKYDYNRPTGFSEKTGHFTQLVWKATTDVGCGLADCSANLNGDNGGKTGKAVGWFLVCEYWPPGNVVGDHDKYFEENVEPLVSLGTWLKVNVFDVWLMIVFAVLILTFL

SEQ ID NO: 25806 - protein, 391 aa, Talaromyces stipitatus
  strain ATCC 10500 / CBS 375.48 / QM 6759 / NRRL 1006
MMFWTASLLLVIPVVTAQSPVYGQCGGNGWSGATTCASGSCCTYSNDWYSQCLPCSGGGGGGTSTTLTTTTKTSSTTSSTSTGASNPTTCPLPAQYKWTSTGPLANPASGLLSLKDFSHVPYNGQHLVYSSDVNSGGNYGSLNFALFSNWSQMASASQSQMSQGAVAPDLFYFAPKKIWVMGYEWCASAFCYLTSSDPTNANGWSSAKPLYEGSLSGGNGPIDPAIIGDDENMYLFFAGDNGNIYRTSMPIGNFPASFGSSAQTILTDSTYNLFEAVQVYSVQGQNLYLMIVECIGASGSRYFRSFTATSLGGSWTPQASTESNPFAGAANSGATWSQDISSGDLIRSSADQTKPVDPCNLQLLYQGRDPSSNGGSYNNLPYRPGLLTLAK

SEQ ID NO: 25807 - protein, 243 aa, Talaromyces stipitatus
  strain ATCC 10500 / CBS 375.48 / QM 6759 / NRRL 1006
MKLTYFALLHALVGAACAYQATTTASSLFRDPNEISTDKGNGVYTAAGSQALYDTAGATWCGAGCGKCYNLTSTGSSPCTGCGLGGAAGESIIVMVTNLCPYNGNQQWCPEVGSTNQYGYSYHFDIMAQSEIFGDNVVVDFEPVDCPGQATSDWETCVCYGQTATDVTPVGLTGGGGSSGSSSTSPTNPTTSSSTRTSTSSSAGATQTVYGQCGGGGWTGATVCASGSTCQVVNQWYSQCLPS

SEQ ID NO: 25808 - protein, 387 aa, Talaromyces stipitatus
  strain ATCC 10500 / CBS 375.48 / QM 6759 / NRRL 1006
MVNSKTVVSALALSALAAAAPAPSSTTSFSINQVAVKKPAIHPAVKYAKALAKYHAEIPSNVASAAASAQSGSATNKPTADDEEYVTPITAGSSTLHLDFDTGSADLWTYSASTRGVGSHSTYDTSTGKKVSGASWQISYGDGSSASGVVYKDKVVVGGVTASSQAVEVATQVSSEFSQDTSNDGLLGLAFSSINTVSPTPQKTFYDNVKSSLAKPVFAVTLKHQAPGTYDFGFIDKSKYKGSLAYTNVDNSQGFWQFTADGYSIGGSGGGSSFSAIADTGTTLVLLDDSIVDEYYSQVQGAQNDSSQGGYVFDCSADLPDFGVQIGDYTAVIPGKYINYASTGSTCFGGIQSNSGIGFSILGDVFLKSQYVVFDGDNLQLGFAAQA

SEQ ID NO: 25809 - protein, 328 aa, Talaromyces stipitatus
  strain ATCC 10500 / CBS 375.48 / QM 6759 / NRRL 1006
MKANYFPLWALAGSASAYLATTTRYYDGQEGACGCGGSSGLDSWQVGSSSTGFYTAAGSQALFDTDGSSWCGGGCGKCYNLTSTGTSACNGCGEGGVAGESIIVMVTNLCPYNGNEKWCPSVGSKNDYGYSYHFDIMAESEVFGDNVVVNFEPVACPGQATSDWETCVCYGQTDTDSTPAGFSTVAGSSEPTATSSTSTAAASSKTSTTLVISTTPVKEVASSSTSSTSTVKPVTETSPAAVAPTSTVPSVPEGAATTSTYSLTLTTVVTETITVWETPTSTSGSSAAVQTLYGQCGGINWTGATTCATGATCKVQNPYYYQCVSSSN

SEQ ID NO: 25810 - protein, 415 aa, Talaromyces stipitatus
  strain ATCC 10500 / CBS 375.48 / QM 6759 / NRRL 1006
MNSFRVLSSLGLLASSVLAGPISIPKRQTSTGQNVVYWGQNGGGIIENPDLAAYCTGSEGIDIIVLAFLYQFGNGVTVPGGSFGQTCSVLATSGTSQSCDAVASAITTCQNKGINVFLSLGGGAGGYSLTSVSEAESIGQYLWDAYGNPSSTSVSRPFGNAVVNGWDFDIENASGSQYYPYLISKLRSNFASDKNNKYYISGAPQCPIPEPNMGTMIQDSEFDMLFIQFYNNNNYTHPCALGINGDAAFNYAQWDSFISTSNSSSAELFIGVPAAPLAANGADTGSIYYATPNQLATIVSATEGNSSFGGVMLWSAGFSDSNVNNGCTYAQEVETILKDGEVCSGSYSVTQTLTPVAPTPSFSGTATGTSTATPTGTPVPEWGQCGGQGYTGSTVCDSGLKCVAEGAYWSSCQPA

SEQ ID NO: 25811 - protein, 306 aa, Talaromyces stipitatus
  strain ATCC 10500 / CBS 375.48 / QM 6759 / NRRL 1006
MLSQSLALSILVGGAFSIPVENRANCPNIHVFGARETTVSPGYGSSITVVNDVLNNYPGSTAEAISYPACGGQSSCGGISYSSSVAQGIAAVASAVNSFNSQCPSSEIVLVGYSQGAEIMDVALCGGGDPNQGYSNTAVQLSASAVSMVKAAIFMGDPLFRAGLPYEVGTCAAGGFDERPAGFSCPSAGLIQSYCDSSDPYCCNGNNAATHQGYGAEYGNQAFAFIKSKLSGSSTGGSGGSGGSGGSGGSGGSGGSGGSGGSGGSGGSSGTVAQWGQCGGQGWTGPTQCVSPYTCTAINSYYSQCL

SEQ ID NO: 25812 - protein, 406 aa, Talaromyces stipitatus
  strain ATCC 10500 / CBS 375.48 / QM 6759 / NRRL 1006
MVAVKPLILALAAGHLAHAQLNTAAKAAGLLYFGTAVDNGDLSDSQYLPNLETDDFGQITPANSMKWQPTEPSQGSYTFSQGDQIASLAKTNNDYLRCHNLVWYNQLPSYITSGSWTNETLIAALKEHINGVVTHWKGQCYAWDVVNEALNEDGTYRQNVFYQHIGEAYIPIAFAAAAAADPNAKLYYNDYNIEYPGAKATGAQNIVKSIQAAGARIDGVGLQAHFIVGQTPSLASQKANMAAFTALGVDVAITELDIRMTLPDTSALQTQQSTDYQTTTTACVQTKGCVGITLWDFTDKHSWVPGTFSGQGDACPWDSNYKKKPAYYGILAGLQSGAGGSTTLTTTTTSTPTTTSSPATTTTTGAGSGTGAAHWGQCGGNGWTGPTTCVSPYTCQVVNPYYSQCL

SEQ ID NO: 25813 - protein, 453 aa, Talaromyces stipitatus
  strain ATCC 10500 / CBS 375.48 / QM 6759 / NRRL 1006
MLQYLPVIAAAILTGVEAQTQSVWGQCGGQGWTGATICAAGATCSAINSYYAQCTPAAAASTTLVTKTSSTSVGTTSPATTPTTKPSTTAAASGNPFSGYQLYANPYYSSEVHTLALPSLTGSLAAAATKAAEIPSFVWLDTAAKVPTMGTYLANIQAANKAGASPPIAGIFVVYDLPDRDCAAAASNGEYTVANNGVANYKAYIDSIVKQLKAYPDVHTILIIEPDSLANMVTNLSTAKCSEAQAAYYECVNYALINLNLANVAMYIDAGHAGWLGWPANLSPAAQLFAQVYKNASSPASLRGLATNVANYNAWSLSSAPSYTSGDSNYDEQLYINALSPLLTQNGWPNAHFIMDTSRNGVQPTKQQAWGDWCNVIGTGFGVPPTTNTGDPLEDAFVWVKPGGESDGTSNSSATRYDYHCGYSDALQPAPEAGTWFQAYFVQLLTNANPSLT

SEQ ID NO: 25814 - protein, 308 aa, Talaromyces stipitatus
  strain ATCC 10500 / CBS 375.48 / QM 6759 / NRRL 1006
MKGSLIIGALCALGAVASPLNMRVLVTDIEVTVVTITVTETPGYTPAAATTTVPASTTSVAPTTVPVAGAANLNNEYPRPPLTSTSTSTTLVVPSSSSTTFVAPEPTTTVAAAPAPTPVEPSTTSTSTSASTSPSVAPSSAGSSYQSLILNSHNIHRSNHSAPALTWNETLAESALKLANTCDYHHDTSLGPAANYGQNIAFGIDSDKVDEIITNMMYNDEMMFYQDLYGQANPDMSKFEKWGHFSQIVWLDTTSVGCATVTCQPLAESHSSLALPFTVCNYYPAGNYGGEYADNVLQPKGNAMVVAS

SEQ ID NO: 25815 - protein, 375 aa, Talaromyces stipitatus
  strain ATCC 10500 / CBS 375.48 / QM 6759 / NRRL 1006
MRSFIGLAGLACLSSVVLAVPAPAPTAPAKLEDRAASCTFSGSNGAAAASKSKTSCSTIVLSSVAVPSGTTLDLTNLNDGTKVIFEGTTTFGYAEWSGPLVSVSGNDITVEGASGAVLDGDGSRWWDGKGSNGGKTKPKFFYAHNLKSSSISNIKILNSPVQVFSIDGAQTLTLDHITIDNSAGDSQGGHNTDAFDVGDSNGVTISNAIVQNQDDCLAVNSGTNIIFTGGTCSGGHGLSIGSVGGRSDNTVQTVHIENSTIKNSQNGVRIKTVYGATGSVSGVTYKDITLSGITKYGIVIEQDYENGSPTGTPTNGVPITGLTIDGVTGSVTSSATEVYILCGSGSCSNWTWQGVNITGGKKSSSCKNVPSGASC

SEQ ID NO: 25816 - protein, 526 aa, Talaromyces stipitatus
  strain ATCC 10500 / CBS 375.48 / QM 6759 / NRRL 1006
MSALNSFKMYKNALILGSLLATAHAQQIGNLTAETQPSLSWSTCTSGGSCTSKSASITLDANWRWVHSVNGSTNCYTGNTWDTSICDTDTSCAQDCAVDGADYSGTYGITTSGNSLRLNFVTGSNVGSRTYLMADKTHYQLFNLLNQEFTFTVDASTLPCGLNGALYFVSMDADGGVSKQPNNKAGAQYGVGYCDSQCPRDLKFIGGQANVEGWQPSSNNSNTGLGNHGSCCAELDIWEANSISEALTPHPCDTSSQTVCTGDACGGTYSNDRYGGTCDPDGCDFNPYRVGVTDFYGPGMTIDTTKPVTVVTQFVTNDGTSSGTLSEIRRYYVQNGKVFAQPSSKIDGISGNAINSDYCSAEISTFGGNPSFTKHGGLAGVSTALKNGMVLVMSLWDDYSVNMLWLDSTYPTNATGTPGAARGTCSTSSGSPKTVEANSPNAHVIFSDIRVGPLNSTFSGSGTSTPGGGSSTTTSPGSTTTTPGSGSGSGVASHYGQCGGQGWTGPTTCASGFTCTVINPYYSQCL

SEQ ID NO: 25817 - protein, 564 aa, Talaromyces stipitatus
  strain ATCC 10500 / CBS 375.48 / QM 6759 / NRRL 1006
MAFNFNWSPLMADAGFYTRAQDLLTAALNKSPKPPIIVDDIKVTELNLGSIPPDLEILEVGDLAEDRFRGIFKMSYNGDAFLTLKTRVQANPLNTFLVTRPSFASPKPLAAAAGLTIPLQITLSEFRLSGFVVLVFSKQKGITVVFRNDPLESLKVSSTFDSISFVRDYLQKAIEGQLRALFMDELPAIIHRLSLRLWVPEYRDRESESVNTLDQSSGPGQDPLASPPQDPVDASGNALNPSEVASLSLDSGVEIHSLFSQKNLLRLAALTDSQRTLSLFTPSIKDVVYRAWTASTELGDSNTLTSPASPVLSRAQSHIGSLHSFVDNASTISMQSGGSSNFSGHGLNLRSGRHPRPHGKKRKKRVVDLRRPKTTDDMESVSGESVFSSENATSAPTIFSSPAQFSEEKNDDPVTPPLAPQNDLHLPTIHERRRISQGEHTLTRRSVPSMSEVAQPSSSRNSAAMIADTWPDPDATPRNSIRLPSSDRANNPLTTAHLPSSAIQYPPPIPDNNDPRQQAWLSKMAAELARRIQEEKVGPSGSRPFPDFWDDHSREEIPPPAYGH

SEQ ID NO: 25818 - protein, 434 aa, Talaromyces stipitatus
  strain ATCC 10500 / CBS 375.48 / QM 6759 / NRRL 1006
MKFNFSLKLLLVASTALAAPSIEERTTAVSRNDIIGPKNSFKPLPETCKRHKVCHVRSHGDGKDDSDNILDALRTCNNGGRVIFDQEYTIGRALDLQFLKHIDLDITGTMKFTNDTNYWINNAFQITFQNSTTFFKLGGQDVNIYGGGTIDGNGQVWYDLFTQNATLQRPILMGIIGLEGGSIGPLKLRYSPSWYHIVANSSGVVFDGIDISGYSSSGNVAKNTDGWDTYRSDNIVIQNSVINNGDDCVAFKPNSTNILVQNLHCNGSHGISVGSLGQYAGETDIVENVLVYNISMFNASDGARIKVWPGIVSELEASLQGGGGSGSVKNVVYDTMSVHNVDWAIELTQCYGQSNQALCDEYPSNLTISDIWFKNFSGVTSTKEKNKIATLVCSSPNVCSNIFAEDINVVSPSGYNQAVCTNVDDSLLQLNCTK

SEQ ID NO: 25819 - protein, 512 aa, Talaromyces stipitatus
  strain ATCC 10500 / CBS 375.48 / QM 6759 / NRRL 1006
MKLLTVVGKIILLARTATALNNGLAVTPQMGWDDWNAFGCSLSQNLVLSTANTILKTGLRDLGYHYIILDDCWSSGRTSSNVLIPDANKFPNGMKYLGDQLHAQGFGFGIYSSAGTKTCAGYPGSLGYETVDANTFASWGVDYLKYDNCNNNGQSGSQAASSARYNAMEKALAASGRNILYAICNWGQDSPWIWGPSVGNSWRITGDISDNFNTQNSACPVPNSGGYDCSVTQIMSKQATISQYSAKGGWNDLDMLEVGNGGMSDSEYVAHFSVWAAAKSPLIMGNDMSKLIASDYSILANPAIIAVNQDPLGVAATYRWTRNNVQLWSGPLVSTTGSSVNDQVVVLYNNGGSSTTVSVALSDVFGSSSSVPSSQLEIRDLWGSRLSNSQAQTILNQGASANPSWLYNATAKSYATGLSQGDSMLLGTSIGSVTGASGTIQQTVSGNGCRVFRLRASKASSTSTTTTTTTSSSGQSLQTQWGQCGGQGWTGPTECQSPYTCQVQNDYYSQCK

SEQ ID NO: 25820 - protein, 399 aa, Talaromyces stipitatus
  strain ATCC 10500 / CBS 375.48 / QM 6759 / NRRL 1006
MKTSTALICLGLMASAVIAAPHRLQARGPGGEVVVYWGQNAAAASENNDLSTYCTTDSGIDIVVLSFLYEYGNGNTIPAGVIGNDCSISTSGQGTNCDALASQIATCQSNGVKVILSLGGAVGAYSLTSQAEAETIGQNLWDAYGKSSGGSIPRPFGSTFVNGWDFDIEANSGNQYYQYMISKLRSNFASDSSNTYYITGAPQCPIPEPNMGEIIQNAQFDYLWVQFYNNGYCSYPNTLNYADWVSYVSGTPSANAKIFIGVPASELGSTGTQSGAVYYQSPSVLASTVASFDTSSNWGGIMMWDAAFSDANVINGCNYAQQAHSILKTGSPCGGSGTTPPSTTTTPTQTTSTATATVTATGVPVPQWGQCGGEGYTGSTVCATPYTCVKESQYWSSCQ

SEQ ID NO: 25821 - protein, 419 aa, Talaromyces stipitatus
  strain ATCC 10500 / CBS 375.48 / QM 6759 / NRRL 1006
MSLGHSFKRAGLFSLCLIATGTLVTAGPCDIYSSGGTPCVAAHSSTRALYSSYSGPLYQVKRNSDSATTNISPVSAGGIANAAAQDSFCSGTTCLISIIYDQSGHGNHLTAAPPGGFSGPGPNGYDNLANAAAAPVYLGGQKVYGVYIAPGDGYRNNAANGTATGDGAEGLYAIFDGTHYNGGCCFDYGNAETSSRDTGAGHMEAIYFGNCNVWGTGSGNGPWIMADLENGLFSGASAGKNTGDPSISYRFVTAVVKGEANQWAIRGGNSQSGSLSTFYSGGRPSGYNPMHKEGAIILGIGGDNSHGAEGTFYEGVMTSGYPSDATENSVQANIVAAKYGTSASSGTTTTGTGTQPSSGSGQVHWGQCGGSGWTGPTSCEAPYACQTQNPYYAQFDGFPWETREYLGILSVALQRRVTL

SEQ ID NO: 25822 - protein, 663 aa, Talaromyces stipitatus
  strain ATCC 10500 / CBS 375.48 / QM 6759 / NRRL 1006
MKLSTSLITLIATVQAQQTAWGQCGGTGWTGPTACVSGWTCNYVNPYYSQCIEGQSTSSSPSTTSTPSTTTSPVSSSSSSSSSAIPFSYNSKSFLLNNQPFQIIGGQMDPQRIPRAYWRQRLQMARAMGLNTVFSYVYWHSLEPSQGVFDFTGNNDLITWFQTVQEVGLKAVLRAGPYPFLTAASSYMQRLAQELHDQQTTQGGPIIMVQVENEYGNYGSDHSYTQVIGNIFKQNWQVTLYTNDGGNQGALSGGQIPGILAEIDGNPQGGFAARNQYVTDQSSLGPLLDGEYYVTWFDTWGPHSGYSTDEGNQGAINGVINDLSWILSNNDSFSIYMFHGGTSFGYGNGGENYGNLTPFITSYDYGAPLDESGRITPIYNDIRNMISNHVPSGTIPSVPSVPTMWSMPTTTLQPVARLFDQLPSATNSSLPQTMEQLGQSFGYVLYSHQATSSISGAVKSGDHARDRVIVYKNGVKQGVIDSIYSHPATVNVQLSSGDTLWLLVENLGRVDYGSPIVDQRKGIVGNVTIGGSVISNWEIYSYPLNTPPSTVDTSNSSISIPSGSQPVFYKGSFVAPSSDSASDTYLTLPGGIKGVVWVNGNNLGRYWIIGPQQSLYLPGCFMKTGSNEIVVLELEPQAGTRVAYGVTSRTWGNNPDPDCNNCS

SEQ ID NO: 25823 - protein, 833 aa, Talaromyces stipitatus
  strain ATCC 10500 / CBS 375.48 / QM 6759 / NRRL 1006
MFPDENGIDGWLRYAPLSSELASQFKRYGNIIALRNDESSPVRTAAKEIQHGLKRILNQEANIGHDLITGSQVEGPATIVIGTVNSFSHAGGDVSHIAQLKEDGFWLHGDDYDNVQILGQNERGALYGAFAFLMLLAQGKQCPSAHVSNPSAPIRWVNQWDNLDGSIERGYAGPSIFFRDMVVQDDLTRVSQYARLMASVGLNGIIVNNVNSHHDLLSPRNLAGLGRIANAMRPWGVRIGVALFFDTPKILGGLSTSDPLDPGVIAFWDKITAQLYQHVPDLIGYLIKANSEGQPGPLTYGRTLADGANMFADALKRHGAGVVVYRAFVYNHHLDESNWKNDRANAAVEYFKDMDSLFEDNVLVQIKYGPIDFQVREPTSPLFAHLRKTPTIIEFQVAQEYLGQQSHVCYLPPLWKTILDFDLRVDGKPSLVRDIVSGERFGWNQSGYAAVVNVGSDSTWLGSHLAMSNLYAYGRYTWDPTSNEVDVIQDWTRLTFSSHSTVVDTVTSISMESWPTYENYTGNLGIQTLCEITKTCHYGPRPDAADGNGWGQWTRADAHAIGMDRTVATGTGYAGQYPVEVAEKFEKVKTTPDDLLLWFHHVPYTHKLKSGKTVIQHFYDAHYEGAANAQTFAPRWKAIQGLIDDSRFQHVLFRLVYQAGHAIVWRDSINEFYKAKCSIPDEQGRVGNYPWRIEAESMDLTGYAVVPITPFEAASGGKAIITTSNDKPGTAKYTVPFESGVYNIAVNYYDHLGGTSQYKLFVGGQLIGEWAGDLSKVLLHDFSDLRDGHSATRITFDTVHVNKGDVIELIGTPDGTELAPIDYVSFLPPGLVD

SEQ ID NO: 25824 - protein, 376 aa, Talaromyces stipitatus
  strain ATCC 10500 / CBS 375.48 / QM 6759 / NRRL 1006
MRSFITLTGLAIFCSSVALAAPAPAPIAAAKFENRASACTFSGSNGAALASKSKTSCSTIVLSNVAVPAGTTLDLTGLNEGTKVIFEGTTTFGYKEWAGPLVSVSGSDVTVEGAPGAVLNGDGARWWDGKGSNGGKKKPKFFFAHNLKSSNISNIKIENSPVQVFSINGAETLILDSITIDNSVGDSTGAHNTDAFDVGDSNGVTISNANVQNQDDCLAINSGTNIIFTGGTCSGGHGLSIGSVGGRSDNTVKTVHIENSTIKNSQNGVRIKTVSGATGSVSGVTYKDITLSGITKYGIVIEQDYENGSPTGKPTSGVPITGLAIDGVTGSVSNSATGVYILCGKGSCSNWTWEGVKITGGKKSSKCENIPSAASC

SEQ ID NO: 25825 - protein, 840 aa, Thielavia terrestris
  strain ATCC 38088 / NRRL 8126
MKHQSVAQLLVAAVAAPVTAAAASWKNVNIGGGGGFIPSIVFHPTAKGVAYARTDIGGLYRLNSDDSWTPVTDSLATDARWGDWGIDALALDPQDPNKVYAAVGMYTNSWDPNPGSIIRSSDKGATWASTDLPFKVGGNMPGRGMGERLAVDPANSNILYFGARSGNGLWKSTDGGVTWAKVTSFPNPGTYRPDPTDTTGLNSDIIGLTFVTFDSTSGLTNGATSRIFVGTADNITASVYVSTDAGATWSAVPGQPGKYFPHKCRLQPTEKALYLTYSDGAGPYDGTLGAVYRYDLTTSTWKDITPVSGSDLYFGFGGLGVDMQKPGTIMVASLNSWWPDAQIFRSNDSGTTWTKIWEWTSYPNQNWYYALYTDNAPWINAGFISQDTKRLGWMIESLEIDPFDSNHWLYGTGLTLYGGHDLTKWDTATRNVTISSLAVGIEEMSVQGLASVPGGSELLVAVGDDCGFTFQSSSDLGTPPETNWMTPEWSTSSDVDYAGNKPQNVVRVGNANGSPQIALSTDGGATWYADYATDNTKSGGTLAFSADADTILWSSGNSGVLISQNQGTFTAVSAVPSGAAIAADKRNNTVFYAGSGGDFYRSTDTGTTFTKTASAFGSAVSSIQDIAAHPAVAGEVWVSTNAGLFRSTDYGVTFAQVGAGSLTKTQQIAFGKGTGGANSWNLYAFGTGSAGAKLYASADNGATWVDIQGTQGFGAISANKVVGSGNVAGQVYVGTNGRGVFYAQVSVAGGGGGSSSTARPSSTSTSTTSKTTLTTSTIKTTSVTTTSTSTVKSTSTTTSAAPQATQSHWGQCGGQGWTGPTVCASPYTCQKQNDWYWQCL

SEQ ID NO: 25826 - protein, 426 aa, Thielavia terrestris
  strain ATCC 38088 / NRRL 8126
MLPLTLLLPLSAIVLPVHGEVVKNGSTCIVTPLSDTNAAFAVPRSDGGGLARATVDDTPQILSAFSQCGQDGTIILRPGTYHIRQVMDTTNLRNVSVEIYGTLIWSADNLSYWRQKSFSVTYAGRQTAWRIGGRDIALRGFGQAVFDGNGQAWIDLARGASNLDGRPISLTVWHGTNVLIDGITWRMAQFWHTFVAYSQNVTMTNLVMNTLSSNSYSSQNTDGTDTWNSKDITISNWTVTCGDDCIAIKGNSSNVHVSNVVCHESGAMTIGSVGSNARQPDYVENIVFENITAIHSSNSAWIKTYPGTGYVRNVTFRNIYGEDVNQPIYVTSCIYSYQNCDSSHLAISDIRWENITGTSRYNVAAAIHCSGAAPCDNLHFSDINIKPKNGGTAKVLCSNIKNQATMGLQCTGPCPGSHPQQLSGNV

SEQ ID NO: 25827 - protein, 398 aa, Thielavia terrestris
  strain ATCC 38088 / NRRL 8126
MSAEPSSRSLALVIAAASLVAVARGAYPLTTDSNCNCYKTNLTTSNYFSHHQFFDFRSLWQYVNVPQPIDSFEGNAQAQPPSPYFTNPAFADAWDIQNWNNTALMALNDSTISDATVKMVNSPNNIYIEQDNGATHLTLRTVRHATFQSAAEIESQSQGFQFLSVRMRARTTGAKGAVTAMFTYRPPPTPLNTQLVQEADLEIRTEDPPMYVQYTNQPSWNSTGDIPAATRNVTLPDGWRWSDWAEYRMDWTPGSSTWYVNGRLVSQITFQAPRDPSQVIFNSWSDGGSWSGPMQVGSQAYLQIQWIEMVYNSTDPGAGRTGGCRNICTIDETTKLGTPALLTGGSFPSQPGNPGNAGPAGCVSAKYGQCAGKNWNGCRNCAAGSTCRYQNDYYSQCL

SEQ ID NO: 25828 - protein, 299 aa, Thielavia terrestris
  strain ATCC 38088 / NRRL 8126
MRSTPVLRTTLAAALPLVASAASGSGQSTRYWDCCKPSCAWPGKAAVSQPVYACDANFQRLSDFNVQSGCNGGSAYSCADQTPWAVNDNLAYGFAATSIAGGSESSWCCACYALTFTSGPVAGKTMVVQSTSTGGDLGSNQFDIAMPGGGVGIFNGCSSQFGGLPGAQYGGISSRDQCDSFPAPLKPGCQWRFDWFQNADNPTFTFQQVQCPAEIVARSGCKRNDDSSFPVFTPPSGGNGGTGTPTSTAPGSGQTSPGGGSGCTSQKWAQCGGIGFSGCTTCVSGTTCQKLNDYYSQCL

SEQ ID NO: 25829 - protein, 481 aa, Thielavia terrestris
  strain ATCC 38088 / NRRL 8126
MAQKLLLAAALAASALAAPVVEERQNCGSVWSQCGGIGWSGATCCASGNTCVELNPYYSQCLPNSQVTTSTSKTTSTTTRSSTTSHSSGPTSTSTTTTSSPVVTTPPSTSIPGGASSTASWSGNPFSGVQMWANDYYASEVSSLAIPSMTGAMATKAAEVAKVPSFQWLDRNVTIDTLFAHTLSQIRAANQKGANPPYAGIFVVYDLPDRDCAAAASNGEFSIANNGAANYKTYIDAIRSLVIQYSDIRIIFVIEPDSLANMVTNLNVAKCANAESTYKELTVYALQQLNLPNVAMYLDAGHAGWLGWPANIQPAANLFAEIYTSAGKPAAVRGLATNVANYNGWSLATPPSYTQGDPNYDESHYVQALAPLLTANGFPAHFITDTGRNGKQPTGQRQWGDWCNVIGTGFGVRPTTNTGLDIEDAFVWVKPGGECDGTSNTTSPRYDYHCGLSDALQPAPEAGTWFQAYFEQLLTNANPPF

SEQ ID NO: 25830 - protein, 86 aa, Thielavia terrestris
  strain ATCC 38088 / NRRL 8126
MYRTARATAVIAGALERLSALSSPGAGAQQNPAVVADQARGAVLFSCCDPADAVCGGTRFILPAHVLYALEATGPAAAFLEREDGF

SEQ ID NO: 25831 - protein, 389 aa, Thielavia terrestris
  strain ATCC 38088 / NRRL 8126
MHLLTWTSFLSLTLAAPVILPRASQLIPGHYIVKLKDGASESSLQNAISHLNSAPTKHVYRAGSFKGFAAPLSPQVLASLRKLPEVEFIEQDAVVTINSVVTQNNVPWGLARISHRQVNATTYLYDSSAGTGTCAYIIDTGIQVNHTQFEGRATFLANFIDSTDTDLNGHGTHVAGTTGSAAYGVAKQTRLFGVKVLDASGSGSLSSVIAGIDFVASDSANRTAAGQCANGSVANMSLGSGRSSTVNAAVASAVAKGVFFAVAAGNSDDDAAFYSPASEPTACTVGATDSSDARAWFSNYGSVVDVFAPGVDVLSSWIGASGTETNTISGTSMATPHITGLGAYLLGLLGRTTPAQLCQHIKDIATLGTITDLPDGTINAIAYNGISDA

SEQ ID NO: 25832 - protein, 297 aa, Thielavia terrestris
  strain ATCC 38088 / NRRL 8126
MVGFSNIVLGLSAAAATLAAPTAERGAANFVLHPDHPLARRIGNLTARSNPSYTQNYQTGGTVNFTPTGTGFTLNYNVQQDFVVGVGWNPGSNQPITHSGTFTVNSGLGSLSVYGWSTNPLVEYYIMEVNDGITVGGQQMGTVESDGGTYTIWKHQQVNQPAIAGSGLYTFWQYISIRDSPRTSGTVTVQNHFDAWAKLGMNLGTMNLQVVAVESWSGSGSAQQTVYNGGSGSTGGSGGGNGGSSGGNGGSSGGSGGSTGTCSALWGQCGGQGWTGPTCCSQGTCKAQNQWYSQCLQ

SEQ ID NO: 25833 - protein, 627 aa, Thielavia terrestris
  strain ATCC 38088 / NRRL 8126
MTTVVRICVCGDEGTGKSSLIASLVKDTFVANKIQSVLPQVTLPPTIGTPENVTTTIVDTSARPQDRTTLRKEIRKCNVILLVYADHYSYERVALFWMPYFRSLGVNVPVVLCANKSDLAGSGSTPQVFDEEMLPVMAEFREIDSCIRTSAKEQHNVIEVFYLCQKAVTHPIAPLYDHKECQLKPACVAALKRVFYLCDKDQDGYLNDEEMHEFQEKSFEKPLLPEELNNIKLTVSKAVPTSSIEKGLDVHGFLYLNKLYAEKGRHETIWFILRKHHYTDSLSLEDSFLHPRFDVPDYASAELSPAGYRFFMDLFLTFDKDNDGGLNDQELAALFAPTPGLPQSWLETSFPSSTVRNEAGHITLQGWLAQWSMTTFLEPKTTLEYLAYLGFEGPNARDLTTAALKVTKPRKRRRRPGRVERNVVLCYIVGSAGAGKSSLLDAFLNRPFDGLYHPTIKPRRAVNSVELPGGKQCYLILEELGELEPAILENQAKLDACDLICYAYDSSEPDSFSHIVDLRKRYPQLDELPAIYTALKADRDKTTQRSELQPDAYTAALNMAAPLHVSVTWNSISELFVALAEAATNPSTAFPKSEEPPDRTSLYMALAATSCAALAAFMIWRRSTNSV

SEQ ID NO: 25834 - protein, 775 aa, Thielavia terrestris
  strain ATCC 38088 / NRRL 8126
MATTLLSLLGAAALAGRASAVCSRGGCIADSCARAVRFDTTLVPSASRVADCSSFLEVTATPSASTVWVTEDLAAATVTVTSELVQVERRQVTAQSASPANTIPAYASACSVASRYSSACSCFGVTGATVTAATPVVTSTTTVATTVTEVDYESPPLASSSVVFPSDDSWTATYTYSEYTLPVFTSAPDPTIDITYPTPSTTCLLDATPTGDSFYLLAPSAGYMFKRDSGLGPVDPPADEAAAEALMANWNPPTFEFQVAQDAAPGLFDLVVHDGTDSALYVALDVTSGEVTLVSSSTNGQVQDGRCTTVFGVSCKGSLIVEYGSTSYVWTATNSSTIATPGTPPANNTTPLNTMVLLPTRLATPFSLNATVSKRRSSRRALFKRDHSQDGVAPRCPGFPYGTVYAASNGVSPSPPNGCGPDGEWYSSLIPNLDFGGCCNSHDTCYDTCSEWFEDCNDKFHSCMLDTCASKYDHWYNFFLRPGCEAAADLYYWAVTGETAQSHFQSGSKAECSCNCADGNSAVCTPGGICQKVRGPGANDSGNCGGCGRNCGPKAHCQDGNCVCNPAPPTPDQCGSLCLDFMTHPRNCGGCGNVCASGYCYEGACFTPPAHPDQCYPVDAVRNGDFSNGTAYWTTVGAELAEAVSGSVPLPTISGNPPPSYLVIFMDWSTEAVISQTVRMCPGVQYQLDFLAAAARTFGFTITLGGQVVVDHSPISNTGGWFSQGPFDLPVLAAGEAGTTQGDDFFLETELAIHAQGPDVSVDMIGLGAISIHTI

SEQ ID NO: 25835 - protein, 526 aa, Thielavia terrestris
  strain ATCC 38088 / NRRL 8126
MHAKFATLAALVASAAAQQACTLTAENHPTLSWSKCTSGGSCTSVSGSVTIDANWRWTHQVSSSTNCYTGNEWDTSICTDGASCAAACCLDGADYSGTYGITTSGNALSLQFVTQGPYSTNIGSRTYLMASDTKYQMFTLLGNEFTFDVDVSGLGCGLNGALYFVSMDEDGGLSKYSGNKAGAKYGTGYCDSQCPRDLKFINGEANNVGWTPSSNDKNAGLGNYGSCCSEMDVWEANSISAAYTPHPCTTIGQTRCEGDDCGGTYSTDRYAGECDPDGCDFNSYRMGNTTFYGKGMTVDTSKKFTVVTQFLTDSSGNLSEIKRFYVQNGVVIPNSNSNIAGVSGNSITQAFCDAQKTAFGDTNVFDQKGGLAQMGKALAQPMVLVMSLWDDHAVNMLWLDSTYPTDAAGKPGAARGTCPTTSGVPADVESQAPNSKVIYSNIRFGPIGSTVSGLPGGGSNPGGGSSSTTTTTRPATSTTSSASSGPTGGGTAAHWGQCGGIGWTGPTVCASPYTCQKLNDWYYQCL

SEQ ID NO: 25836 - protein, 304 aa, Thielavia terrestris
  strain ATCC 38088 / NRRL 8126
MKGLFSAAALSLAVGQASAHYIFQQLSINGNQFPVYQYIRKNTNYNSPVTDLTSDDLRCNVGAQGAGTDTVTVKAGDQFTFTLDTPVYHQGPISIYMSKAPGAASDYDGSGGWFKIKDWGPTFNADGTATWDMAGSYTYNIPTCIPDGDYLLRIQSLAIHNPWPAGIPQFYISCAQITVTGGGNGNPGPTALIPGAFKDTDPGYTVNIYTNFHNYTVPGPEVFSCNGGGSNPPPPVSSSTPATTTLVTSTRTTSSTSSASTPASTGGCTVAKWGQCGGNGYTGCTTCAAGSTCSKQNDYYSQCL

SEQ ID NO: 25837 - protein, 284 aa, Thielavia terrestris
  strain ATCC 38088 / NRRL 8126
MQPSTPLRRAQAALTRVNDFGPNSSNTKMYIYVPSKLAAKPPIIVAIHYCTGTAQAYYSGSPYAQLADQKGFIVIYPESPYSGTCWDVSSRAALTHNGGGDSNSIANMVNYTLNKYNGDPSKVFVTGSSSGAMMTNVMAATYPEMFAAGIVYSGTPAGCFYSQSGGTDQWNSSCANGQIHSTPEVWAKMVHDMYPGYNGSRPKMQIYHGSADTTLYPSNYNETIKEWCGVFGYDYTKPDTTQANTPQARYTTYTWGDHLVGIYAQGVGHTVPIRGSDDMKFFGL

SEQ ID NO: 25838 - protein, 391 aa, Thielavia terrestris
  strain ATCC 38088 / NRRL 8126
MAISHTSIVALCGCIFLLPGVLAGFNPSATDNIAIYWGQNSINRAGGQQRLSSYCSSTPFNIIPLAFLTSIKNPTSLNFANAGDNCTTFPGTQLLQCPQIEEDIQTCQSLGKTILLSIGGATYTEGGFTSADEATTWANTLWSMFGPPTSDSSVLRPFGSATVDGFDFDFEATTANLAPFAAALRANMDAASSSGGRRFYLSAAPQCPFPDAAMGEALSSVAFDFVSVQFYNNYCGATSYVSGAGGPGNFNFETWDNWAKTVSPNPNVKVLLGLPGSATAAGSGYVSGQQLTNVIDYSRGFSSFGGVMLWDMSQVYGNAGFLDSVVSALGGQLPSKTTTPTTLTTATATSAPTGSLVPQWGQCGGTGYQGPTQCQPPYQCVSVGPWWSQCE

SEQ ID NO: 25839 - protein, 489 aa, Thielavia terrestris
  strain ATCC 38088 / NRRL 8126
MKLTTVSLLLHSAGFGAAQLIGPVGPTTSLAHKTRECNVLHYGAVNDNSTDIADALEATFRRCVLHHPGSRLVVPQGEYLLNRSVVLSNGTNWAFQLEGLISLGYGGNYSVSRELILQGYAGVQPLNDTINGEGDHLFLENGLVIVNAVDFEFFSSTGKGAFQGQGYLWRNANNTDRPRLIRLISPINASVHDLILVDSPKFHIVFDFAVNLEVYHLTIRGANLGSYDGVDVVGTNYWVHDIEVTNRDECVSVKSPSNHALVENLVCNQAGSGISIGSLNVSASIANIHARNISIIQGNNIAFIKTYPGGSGYVTNVTFENFRSKASLYGLDINQYWQNTNTPDTGSVALSNLVFRNFSGSVANGVQRPPLYLIANDLTFATNVTVEDFSVWTETNDYVVNKISNVFGTGDDSYGPGNGIRALAPGEAPAPYTSTITVTASPTNWVAPPSPTWAVPNTGYGTNIPIPVYTPAPLWKPSGDYDKHYWGSF

SEQ ID NO: 25840 - protein, 311 aa, Thielavia terrestris
  strain ATCC 38088 / NRRL 8126
MKSSALLAACSALLAAASPILQGRRLYISTDVVTEWVTVTVTEGDASTAFSRPVPHTKATTTTSIPEPSTTSVAPPPPPPPPTSTSAPVIQAAPQPTQQPSPSPQAADPQVQAAQPSSDTPAPAPAPSTTTQASAAQPSDYTSTALYHHNVHRFNHSANALVWSDEHAQYAQTLAERCVFEHDTSIGGGGYGQNIAMWGSTGDPEAFGATGSIARAASNGWYNGELNDFPASSYGASTPDMTNFEKWGHFSQLVWKDTQKVGCATVFCQPGTLSSMGSWFSVCNYYPPGNVGGAYGDNVAPPEGQPIVTAA

SEQ ID NO: 25841 - protein, 334 aa, Thielavia terrestris
  strain ATCC 38088 / NRRL 8126
MRTTFAAALAAFAAQEVAGHAIFQQLWHGSSCVRMPLSNSPVTNVGSRDMICNAGTRPVSGKCPVKAGGTVTVEMHQQPGDRSCNNEAIGGAHWGPVQVYLSKVEDASTADGSTGWFKIFADTWSKKAGSSVGDDDNWGTRDLNACCGKMQVKIPADIPSGDYLLRAEALALHTAGQVGGAQFYMSCYQITVSGGGSASPATVKFPGAYSANDPGIHINIHAAVSNYVAPGPAVYSGGTTKVAGSGCQGCENTCKVGSSPTATAPSGKSGAGSDGGAGTDGGSSSSSPDTGSACSVQAYGQCGGNGYSGCTQCAPGYTCKAVSPPYYSQCAPSS

SEQ ID NO: 25842 - protein, 413 aa, Thielavia terrestris
  strain ATCC 38088 / NRRL 8126
MKPSVVAGLFASGAAAQSGAWGQCGGIGYTGPTSCVSGYRCVYVNDWYSQCQPGAATTTTSPPASSTSTPPTSTGTAGVRYVGRVNPSTKELSWPGTGISFTFTGTSATIGIASVSGTNSVDLVVDDGDPIVITSFGSSITTPAGLSQGTHTVTLRKRSEALYGSIFLGSVTTDGAFVAGTVPTRQIEIIGDSITVGYGLDGTNPCTNNATVEDNPKTYGALAAAALGADYNVIAWSGKGVVRNVATGSPDTSPLMPELYTRYGANDPDNSYPYPPTWSPDAVVINLGTNDFSYIAWDASGNAYAARPPLNATTYTDGMVAFAQSIRAHYPAAHVFLVGSPMLSDSYPTAADAQKTTQTNALKSAVAQLGANAHFVDWPTQGSDVGCDYHPNAATHAAEAAVLADAIRSALGW

SEQ ID NO: 25843 - protein, 414 aa, Thielavia terrestris
  strain ATCC 38088 / NRRL 8126
MRSQAVWAAILAPATVSATLNDLAVRAGLKYFGTCLSESYINSDSQYAALINDKTEFGGLVPENGMKWDATEPSQGQFSFSQGDITANTAKKNGQVLRCHTLVWYSQLPGWVTSGSWTRSTLQSVMQTHITNVMGHYKGQCYAWDVVNEAIADDGTWRTSVFYNTFSTDYIPLAFNIAKTADPNAKLYYNDYNLEYNGAKTDTAVQLVQLVQSAGAPIDGVGFQGHLIVGSTPGRSSLATALKRFTALGLEVAYTELDIRHSSLPPSTSALATQGNDFANVVGSCLDVAGCIGVTVWGVTDKYSWIPQTFPGAGDALLYDDNYNKKPAWTSVSSVLAAKATSPPASSSTTLTTVITTAPTSTPTSTTAPTTTSSSNGAQQTHWGQCGGIGWTGATQCQSPYTCQKLNDWYYQCL

SEQ ID NO: 25844 - protein, 300 aa, Thielavia terrestris
  strain ATCC 38088 / NRRL 8126
MWPTPKVAFLLLWAHALLVKGSPLAADAEVLGKRACPDIHVFGARETTAPPGYGTAGTVVNLILQAYPGATAEAINYPACGGQASCGGVQYGDSARQGTAAVATAVNNFYQQCPTTQLVLVGYSQGAQIMDNAVCGGPDNGAGITTTASPISAGALAQIKAVIEMGSPRFVAGLPYDVGTCTAQGFDARPSGYVCGGNQGSKIQSYCDSTDPYCCTGNDANSHQQYANKYGQQALAFIESKLGSSSSGGSGGSTGGSGGSTGGSCSALWGQCGGQGWTGPTCCSQGTCKAQNQWYSQCLN

SEQ ID NO: 25845 - protein, 767 aa, Thielavia terrestris
  strain ATCC 38088 / NRRL 8126
MLGFLCACIALGASFSGSLAASHKPGACSPPKTCSGPWARVAPAPGAVVVDNSASPYPGSYRTVQEGVNALSTTTKTPQNLFIFPGTYVEQVYIPPLASNLTVQGYTCNSKSYEGNQATITYNLALINTTSDDKTATLRQWNPNTKVYNLNIVNTFGHIPQNGQNLALSAEATGQGYYGCQLIGYQDTVLAETGLQLYAKSLIVGAVDFIFGQTALAWFEGVDIRTIATGCVTASGRDSATNPSWYVISRSSVAGINDTIPAGINYLGRPWRSFARVVFQETYLGNVIAADGWKEWSTSTPNTANVTFAEYNNYGPGSVQHEGPRASFSEQLTARIPIRSILGNNFQDEWWVDTKYLDPSDLRDDDAVSTSATASSTTSTAASTSTSSPTASTTSTTAVATTTVTSLTTSSSASPTTSSNPCVCTDYSQISAAVASCTDIVLSNIAAPGGSAIDLSKLKAGATVTFDGLTTFGFTNSSSFNPITIGGQGITVTANPGAIIDGNGQAYWDGLGSNGGVPKPDHFIVVSKVTGGSVIKNLYIRNWPVHLFSISGCADLVFQDLVLNNTAGDAPNSRSNGLPAAHNSDGFDVSSSSNIVIRRSVVHNQDDCVAITSGNNMTVSDLDCYGGHGLSIGSVGLKSNNNVTNILFTNSTVTASENGCRIKTNYNATGFVANITYANIALRGISAYGIDVQQDYLNGGPTGVPSSGVLIQHVLFRNVTGTADPSARDYYVLCGDGSCEDFRFEDVSVTGGGVASSCNFPPGGCPS

SEQ ID NO: 25846 - protein, 504 aa, Thielavia terrestris
  strain ATCC 38088 / NRRL 8126
MKYRPSLSLAAAALFLLEPWVQAQLSGSVGPTTSRAAKAAKKVCNIMNYGGVASATTDNSAAITAAWNACKGGGEVYIPSGSYGLSSWVTLSGGSGVSINLEGVIYRITSATAGGTMISVSSTTDFEFYSGNSKGAIQGYGYLLNASDPRLVRLTQVTNFSFHDIALVDAPEFSLVMDTCSNGEVYNSIVRAGSEGGLDGVDVWGQNIWIHDIEVTNKDECVTVKSPASNILVESIFCNWSGGSAMGSLGANTDISNIYYRNVYSQNCNQMYMIKSWGGSGTVKNVKLENFWGHSNAYTLDLNAYWTSMTQAPGDGVSYQNITFTGWKGTNSNGAQRGSIQVLCPSAVPCTGITISDVNIWTESGSTEKEICENAYGTGGCLRAGSGGTYTTTVTRTTASNYAIQTMPNEIKAWGLGTEIPIPAIPTSFFPGLRPISALMAASSNGGGATPTTAGPTPTTTSAGTGGGVQSEYGQCGGSGYSGPTACAAPYACSTLNPYYAQCL

SEQ ID NO: 25847 - protein, 385 aa, Thielavia terrestris
  strain ATCC 38088 / NRRL 8126
MGLQYLKTTTAAVAILAAACGSMPGVQAADVASLWGQCGGIGYTGPTQCVSGAVCTHYNDWYYQCIPGATTSAVTTSSTSPVKLTTTSTPTTLSTSTSTTSSGSGPTSSSAPAAVKYLITFGDSYSQTGFDINSTKPAPGNPLGNPPLPGWTASGGLNWVGFLTSVFNTTTVLTYNFAYGGATTNATLVAPYEPTVLSLIDQVAEFSGSIASKPSYAPWTAQNSLFGVWIGVNDVGNSWWLSNYTQIVDQIMDSYFGRLQVLYDAGARNFVLLSVPPINRTPLMLAESTDSQQAEATAIAAYNAALTTRLAAFTSKNSGVTGKIVDTSVPFNTALDNPTAYGAPDNTCYNSDGTSCLWFNNYHPGIAINKLVAQAVADAWKGTFF

SEQ ID NO: 25848 - protein, 448 aa, Thielavia terrestris
  strain ATCC 38088 / NRRL 8126
MKSIATLILLAGGAAGQQSAYGQCGGINYSGPTSCVAGYACTSWNPYYYQCVPGTATPTPTPTSHTSTAVTTTSTSKSTSSTKTSTVSTKTTSSSTTGPTATGFAKTNGLLFEIDGVTKYFAGTNCYWCGFLTSNGDVDHVFADMAAAGFKVVRVWGFNDVNTIPLTGTVWYQYLSASGSQINTGEYGLQRLDYVVSSAAAHGLKLIINFVNNWNDYGGINAYVNAFGGNASTWYTNTAAQAQYQKYIEAVVSRYKDSTAVFAWELANEPRCSGCDGSVIYNWAATTSRYIKSLDPNHMVTMGDEGFGPLAGGDGSYPYQTGAGGYTWVDNLNISTLDFGTLHLYPDSWGQPYSWGDLWISTHGAACVNANKPCILEEYGGGNNCTVENPWQATALGTKGIAGDMFWQYGDTLPSCNCQTSQDGNTVYYNQGNWDCMVTQHVAAINAS

SEQ ID NO: 25849 - protein, 314 aa, Thielavia terrestris
  strain ATCC 38088 / NRRL 8126
MVRQQATSLLALAFLSVASAQVSNDFESGWDQTAWPTYAPDCNQGGKVTLDSTTAHSGKNSIRVDGAGGYCGHIFFGTSQVPSGDLYVRVYLKAANALTSSHVTFITMPDPAQGTNKHLRIGGQSQILMYNRESDDATLPDLSPQGIASSTALPTGSWQCFEYHIGTDGTIETWLNGAAIAGLEAGPGINNPYADQWERSSIKPTPAGVYFGWESYGGDTNTFWYDDIVISSSRVGCSGSTGTSPPATTTTPGGSTPPPATSTTTSTAPPATSSTPSCTAAHWAQCGGIGYTGCTTCASPYTCTALNDYYSQCL

SEQ ID NO: 25850 - protein, 317 aa, Thielavia terrestris
  strain ATCC 38088 / NRRL 8126
MKGLSLLAAASAATAHTIFVQLESGGTTYPVSYGIRDPSYDGPITDVTSDSLACNGPPNPTTPSPYIINVTAGTTVAAIWRHTLTSGPDDVMDASHKGPTLAYLKKVDDALTDTGIGGGWFKIQEAGYDNGNWATSTVITNGGFQYIDIPACIPNGQYLLRAEMIALHAASTQGGAQLYMECAQINVVGGSGSASPQTYSIPGIYQATDPGLLINIYSMTPSSQYTIPGPPLFTCSGSGNNGGGSNPSGGQTTTAKPTTTTAATTTSSAAPTSSQGGSSGCTVPQWQQCGGISFTGCTTCAAGYTCKYLNDYYSQCQ

SEQ ID NO: 25851 - protein, 448 aa, Thielavia terrestris
  strain ATCC 38088 / NRRL 8126
MKSVALLLSVAASLAAASAIAVEHEAHVRADASITLPRSAASNCNPHKQKDNWGNAVEKDRKRITIRASKNDRDDISDEFLSGIKRANNGGLLHLEKDKTYVIGKKLDLSFLKDVYVKIDGELKFTDNITYWQANNFFYSFQNSITFWVWGGRDIKIYGSGTINGNGQAWWDGFAGHEILDPNNAYYRPILFLTDNATNVEVRGIHMKDSPCWNNFFVRSKNVIFDDVYISAVSTNASSLPKNTDGFDSFNVDGLTVTNTRVNVGDDCFSPKPNTTNILVQNLWCNGTHGVSMGSIGQYAGVKDIISNALLQNITLLNGQNGARLKAWAGADVGYGYISNITYRDIHVENTDNPIVLDQCYFNVNQTECAAHPSRVNITDVRFINVHGTSSGKNGRVVADLTCSPGATCTGIYLQDINITSPAGSPPEIVCDGIQGGIGVPCVSASEA

SEQ ID NO: 25852 - protein, 395 aa, Thielavia terrestris
  strain ATCC 38088 / NRRL 8126
MALKSLLLTSLATAGLVVADGLNVRAKAAGKKYFGTEISTTVMNDANANNIAKNSQDFGQYTCENEMKFDALEPSRGTFNYANADRIVAQAQANGMLMRCHNLVWHNQVPSWVTNGHFDNATLISIMKNHIANVVGHYKGKCYAWDVVNEALNEDGTYRTSGSVWGSTIGPAYIPIAFAAAAEADPDAKLYYNDYNCDRAGAKATGAQNLIKMVKQYGAPIHGFGMQGHLTTGQVGSASQYVSNMQAFAALGVEVAFTELDIATPSSNPNFQQQATDYATIVSACKQVDACVGITTWGFTDKYTWISNSDPLPWDSNLQKKPAYTAILNAWGSSPPPSTTTTTAATTTTPPSGGGGNGCTAPHWAQCGGIGYSGCTTCEAPYTCKYSNDWYSQCL

SEQ ID NO: 25853 - protein, 464 aa, Thielavia terrestris
  strain ATCC 38088 / NRRL 8126
MGQKTLHGFAATALAVLPFVKAQQPGNFTPEVHPQLPTWKCTTAGGCVQQDTSVVLDWNYRWIHNADGTASCTTSSGVDHTLCPDEATCAKNCFVEGVNYTSSGVTTSGSSLTMRQYFKGSNGQTNSVSPRLYLLGSDGNYVMLKLLGQELSFDVDLSTLPCGENGALYLSEMDATGGRNQYNTGGANYGSGYCDAQCPVQTWMNGTLNTNGQGYCCNEMDILEANSRANAMTPHPCANGSCDKSGCGLNPYAEGYKSYYGPGLTVDTSKPFTIITRFITDDGTTSGTLNQIQRIYVQNGKTVASAASGGDIITASGCTSAQAFGGLANMGAALGRGMVLTFSIWNDAGGYMNWLDSGNNGPCSSTEGNPSNILANYPDTHVVFSNIRWGDIGSTVQVSGGGNGGSTTTTSTTTLRTSTTTTTTAPTATATHWGQCGGIGWTGPTVCESPYACKELNPWYYQCL

SEQ ID NO: 25854 - protein, 228 aa, Thielavia terrestris
  strain ATCC 38088 / NRRL 8126
MKFLPILCAAGLAAAAPTQPAGEAAVEARQLFSDTANDLENGVSSNCPKVIFICARGSTETGNLGSSVCPEVANGLKNYYPNQLWVQGVGGAYTADLASNALPGGTSTAAMQEAANMFNLAQQKCPNASVAAGGYSQGTAVVAGGIQSLSAAAKDQIKGVVLFGYTQAQQNHDTIPNFPVDKTMIFCAQGDLVCNGTLIVTAAHFSYITNGDASTKGPAWLHEKIGDA

SEQ ID NO: 25855 - protein, 830 aa, Thielavia terrestris
  strain ATCC 38088 / NRRL 8126
MRSSSRFLGALAAAASFVPSALAQNSVPVTFTDPSTGIVFNSWGLPNGSAETQGGYTFGVALPSNALTTDATEFIGYLQCASTDGKGWCGVSLGGPMTNSLLIAAWPYGDNIYTSFRYATGYAMPDVYTGNATLTQISSTINSTSFTLIFRCQNCLSWNQDGSSGGASTSSGALILGWCQAFPSPGNPTCPDQITIEQHDNGQGIWGAQLDSNAANPSYTAWAAKATKTVPAQCSGPTSTGVVGVPVPTGATYDYIVVGAGAGGIPIADKLSEAGKSVLLIEKGFASTGQNGGTLGPDWLAGTGLTRFDVPGLCNEIWVDSKGIACDDTDQMAGCVLGGGTAVNAGLWFHPYSLDFDYLFPTGWKSSDVQAAISRVFSRIPGTYTPSMDGKLYYQQGFDVISGGLSKGGWTQVVANSSPDSKNRTFSHSPFMFSGGERGGPLATYLQTAKKRSNFNLWLNTTVKRVVRDGGHITGVEVEAFRSGGYEGVVNVTNISGRVILSAGTFGTAKILLRSGIGPSDQLQVVQNSTIDGPTMINSTSWIPLPVGYNLDDHCNTDTVITHPNVVFYDFYAAWDNPIPSDEQSYLNSRSGILAQAAPNIGPMFWEEIKGADGIVRQLQWTARVEGSFDTPNGHAMTMSQYLGRGATSRGRMTITPSLTTVVSDVPYLKDPNDKEAVIQGIVNLQNALKNVANLTWTYPNSSISARDYVNSLSLSPSIRRSNHWVGTAKIGSDDGRTGGSAVVDLNARVYGTDNLFVVDASIFPGVPTTNPSAYIVTVSEHASEKILALAAPQPVPKWGQCGGRQWTGSFICAAGTKCTYQNDWYSQCL

SEQ ID NO: 25856 - protein, 326 aa, Thielavia terrestris
  strain ATCC 38088 / NRRL 8126
MKSFTIAALAALWAQEAAAHATFQDLWIDGVDYGSQCVRLPASNSPVTNVASDDIRCNVGTSRPTVKCPVKAGSTVTIEMHQQPGDRSCANEAIGGDHYGPVMVYMSKVDDAVTADGSSGWFKVFQDSWAKNPSGSTGDDDYWGTKDLNSCCGKMNVKIPEDIEPGDYLLRAEVIALHVAASSGGAQFYMSCYQLTVTGSGSATPSTVNFPGAYSASDPGILINIHAPMSTYVVPGPTVYAGGSTKSAGSSCSGCEATCTVGSGPSATLTQPTSTATATSAPGGGGSGCTAAKYQQCGGTGYTGCTTCASGSTCSAVSPPYYSQCL

SEQ ID NO: 25857 - protein, 220 aa, Thielavia terrestris
  strain ATCC 38088 / NRRL 8126
MRSLSLNVEAEVRNSERSDENLGYEVLEPSQGACSTSSMSTPDSSISIRTASSTVLIWGRLVVFLSWLLRRVVNVGVCKLGIIVGVLEVLEVLDGAGVPEAGLCFARHVGPFSGGGLAAQGNSVGWMRPQPLEVVDSAIRHIYPEHLGLRLVLGRHEVAVAIVPDVPELEVARRVLAEAQPSEDRGQLVDLEVSRPWISDRIRMGTKQRASESVQDKAEA

SEQ ID NO: 25858 - protein, 390 aa, Thielavia terrestris
  strain ATCC 38088 / NRRL 8126
MKSSVVVSLFASGAAAQVGPWGQCGGINWTGGTTCVSGYHCVYQNDWYSQCLPGADSTTLKTSTTSTKPTSTSTAPATTTSAAAKGKLKWLGINQSCAEFGQGTYPGTWGKDFTFPSTSSIQTHINDGYNIFRVAFAMERLVPNSLTGSPDAGYLKNLTDTVNFITNAGAYAILDPHNFGRYYGNIITDTTAFGAFWTTVAKQFASNSRVIFDTNNEYHDMDQTLVLNLNQAAINAIRGAGATSQYIFAEGNSYTGAWTWNTTNTNLAALSDPQNKLVYEMHQYLDSDGSGTSATCVSSDIGVQRIVGATSWLRANGKIGILGEYAGGANSVCQTAVTGLLDHLQANSDVWAGALWWAGGPWWGNYIFSFEPPSGTAYTYYNSLLKQYTP

SEQ ID NO: 25859 - protein, 416 aa, Thielavia terrestris
  strain ATCC 38088 / NRRL 8126
MPSVVLSLAFLAGSAIAQQSVWGQCGGIGYSGPTSCVSGSCCVTLNAYYAQCTPGTGCGGGGSGTTLTTKTTTTTATATPTGGGGVGSGKTRFAGVNIAGFDFGCGTDGTCNTAKVYPPVKNYPPDYNHPDGAGQMQHFYRDDNMNIFRLPVGWQYLVNNNLGGSLDSTNFGYYDQLVQACLSTGAYCIIDIHNYARWNGAIIGQGGPTNEQFADLWRQIATKYANQPRIWFGIMNEPHDVPNISTWAATVQAAVTAIRNAGATSQFISLPGNDWQSAAAFISDGSAAALSAVKNPDGSTTNLIFDVHKYLDSDNSGTHTECVTNNIDSAFAPLATWLRQNNRQAILTETGGGNTASCQTYVCQQLAYLNQNSDVYLGYVGWAAGSFDSTYELDLTPTQNGNSWTDTALAKACFAR

SEQ ID NO: 25860 - protein, 392 aa, Thielavia terrestris
  strain ATCC 38088 / NRRL 8126
MRLPQTEVSLALLALAAPAVRAGCSLPSSYKWTSTGPLATPKSGWVSLKDFTHVPYQGKHLVYATDHDTGSSYGSMNFGLFSNWSDMASASQNAMSQAAVAPTLFYFEPKSIWVLAYQWGPTAFSYRTSTDPTNANGWSAAQPLFTGTAEGAPYGPIDQTLIGDSTNMYLFFAGDDGKIYRSSMPIDNFPGNFGTESTVVLSGATNDIFEAVQVYTVTGQSSPQYLMIVESIGSSGDRYFRSYTASSLSGSWSPQATSESAPFAGKANSGATWTPDISHGDLIRSSADQTMPIDPCNLQLLYQGRNGSGSTYDLQPYRPGLLTLVGATGGNNGGGSSSTPTTTATPPATSTPGNGGTVAHWGQCGGSGYSGPTVCESPYTCTYQNPWYSQCL

SEQ ID NO: 25861 - protein, 363 aa, Thielavia terrestris
  strain ATCC 38088 / NRRL 8126
MSSLALLLSLSALAASNPLPAKLADRDSCTFTDAASAIKGKTSCSTITLSGITVPAGTTLDLTGLKDGTHVTFSGTTTFGYKEWSGPLISVSGNNILVDGAPGHIIDGNGAAWWDGEGSNGGKTKPKFFFAHSMTNSNIKGLSVKNTPVQAFSINGATNLGLYDIHIDNSAGDSQGGHNTDAFDVGSSTGVYISGAIVKNQDDCLAINSGTNITFTGGQCSGGHGLSVGSVGGRSDNTVKTVRILNSSVSNSENGVRIKTVYGATGSVSDVTYSGITLSGITKYGIVIEQDYENGSPTGTPTGGVPITDLTLSSVTGTVSSSATNIYILCAEGACSDWTWSNVSVKGGKTSTKCSNVPSPATC

SEQ ID NO: 25862 - protein, 338 aa, Thielavia terrestris
  strain ATCC 38088 / NRRL 8126
MKFSILPSLLAGVVSVSAGTILWDGRFNDLSSSTDLNNWSWSNEVGPYQYYIHGPSPVTAYVNLSPDYKNPADTGSKQGAKITLDSTSYWNGQNMRRTELIPQTSAAINKGKVYYHFSLMRKDTNAPATTREHQIAFFESHFTELKSGLLSGASGVSDTSLRWCVSGQTQWSTEWVADVWHNVAYEIDFNANTVGFWHSTGSDALVRVVAPVSVSTSSNGADWHVGVLELPRSGYSDTTEDFYFSGVYIESGSLTTSVSGPGSPSGGNGSSSAPGSSTTTTKVSSSTTTSAATPTSSAGGGCTASQWAQCGGINYSGCTTCAAPYTCKYLNDWYSQCQ

SEQ ID NO: 25863 - protein, 622 aa, Trametes hirsuta
MSASSSDPFHSFAKTSFTSKAAKRATAHSLPPLPGPGDLPPGMNVEYDVAIVGSGPIGCTYARELVEAGFNVAMFEIGEIDSGLKIGSHKKNTVEYQKNIDKFVNVIQGQLMPVSVPVNTMVVDTLSPASWQASTFFVRNGANPEQDPLRNLSGQAVTRVVGGMSTHWTCATPRFEKLQRPLLVKNDSKADDAEWDRLYKKAESYFKTGTTQFAESIRHNLVLKKLQEEYKGVRDFQQIPLAATRQSPTFVEWSSAHTVFDLENRPNKDAPKQRFNLFPAVACTNVRRDNANSEIVGLDVRDLHGGKSITIKAKVYILTAGAVHNAQLLAASGFGQLGRPDPAKPLPSLLPYLGTHITEQTLVFCQTVMSTELINSVTADMTIVGKPGHPDYSVTYTPGNPNNKHPDWWNEKVKKHMMDHQEDPLPIPFEDPEPQVTTLFQATHPWHTQIHRDAFSYGAVQQSIDSRLIVDWRFFGRTEPKEENKLWFSDKITDAYNLRQPTFDFRFPGGREAEDMMTDMCVMSAKIGGFLPGSYPQFMEPGLVLHLGGTHRMGFDEKADKCCVDTDSRVFGFKNLFLGGCGNIPTAYAANPTLTAMSLAIKSCEYIKKNFEPSPNPVKHHN

SEQ ID NO: 25864 - protein, 520 aa, Trametes hirsuta
MSRFQSLLAFVVASLAAVAHAAIGPTADLTISNAEVSPDGFARQAVVVNNVTPGPLVAGNKGDRFQLNVIDNLTNHTMLKSTSIHWHGFFQKGTNWADGPAFVNQCPISSGHSFLYDFQVPDQAGTFWYHSHLSTQYCDGLRGPFVVYDPNDPHASLYDVDNDDTVITLADWYHTAAKLGPAFPLGADATLINGLGRSPSTTAADLAVINVTKGKRYRFRLVSLSCDPNHTFSIDGHDLTIIEVDSINSQPLVVDSIQIFAAQRYSFVLNADQDVGNYWIRANPNFGNVGFAGGINSAILRYDGADPVEPTTTQTTPTKPLNEVDLHPLATMAVPGSPVAGGVDTAINMAFNFNGTNFFINGASFVPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDVNDQ

SEQ ID NO: 25865 - protein, 384 aa, Trametes hirsuta
MKAILSLAAALLSAAPAFSTAVWGQCGGIGFSGDTTCTASTCVKVNDYYSQCQPGASAPTSTASAPGPSACPGSRTKFKLFGVNESGAEFGNNVIPGALGTDYTWPSPTSIDFFLDQGFNTFRIPFLMERVSPPSTGGLTGPFNNTYLDGLKQTVSYITGKGGFAIIDPHNFMIFNGATITSTSQFQAWWQKLAAEFKTNNNVIFDLMNEPHDIPAQTVFQLMQAAVNGVRASGATSQLILVEGTSWTGAWTWTTSGNSDAFGAITDPNNNVAIQMHQYLDSDGSGTSPTCVSSTIGAERLQAATQWLQQKGLKGFLGEIGTGNNTQCVTALQGALCEMQQAGGTWLGALWWAAGPWWGDYYQSIEPPNGDAITNILPALKAFL

SEQ ID NO: 25866 - protein, 499 aa, Trametes maxima
AVGPVADNTITDAATSPDGFSRQAVVVNGVTPGPLVAGNIGDRFQLNVIDNLTNHTMLKTTSVHWHGFFQQGTNWADGPAFINQCPISPGHSFLYDFQVPNQAGTFWYHSHLSTQYCDGLRGPFVVYDPNDPHASRYDVDNDDTVITLADWYHTAAKLGPRFPAGADATLINGKGRAPSDTSAELSVIKVTKGKRYRFRLVSLSCDPNFTFSIDGHNLTIIEVDSSNSQPLSVDSIQIFAAQRYSFVLNANQAVDNYWIRANPNFGNVGFNGGINSAILRYDGAPAVEPTTNQTTSVKPLNEVNLHPLVSTPVPGSPSSGGVDKAINMAFNFNGSNFFINGASFVPPSVPVLLQILSGAQTAQDLLPSGSVYVLPSNASIEISFPATAAAPGAPHPFHLHGHTFAVVRSAGSTVYNYSNPIFRDVVSTGTPAAGDNVTIRFLTNNPGPWFLHCHIDFHLEGGFAVVQAEDVPDVKATNPVPQAWSDLCPTYDANAPSDQ

SEQ ID NO: 25867 - protein, 622 aa, Trametes pubescens
MSTSSSDPFYNFAKTSFKSAAAQKASATSLPPLPGPDQKVPGMDIKYDVVIVGSGPIGCTYARELVEAGYKVAMFDIGEIDSGLKIGAHKKNTVEYQKNIDKFVNVIQGQLMSVSVPVNKLVVDTLSPTSWQASTFFVRNGSNPEQDPLRNLSGQAVTRVVGGMSTHWTCATPRFDREQRPLLVKDDPDADDAIWDQLYTKAESYFKTGTDQFNESIRHNLVLNKLAEEYKGQRTFQQIPLAATRRNPTFVEWSSANTVFDLQNRPNIDAPEERFNLFPAVACERVMRNASNTAIESLHIRDLISGDRFAIQADVYVLTAGAVHNTQLLVNSGFGKLGRPDPANPPELLPFLGSYITEQSLVFCQTVMSTELIDSVKSDMTIIGNPGELGYSVSYMPGASTNKHPDWWNEKVQNHMMQHQEDPLPIPFEDPEPQVTTLFQPSHPWHTQIHRDAFSYGAVQQSIDSRLIVDWRFFGRTEPKEENKLWFSDKITDAYNMPQPTFDFRFPAGRTSQEAEDMMTDMCVMSAKIGGFLPGSLPQFMEPGLVLHLGGTHRMGFDEQEDNCCVDTDSRVFGFNNLFLGGCGNIPTAYGANPTLTAMSLAIKSCEYIKKNFTPSPFTPAQ

SEQ ID NO: 25868 - protein, 623 aa, Trametes versicolor
MSTSSSDPFFNFTKSSFRSAAAQKASATSLPPLPGPDKKVPGMDIKYDVVIVGSGPIGCTYARELVEAGYKVAMFDIGEIDSGLKIGAHKKNTVEYQKNIDKFVNVIQGQLMSVSVPVNTLVIDTLSPTSWQASSFFVRNGSNPEQDPLRNLSGQAVTRVVGGMSTHWTCATPRFDREQRPLLVKDDQDADDAEWDRLYTKAESYFKTGTDQFKESIRHNLVLNKLAEEYKGQRDFQQIPLAATRRSPTFVEWSSANTVFDLQNRPNTDAPNERFNLFPAVACERVVRNTSNSEIESLHIHDLISGDRFEIKADVFVLTAGAVHNAQLLVNSGFGQLGRPDPANPPQLLPSLGSYITEQSLVFCQTVMSTELIDSVKSDMIIRGNPGDLGYSVTYTPGAETNKHPDWWNEKVKNHMMQHQEDPLPIPFEDPEPQVTTLFQPSHPWHTQIHRDAFSYGAVQQSIDSRLIVDWRFFGRTEPKEENKLWFSDKITDTYNMPQPTFDFRFPAGRTSKEAEDMMTDMCVMSAKIGGFLPGSLPQFMEPGLVLHLGGTHRMGFDEQEDKCCVNTDSRVFGFKNLFLGGCGNIPTAYGANPTLTAMSLAIKSCEYIKNNFTPSPFTDQAE

SEQ ID NO: 25869 - protein, 527 aa, Trametes versicolor
MGKFHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDANASLYDVDDDTTVITLADWYHTAAKLGPAFPAGPDSVLINGLGRFSGDGGGATNLTVITVTQGKRYRFRLVSISCDPNFTFSIDGHNMTIIEVGGVNHEALDVDSIQIFAGQRYSFILNANQSIDNYWIRAIPNTGTTDTTGGVNSAILRYDTAEEIEPTTNATTSVIPLTETDLVPLDNPAAPGDPQVGGVDLAMSLDFSFNGSNFFINNETFVPPTVPVLLQILSGAQDAASLLPNGSVYTLPSNSTIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTAWSDLCPTYDALDSSDL

SEQ ID NO: 25870 - protein, 519 aa, Trametes versicolor
MGLQRFSFFVTLALVARSLAAIGPVASLVVANAPVSPDGFLRDAIVVNGVVPSPLITGKKGDRFQLNVDDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTTSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 25871 - protein, 520 aa, Trametes versicolor
MGRFSSLCALTAVIHSFGRVSAAIGPVTDLTISNADVSPDGFTRAAVLANGVFPGPLITGNKGDNFQINVIDNLSNETMLKSTSIHWHGFFQKGTNWADGAAFVNQCPIATGNSFLYDFTATDQAGTFWYHSHLSTQYCDGLRGPMVVYDPSDPHADLYDVDDETTIITLSDWYHTAASLGAAFPIGSDSTLINGLGRFAGGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVPLDSPAAPGDPNIGGVDYALNLDFNFDGTNFFINDVSFVSPTVPVLLQILSGTTSAADLLPSGSLFALPSNSTIEISFPITATNAPGAPHPFHLHGHTFSIVRTAGSTDTNFVNPVRRDVVNTGTAGDNVTIRFTTDNPGPWFLHCHIDFHLEAGFAIVFSEDTADVSNTTTPSTAWEDLCPTYNALDSSDL

SEQ ID NO: 25872 - protein, 436 aa, Trametes versicolor
MFKFAAAGQCGGVGWTGRTTCVSGSVCSKQNDYYSQCISGAGAPGTTVAPTTAPTAPATSAPGGSPTTVSAPSTPSSTPAAGNPFTGFQVYLSPYYSAEIASAAAAVTDSSLKAKAASVANIPTFTWLDSVAKVPDLGTYLADASSIQTKTGQKQLVPIVVYELPDRDCAAKASNGEFSIADAGAENYKDYIDQIVPQIKQFPDVRVVAVIEPDSLANLVTNLNVQKCANGGTYKASVTYALQQLSSVGVTMYMDAGHAGWLGWPANIQPGSEVFAEMFKSADFVAFVRAFATNVREYNALTAAFPRPITQGNPNYDEFPYIQRVRPMLKSPGFPAQFVVDQGRAGQQNFRQQWGDWCNIKGAGFGTRPTTSTGNPLIDAIIWVKPGGESDGTSNSSSPRYDSTLLSVRRDDPAPEAGTWFQAYFETLVSKPTRPL

SEQ ID NO: 25873 - protein, 520 aa, Trametes villosa
MSRFHSLLAFVVASLTAVAHAGIGPVADLTITNAAVSPDGFSRQAVVVNGGTPGPLITGNMGDRFQLNVIDNLTNHTMVKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAAKLGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTAPLNEVNLHPLVTTAVPGSPVAGGVDLAINMAFNFNGTNFFINGTSFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDALDPSDQ

SEQ ID NO: 25874 - protein, 519 aa, Trametes villosa
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWAEGPAFVNQCPIASGHSFLYDFHVPDQAGTFWYHSHLSTQYCDGLRGPFVVYDPKDPHASRYDVDNESTVITLTDWYHTAARLGPKFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTPSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 25875 - protein, 473 aa, Trametes villosa
MSFSSLRRALVFLGACSSALASIGPVTELDIVNKVIAPDGVARDTVLAGGTFPGPLITGKKGDNFRINVVDKLVNQTMLTSTTIHWHGMFQHTTNWADGPAFVTQCPITTGDDFLYNFRVPDQTGTYWYHSHLALQYCDGLRGPLVIYDPHDPQAYLYDVDDESTVITLADWYHTPAPLLPPAATLINGLGRWPGNPTADLAVIEVQHGKRYRFRLVSTSCDPNYNFTIDGHTMTIIEADGQNTQPHQVDGLQIFAAQRYSFVLNANQAVNNYWIRANPNRANTTGFANGINSAILRYKGAPIKEPTTNQTTIRNFLWETDLHPLTDPRAPGLPFKGGVDHALNLNLTFNGSEFFINDAPFVPPTVPVLLQILNGTLDANDLLPPGSVYNLPPDSTIELSIPGGVTGGPHPFHLHGTDNPGPWFLHCHIDFHLQAGLAIVFAEDAQDTKLVNPVPEDWNKLCPTFDKAMNITV

SEQ ID NO: 25876 - protein, 520 aa, Trametes villosa
MGRFSSLCALTAVIHSFGRVSAAIGPVTDLTISNGDVSPDGFTRAAVLANGVFPGPLITGNKGDNFQINVIDNLSNETMLKSTSIHWHGFFQKGTNWADGAAFVNQCPIATGNSFLYDFTATDQAGTFWYHSHLSTQYCDGLRGPMVVYDPSDPHADLYDVDDETTIITLSDWYHTAASLGAAFPIGSDSTLINGLGRFAGGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVPLDSPAAPGDPNIGGVDYALNLDFNFDGTNFFINDVSFVSPTVPVLLQILSGTTSAADLLPSGSLFAVPSNSTIEISFPITATNAPGAPHPFHLHGHTFSIVRTAGSTDTNFVNPVRRDVVNTGTVGDNVTIRFTTDNPGPWFLHCHIDFHLEAGFAIVFSEDTADVSNTTTPSTAWEDLCPTYNALDSSDL

SEQ ID NO: 25877 - protein, 527 aa, Trametes villosa
MGKYHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHEALDVDSIQIFAGQRYSFILNANQSIDNYWIRAIPNTGTTDTTGGVNSAILRYDTAEDIEPTTNATTSVIPLTETDLVPLDNPAAPGDPQVGGVDLAMSLDFSFNGSNFFINNETFVPPTVPVLLQILSGAQDAASLLPNGSVYTLPSNSTIEISFPIITTDGVLNAPGAPHPFHLHGHTFSVVRSAGSSTFNYANPVRRDTVSTGNSGDNVTIRFTTDNPGPWFLHCHIDFHLEAGFAIVWGEDTADTASANPVPTAWSDLCPTYDALDSSDL

SEQ ID NO: 25878 - protein, 495 aa, Trichoderma asperellum
MLRRLSLLVLAGLVSRSAQQSCAALYGQCGGIGWSGATCCVSGAQCNALNDYYSQCVLSTGGSGPTGSSSSATSIPHSQSLSSASSIPHSQSSSVGQSTGVSTYTTTDTSTVALHSQSPYPSIAASSCGAWTLVDNVCCPSYCATDDTSESCTCSDCTTPPSADCKSGTMYPEVHTVSTNETWHYSRSTHFGLTSGGACGFGLYGLCTKGSVTANWTDPMLGTTCDAFCTAYPLLCKDPAGTTLRGNFAAPNGDYYTQFWPSLTGDLDNYLSCGECIELIQTKPDGTDYAVGEAGYTDPITLEIVDSCPCSANSKWCCGPGADHCGEIDFKYGCPLPADSIHLDLSDIAMGRLQGNGSLNNGVIPTRYRRVQCPKLGNVYIWLRNGGGPYYFALTAVNTNGPGSVTKIEVKGSDSSTWVPLEHDPNYTSSRPQERYGSWVIPQGSGPFNLPVGVRLTSPTGEQIVNEQAIKTFTPPATADPNFYYIDIGVQFSRN

SEQ ID NO: 25879 - protein, 394 aa, Trichoderma ghanense
MFFSKALAAAGLLATAAFAAPTMEKRAAGGKLVVYWGAEDDSTTLANVCADPSYDIVNLAFLSRFFAGGGYPELSLSSLGGASAAQKAAGATNLQDGTSLIPAIQACQAAGKLVILSMGGAVDYSAVTLTGDAQGQQLADTVWNLFLGGTANPTLRPFGSVKLDGVDLDNETGNPTGYLAMAQRFKSNFAKDPSKKYYLTAAPQCPFPDASEPLNVCQLADYIWVQFYNNGNCNIAQSGFNSAVKNWSKSIGNATLFIGALASGADGDQGYVSASSLLSAYQGVSALNLPNIGGIMLWEAQLAVKNGNFQKTVKAGISSGSTTPPPPSPSGSCSWAGHCAGASCSTDDDCSDDLTCNSGVCGTAGSTPAPTCSWEGHCLGASCGNDNDCSDPYS

SEQ ID NO: 25880 - protein, 392 aa, Trichoderma ghanense
MPSFSSFTSALGLLSLLPAARAGWDQNSNKNIVVYWGQNSGSVGQNRLSYYCQNAPDVDVINISFMVGINNLNLNLANVGNNCTAFPEAPNLLNCPQVAADITECQQTYGKTIMMSLFGSTYSESGFSSSSAAVSAAQEMWAMYGPVQSGNSTPRPFGDAVVDGFDFDLEDPIENNMEPFAAELRSLIDASTSKKFYLSAAPQCPYPDASDQSFLDGQVAFDWVNVQFYNNGCGVSHFPADFNWATWDNWAKTVSANKNAKVLIGTPANVGGANAGSFPTDSQLSGAISLAQGSSSFGGVMLWDMAQLFTNQGYLAKIVADLGSSSSPPPPASTTLQTVTRSSTASTSPTNPPSGGSVPQWGQCGGNGYTGPTQCQAPYKCVATSEWWSSCQ

SEQ ID NO: 25881 - protein, 71 aa, Trichoderma harzianum
AVCPTGLFSNPLCCSTNVLDLVGVDCVTPTAAVPDGVFFQAHCASKGKQPLCCVAPVAKQGVLCQKPIGTQ

SEQ ID NO: 25882 - protein, 398 aa, Trichoderma harzianum
MKFLQTSLIAAALPAALVSGRFVIENEGDNVQLDEPAKYLIELSPGETQWVTEEDKWDLRRNGQNFMDITDTQELGTLRAWTQSQASVAFPDKCVKQKEVGELAGHLTKDGMRRNLEKLTSFHTRYYKSDYGRQSSEWVLERINGIIKDAGAEDTVTAEHFGHSWPQSSVIARIPGKTNTTVIIGAHQDSINLWLPSILGAPGADDDGSGTVTIMEVFHTLLKAKDVVGGSAPNTVEFHWYSAEEGGLLGSQAIFQSYEKEGRDVKAMLQQDMTGFVQGTEDAGKPESVGVITDFVHPGLTAFIKKVIEEYCSIPWVETKCGYACSDHASASKAGYPSAFVIESAFENSDQHIHGTDDLIKYLSFDHMLEHAKMTLGLVYELAYHDFSSKAVEEPSEL

SEQ ID NO: 25883 - protein, 248 aa, Trichoderma harzianum
MRSLSLFTALLAGQAFAYPKPVLQSSTRRDWPTINEFLTELAEIMPIGDTVSAACDLIGDAEDVAADLFDISNTENDACGDVTVLFARGTCDPGNVGVLVGPWFFNSLETALPNKKVGVKGVPYPASVQGFLSGSVQPGIDMANQIKSVISSCPNTKLVLGGYSQGSMVVHNAASNLDAATMAKVSAVVLFGDPYDGRPVANYDASKVLVVCHDGDNICQGGDFILLPHLTYAEDADTAAAFVKPLVS

SEQ ID NO: 25884 - protein, 380 aa, Trichoderma harzianum
MTKLSLLLGALAASVCVQSHALPSPPTVTQAPELEDRATTCTFSGANGASSASKSQKSCATIVLSNVAVPSGVTLDLSDLNDGTTVIFQGTTTWGYKEWSGPLLQIEGNDITIQGASGSVLDPQGSRWWDGEGSNGGKTKPKFFAAHDLTPSSITNLNIRNTPVQAVSVNGVNGLTITGMTIDNSAGDSGGGHNTDGFDIGSSSNVVISGAKVYNQDDCVAVNSGTNITFTGGLCSGGHGLSIGSVGGRDDNTVQTVTFSNSQVTKSANGIRIKASAGDTGTIKGVTYTGTTLSGITGYGILIEQNYDGGDLHGSPTSGIPITNLVLQNISGSGGVLSSANNIAVVCGSGACSSWTWSNVVVTGGKKYGSCQNVPSVATC

SEQ ID NO: 25885 - protein, 397 aa, Trichoderma harzianum
MPSLSFTAALGLLSLLPAAQAGWNQNSNDNIVVYWGQNSGSVGQNRLSYYCQNAPDVDVINISFMVGITNLNLNLANVGNNCTSFPQAPNLLNCPQVAADIVECQQTYGKTIMMSLFGSTYTESGFSSSSAAVSAAQEMWAMYGPVQSGNSTPRPFGNAVVDGFDFDLEDPIENNMEPFAAELKSLMDAATSKKFWLSAAPQCPYPDVSDESFLDGQVAFDWVNVQFYNNGCGVSHYPADFNWATWDNWAKTVSANKNAKVLIGTPANVGGANAGSFPTDSQLSGAISLAKGTSSFGGVMLWDMAQLFSNTGYLAKIVADLGGSASTPPPPPPSTTLATVTRTSTAASGPTSSAPAGGNGGSVPQWGQCGGDGYTGPTQCQAPFKCVVESEWWSSCQ

SEQ ID NO: 25886 - protein, 505 aa, Trichoderma harzianum
MYRKLAAISAFLAAARAQQVCTQQAETHPPLTWQKCTASGCTAQSGSVVLDANWRWTHDTKSTTNCYDGNTWSSTLCPDDATCAKNCCLDGANYSGTYGVTTSGDALTLQFVTASNVGSRLYLMANDSTYQEFTLSGNEFSFDVDVSQLPCGLNGALYFVSMDADGGQSKYPGNAAGAKYGTGYCDSQCPRDLKFINGQANVEGWEPSSNNANTGVGGHGSCCSEMDIWEANSISEALTPHPCETVGQTMCSGDACGGTYSNDRYGGTCDPDGCDWNPYRLGNTSFYGPGSSFALDTTKKLTVVTQFATDGSISRYYVQNGVKFQQPSASVGSYTGNTINTAYCAAEQTAFGGTSFTDKGGLAQINKAFQGGMVLVMSLWDDYAVNMLWLDSTYPTNATASTPGAKRGSCSTSSGVPAQVEAQSPNSKVIYSNIRFGPIGSTGGNTGSNPPGTSTTRAPPSSTGSSPTATQTHYGQCGGTGWTGPTRCASGFTCQVLNPFYSQCL

SEQ ID NO: 25887 - protein, 423 aa, Trichoderma harzianum
MLSFLGKSVALLAALQATLSSPKPGHRRASVEKRANGYANSVYFTNWGIYDRNFQPADLVASDVTHVIYSFMNLQADGTVISGDTYADYEKHYADDSWNDVGTNAYGCVKQLFKVKKANRGLKVLLSIGGWTWSTNFPSAASTDANRKNFAKTAITFMKDWGFDGIDIDWEYPADATQASNMILLLKEVRSQRDAYAAQYAPGYHFLLTIAAPAGKDNYSKLRLADLGQVLDYINLMAYDYAGSFSPLTGHDANLFNNPSNPNATPFNTDSAVKDYINGGVPANKIVLGMPIYGRSFQNTAGIGQTYNGVGSGSWEAGIWDYKALPKAGATVQYDSVAKGYYSYNSATKELISFDTPDMINTKVAYLKSLGLGGSMFWEASADKKGADSVIGTSHRALGGLDTTQNLLSYPNSKYDNIKNGLN

SEQ ID NO: 25888 - protein, 143 aa, Trichoderma harzianum
MKFLTVAAVFFTAVLAAPGNYPPPPPPTYAPPPPTYTLPPNGNGGGNGNGNGNGNGGGNGNGNGNTNTGGSALCPAGLYSNPQSCATDVLGLADLDCAVPSTTPHDGPNFQSICVANGGKRARCCVLPVLGLGVLCQNPVGTN

SEQ ID NO: 25889 - protein, 762 aa, Trichoderma harzianum
MLKLTALVALLLGAASATPTPSPPASDEGITKRATSFYYPNMDHVNAPRGFAPDLDGDFNYPIYQTVNAGDGNALQNAITTDGKGGSRHPQWFASQPRVVYIPPGTYTISKTLRFNTDTILMGDPTNPPIIKAAAGFSGDQTLISAQDPSTNEKGELSFAVAIKNVVLDTTAIPGGNSFTALWWGVAQAAHLQNVRITMSSSSGGNGHTGIRMGRGSTLGLADVRVERGQNGIWIDGHQQASFHNIYFFQNTIGMLISSGNTFSIFSSTFDTCGTAFPTLAGSPWIALIDAKSINSGVTFTTNQFPSFMIENLTKDNGTPVVVVRGSTLVGASSHVNTYSYGNTVGRNPTYGDVTSSNTRPSALAPGGRYPYVAPPTYGDLPISSFLNVKDPAQNGNRQVKGDNTINEADTLNAILELAASQNKVAYFPFGKYRVDSTLFIPKGSRIVGEAWATITGNGNFFKNENSPQPVVSVGRAGDVGIAQLQDLRVTTNDVLPGAILVQFNMAGNNPGDVALWNSLVTVGGTRGAQALANACTNNSNECKGAFIGIHVAKGSSPYIQNVWELGLRDHIAENFSGGTSHRRERWNFGPIRRNATCLYPIGSGHWWLYQLNLHNAANVVVSLLQAETNYHQGANTQQIPPAPWVANVGTWGDPDFSWCNGGDKRCRMGPANFINGGSNIYTYASAAWAFFSGPGQGCAQFECQQTIHWIASTPSNLQAFGLCSKDSVNTLRLGDGTFINTQNGYTGGWTPGGGDVARYTT

SEQ ID NO: 25890 - protein, 89 aa, Trichoderma harzianum; identical to SEQ ID NO: 24572

SEQ ID NO: 25891 - protein, 490 aa, Trichoderma harzianum
MRYALIASMLGQAAISVAMPSEPAHSPRAAGAQAYASNQAGNYKLTSIAAPVQGNGSPGPSTWNLSIDDTSSGYKQKIVGFGAAVTDATVSAFNELSASTLSQLLDELMTGAGASFSLMRHTIGASDLSGDPAYTYDDNGGNADPGMTGFNLGDRGTAMATMLAQMKGLNSNLQIFGSPWSAPGWMKLNNAIDGNTNNNNLNDGYLTNNGAQYSAAFAQYFVKYIQAFESHGATINAITLQNEPLNSQAGYPTMYMFSYEQGDLIQNYVAPALKAAGLSTKIWAYDHNTDQPDFPEQVMGIAADDVSAVAWHCYATNLDWTVLTNFHNSYPNTDQYMTECWTPSTGAWNQAASFTMGPLQNWARGVAAWTLGTTAQDGPHLSSGGCGTCTGLVTINNGQYTFQTAYYMMAQFSKFMPVGATVLSGTGSYTYSGSGGVQSVASLNPDGTRTVVIENTFGNDIYIHLSTSSGQEWSGNVPTNSVTTWVLPAV

SEQ ID NO: 25892 - protein, 505 aa, Trichoderma harzianum
MYRKLAVISAFLAAARAQQVCTQQAETHPPLTWQKCTASGCTPQQGSVVLDANWRWTHDTKSTTNCYDGNTWSSTLCPDDATCAKNCCLDGANYSGTYGVTTSGDALTLQFVTASNVGSRLYLMANDSTYQEFTLSGNEFSFDVDVSQLPCGLNGALYFVSMDADGGQSKYPGNAAGAKYGTGYCDSQCPRDLKFINGQANVEGWEPSSNNANTGVGGHGSCCSEMDIWEANSISEALTPHPCETVGQTMCSGDSCGGTYSNDRYGGTCDPDGCDWNPYRLGNTSFYGPGSSFALDTTKKLTVVTQFATDGSISRYYVQNGVKFQQPNAQVGSYSGNTINTDYCAAEQTAFGGTSFTDKGGLAQINKAFQGGMVLVMSLWDDYAVNMLWLDSTYPTNATASTPGAKRGSCSTSSGVPAQVEAQSPNSKVIYSNIRFGPIGSTGGNTGSNPPGTSTTRAPPSSTGSSPTATQTHYGQCGGTGWTGPTRCASGYTCQVLNPFYSQCL

SEQ ID NO: 25893 - protein, 513 aa, Trichoderma koningii; identical to SEQ ID NO: 24642

SEQ ID NO: 25894 - protein, 470 aa, Trichoderma koningii
MIVGILTTLATLATLAASVPLEERQACSSVWGQCGGQNWSGPTCCASGSTCVYSNDYYSQCLPGAASSSSSTRASSTTARASSTTSRSSATPPPGSSTTRVPPVGSGTATYSGNPFVGVTPWANAYYASEVSSLAIPSLTGAMATAAAAVAKVPSSMWLDTFDKTPLMEQTLADIRTANKNGGNYAGQFVVYDLPDRDCAALASNGEYSIADGGVDKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEQLYIHAIGPLLANHGWSNAFFITDQGRSGKQPTGQQQWGDWCNVIGTGFGIRPSANTGDSLLDSFVWIKPGGECDGTSDSSAPRFDSHCALPDALQPAPQAGAWFQAYFVQLLTNANPSFL

SEQ ID NO: 25895 - protein, 470 aa, Trichoderma koningii
MIVGILTTLATLATLAASVPLEERQACSSAWGQCGGQNWSGPTCCASGSTCVYSNDYYSQCLPGAASSSSSTRASSTTARASSTTSRSSATPPPGSSTTRVPPVGSGTATYSGNPFVGVTPWANAYYASEVSSLAIPSLTGAMATAAAAVAKVPSFMWLDTFDKTPLMEQTLADIRTANKNGGNYAGQFVVYDLPDRDCAALASNGEYSIADGGVDKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEQLYIHAIGPLLANHGWSNAFFITDQGRSGKQPTGQQQWGDWCNVIGTGFGIRPSANTGDSLLDSFVWIKPGGECDGTSDSSAPRFDSHCALPDALQPAPQAGAWFQAYFVQLLTNANPSFL

SEQ ID NO: 25896 - protein, 471 aa, Trichoderma koningii; identical to SEQ ID NO: 24653

SEQ ID NO: 25897 - protein, 470 aa, Trichoderma longibrachiatum
MIVGILTTLATLATLAASVPLEERQACSSVWGQCGGQNWSGPTCCASGSTCVYSNDYYSQCLPGAASSSSSTRASSTTARASSTTSRSSATPPPGSSTTRVPPVGSGTATYSGNPFVGVTPWANAYYASEVSSLAIPSLTGAMATAAAAVAKVPSFMWLDTFDKTPLMEQTLADIRTANKNGGNYAGQFVVYDLPDRDCAALASNGEYSIADGGVDKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEQLYIHAIGPLLANHGWSNAFFITDQGRSGKQPTGQQQWGDWCNVIGTGFGIRPSANTGDSLLDSFVWIKPGGECDGTSDSSAPRFDSHCALPDALQPAPQAGAWFQAYFVQLLTNANPSFL

SEQ ID NO: 25898 - protein, 461 aa, Trichoderma longibrachiatum
MAPSVTLPLTTAMLALVRLVAAQQPGTSTPEVHPKLTTYKCTTSGGCVAQDTSVVLDWNYRWMHDANYNSCTVNGGVNTTLCPDEATCGKNCFIEGVDYAASGVTASGSTLTLNQYMPSSSGGYSSVSPRLYLLGPDGEYVMLKLNGQELSLDVDLSALPCGENGSLYLSQMDENGGANQYNTAGANYGSGYCDAQCPVQTWRNGTLNTSGQGFCCNEMDILEGNSRANALTPHSCTATACDSAGCGFNPYGSGYPNYFGPGDTVDTSKPFTIITQFNTDNGSPSGNLVSITRKYRQNGVDIPSAKPGGDTISSCPSASAYGGLATMGKALSSGMVLIFSIWNDNSQYMNWLDSGSAGPCSSTEGNPSNILANNPGTHVVYSNIRWGDIGSTTNSTGGNPPPPPASSTTFSTTRRSSTTSSSPSCTQTHWGQCGGIGYTGCKTCTSGTTCQYGNDYYSQCL

SEQ ID NO: 25899 - protein, 437 aa, Trichoderma longibrachiatum
MMMLSKSLVAAATAASALAAVLQTVPRASSFVTISGTQFDIDGKVGYFAGTNCYWCSFLTNQADVDSTFSHIASSGLKVVRVWGFNDVNTQPSPGQIWFQKLSATGSTINTGVDGLQTLDYVVKSAEQHNLKLVIPFVNNWNDYGGINAYVNAFGGNATTWFTNSAAQTQYRKYIQAVVSRYANSTAIFAWELANEPRCNGCSTDVIVQWATSVSQYVKSLDANHLVTLGDEGLGLSTGDSSYPYTYGEGTDFAKNVQIKSLDFGTFHLYPDSWGTNYTWGNGWIQTHAAACLAAGKPCLFEEYGAQQNPCANEAPWQTTSLTTRGMGGDLFWQWGDTFANGAQSNSDPYTVWYNSSNWQCLVKNHVDAINGGTTTPPPVSSTTTTSSRTSSTPPPPGGSCTQLYGQCGGYGYTGPTCCAQGTCTYLNYWYSQCLSA

SEQ ID NO: 25900 - protein, 462 aa, Trichoderma longibrachiatum
MAPSVTLPLTTAMLAHVRLVAAQQPGTSTPEVHPKLTTYKCTTSGGCVAQDTSVVLDWNYRWMHDANYNSCTVNGGVNTTQCPDEATCGKNCFIEGVDYAASGVTASGSTLTLNQYMPSSSGRYSSVSPRLYLLRPDGEYVMLKLNGEELSLDVDLSALPCGENGSLYLSQMDENGGANQYNTAGANYGSGYCDAQCPVQTWRNGTLNTSGKGFCCNEMDILEGNPRANALTPHSCTATACDSAGCGFNPYGSGYPNYFAAGDTVDTSKPFTIITQFNTDNGSPSGNLVSITRKYRQNGVDIPSAKPGGDTISSCPSASAYGGLATMGKALSSGMVLIFSIWNDNSQYMNWLDSGSAGPCSSTEGNPSNILANNPGTHVVYSNIRWGDIGSTTNSTGGNPPPPPASSTTFSTTRRSSTTSSSPSCTQTHYAQCGGIGYTGCQTCTSGTTCQYGNDYYSQCLL

SEQ ID NO: 25901 - protein, 461 aa, Trichoderma longibrachiatum
MAPSATLPLTTAMLALVRLVAAQQPGTSTPEVHPKLTTYKCTTSGGCVAQDTSVVLDWNYRWMHDANYNSCTVNGGVNTTLCPDEAACGKNCFIEGVDYAASGVTASGSTLTLNQYMPSSSGGYSSVSPRLYLLGPDGEYVMLKLNGQELSFDVGLSALPCGENGPLYLSQMDENGGANQYNTAGANYGSGYCDAQCPVQTWRNGTLNTSGQGFCCNEMDILEGNSRANALTPHSCTATACDSAGCGFNPYGSGYPNYFGPGDTVDTSKPFTIITQFNTDNGSPSGNLVSITRKYRQNGVDIPNAKPGGDTISSCPSASAYGGLATMGKALSSGMVLIFSIWNDNSQYMNWLDSGSAGPCSSTEGNPSNILANNPGTHVVYSNIRWGDIGSTTNSTGGNPPPPPASSTTFSTTRRSSTTSSSPSCTQTHWGQCGGIGYTGCKTCTSGTTCQYGNGYYSQCL

SEQ ID NO: 25902 - protein, 463 aa, Trichoderma longibrachiatum
MAPSATLPLTTAILAIGRLVAAQQPGTSTPEVHPKLTTYKCTTSGGCVAQDTSVVLDWNYRWMHDANYNSCTVNGGVNTTLCPDEATCGKNCYIEGVDYAASGVTASGSTLTLNQYMPSSSGGYSSVSPRLYLLGPDGEYVMLKLNGQELSFDVDLSALPCGENGSLYLSQMDENGGANQYNTAGANYGSGYCDAQCPVQTWRNGTLNTSGQGFCCNEMDILEGNSRANALTPHSCTATACDSAGCGFNPYGSGYPNYFGPGDTVDTSKTFTIITQFNTDNGSPSGNLVSITRKYRQNGVDIPSAKPGGDTISSCPSASAYGGLATMGKALSSGMVLVFSIWNDNSQYMNWLDSGRAGPCSSTEGNPSNILANNPGTHVVYSNIRWGDIGSTTNSTGGNPPPPPPPASSTTFSTTRRSSTTSSSPSCTQTHWGQCGGIGYTGCKTCTSGTTCQYGNDYYSQCL

SEQ ID NO: 25903 - protein, 470 aa, Trichoderma parceramosum
MIVGILTTLATLATLAASVPLEERQACSSVWGQCGGQNWSGPTCCAAGSTCVYSNDYYSQCPPGAASSSSSTRASSTTNRVSSTTSTSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTILVIEPDSLANLVTNLGTPKCANAQSAYLECINYAITQLNLPNIAMYLDAGHAGWLGWPANQDPAAQLFANVYKNASSPSALRGLATNVANYNGWNITSPPSYTQGNAVYNEKLYIHAIGPLLANHGWSNAFFITDQGRSGKQPTGQQQWGDWCNVIGTGFGIRPSSNTGDSLLDSFVWVKPGGECDGTSDSSAPRFDSHCALPDALQPAPQAGAWFQAYFVQLLTNANPSFL

SEQ ID NO: 25904 - protein, 346 aa, Trichoderma saturnisporum
MIQKLSNLLVAALTVATGVVGHGHINNIVINGVYYQAYDPTSFPYESNPPIVVGWTAADLDNGFVSPDAYGSPDIICHKNATNAKGHASVRAGDTVLFQWVPLPWPHPGPIVDYLANCNGDCETVDKTSLEFFKIDGVGLISGGDPGNWASDVLIANNNTWVVKIPDDLAPGNYVLRHEIIALHSAGQANGAQNYPQCFNLAVSGSGSLKPSGVKGTALYHATDPGVLINIYTSPLNYIIPGPTVVSGLPTSVAQRSSAATATASATLPGGGGSPPGGPTSRPTTTARSTSQASSRPSPPATTSAPAGGPTQTLYGQCGGSGYSGPTRCAPPATVSTLNPYYARLN

SEQ ID NO: 25905 - protein, 419 aa, Trichoderma sp. C-4
MNKPMSSLLLAATLLAGGSIAQQTVWGQCGGQGWSGPTSCVAGSACSTLNPYYAQCIPGATTMSTTTKPTSVSASTTRASATSSATPPPSSGLTRFAGVNIAGFDFGCGTDGTCVTSKVYPPLKNYAGTNNYPDGVGQMQHFVNDDKLTIFRLPVGWQYLVNNNLGGTLDSNNFGKYDQLVQACLSLGVYCIVDIHNYARWNGGIIGQGGPTNDQFTSLWSQLAQKYASQSKVWFGIMNEPHDVNINTWATTVQAVVTAIRNAGATSQFISLPGNDWQSAGAFISDGSAAALSQVKNPDGSTPNLIFDLHKYLDSDNSGTHADCVTNNVNDAFSPVATWLRQNNRQAILTETGGGNTQSCIQYLCQQFQYINQNSDVYLGYVGWGAGSFDSTYILTETPTGSGSSWTDTSLVSSCISRK

SEQ ID NO: 25906 - protein, 461 aa, Trichoderma sp. SSL
MAPSVTLPLTTAMLALVRLVAAQQPGTSTPEVHPKLTTYKCTTSGGCVAQDTSVVLDWNYRWMHDANYNSCTVNGGVNTTLCPDEATCGKNCFIEGVDYAASGVTASGSTLTLNQYMPSSSGGYSSVSPRLYLLGPDGEYVMLKLNGQELSFDVDLSALPCGENGSLYLSQMDENGGANQYNTAGANYGSGYCDAQCPVQTWRNGTLNTSGQGFCCNEMDILEGNSRANALTPHSCTATACDSAGCGFNPYGSGYPNYFGPGDTVDTSKPFTIITQFNTDNGSPSGNLVSITRKYRQNGVDIPSAKPGGDTISSCPSASAYGGLATMGKALSSGMVLIFSIRNDNSQYMNWLDSGSAGPCSSTEGNPSNILANNPGTHVVYSNIRWGDIGSTTNSTGGNPPPPPASSTTFSTTRRSSTTSSSPSCTQTHWGQCGGIGYTGSKTCTSGTTCQYGNDYYSQCL

SEQ ID NO: 25907 - protein, 418 aa, Trichoderma sp. SSL
MNKSVAPLLLAASTLVGGVAAQQTVWGQCGGIGWGGPTNCAPGSACSTLNSYYAQCIPGATSMTTSTRPPSGPTTTTRATSTTSSTPPTSSGDRFVGVNVAGFDFGCSTDGTCVTSKVYPPLKNFTGSNNYPDGIGQMQHFVNDDGMTIFRLPVGWQYLVNNNLGGPLDPTSISKYDQLVQGCLSLGVYCIVDIHNYARWNGGIIGQGGPTNAQFTSLWSQLASKYASQSRVWFGIMNEPHDVNINTWAATVQEVVTAIRNAGATSQYISLPGNDWQSAAAFISDGSAAALSQVTNPDGSTTNLIFDLHKYLDSDNSGTHAECTTNNIDGAFAPLATWLRQNNRQAILTETGGGNVQSCIQYLCQQVQYLNQNSDVYLGYVGWGAGSFDNTYVLTETPTGSGNSWTDTSLVSSCLARK

SEQ ID NO: 25908 - protein, 347 aa, Trichoderma sp. SSL
MIQKLSNLLLTALAVATGVVGHGHINNIVVNGVYYQGYDPTSFPYESDPPIVVGWTAADLDNGFVSPDAYQSPDIICHKNATNAKGHASVKAGDTIPLQWVPVPWPHPGPIVDYLANCNGDCETVDKTSLEFFKIDGVGLISGGDPGNWASDVLIANNNTWVVKIPEDLAPGNYVLRHEIIALHSAGQADGAQNYPQCFNLAVPGSGSLQPSGVKGTALYHSDDPGVLINIYTSPLAYTIPGPSVVSGLPTSVAQGSSAATATASATVPGGSGPGNPTSKTTTTARTTQASSSRASSTPPATTSAPGGGPTQTLYGQCGGSGYSGPTRCAPPATCSTLNPYYAQCLN

SEQ ID NO: 25909 - protein, 514 aa, Trichoderma sp. XST1
MYRKLAVISAFLATARAQSACTLQTETHPSLTWQKCSSGGTCTQQTGSVVIDANWRWTHATNSSTNCYDGNTWSSTLCPDNETCAKNCCLDGAAYASTYGVTTSADSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSNDRYGGTCDPDGCDWNPYRLGNTSFYGPGSSFTLDTTKKLTVVTQFETSGAINRYYVQNGVTYKQPNAELGSYSGNELNDDYCTAEESEFGGSSFSDKGGLTQFKKATSGGMVLVMSLWDDYYANMLWLDSTYPTNETSSTPGAVRGSCSTSSGVPAQLESQSPNAKVVYSNIKFGPIGSTGNPSGGNPPGGNPPGTTTTRRPATTTGSSPGPTQTHYGQCGGIGYSGPTVCASGTTCQVLNEYYSQCL

SEQ ID NO: 25910 - protein, 470 aa, Trichoderma sp. XST1
MIVGILTTLATLATLAASVPLEERQACSSVWGQCGGQNWSGPTCCASGSTCVYSNDYYSQCLPGAASSSSSTRASSTTARASSTTSRSSATPPPGSSTTRVPPVGSGTATYSGNPFVGVTPWANAYYASEVSSLAIPSLTGAMATAAAAVAKVPSFMWLDTFDKTPLMEQTLADIRTANKNGGNYAGQFVVYDLPDRDCAALASNGEYSIADGGVDKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEQLYIHAIGPLLANHGWSNAFFITDQGRSGKQPTGHQQWGDWCNVIGTGFGIRPSANTGDSLLDSFVWIKPGGECDGTSDSSAPRFDSHCALPDALQPAPQAGAWFQAYFVQLLTNANPSFL

SEQ ID NO: 25911 - protein, 396 aa, Trichoderma tomentosum
MPSFSFTAALGLLSLLPAAQAGWNQNSNNNIVVYWGQNSGSVGQNRLSYYCQNAPDVDVINISFMVGITNLNLNLANVGNNCTSFPQAPNLLNCPQVAADIVECQQTYGKTIMMSLFGSTYSESGFSSSSAAVSAAQEIWAMYGPVQSGNSTPRPFGTAVVDGFDFDLEDPIENNMEPFAAELKSLMDSNTSKKFWLSAAPQCPYPDVSDESFLDGQVAFDWVNVQFYNNGCGVSHYPTDFNWATWDNWAKTVSANKNAKVLIGTPANTGGANAGSFPTDSQLSGAISLAKGTSSFGGVMLWDMAQLFTNTGYLAKIVADLGGSASTPPPPASTTLTTVTRSSTAASGPTSSAPPSGGNGGVAQWDQCGGDGYTGPTQCQSPFKCVVESEWWSSCQ

SEQ ID NO: 25912 - protein, 471 aa, Trichoderma viride; identical to SEQ ID NO: 24639

SEQ ID NO: 25913 - protein, 397 aa, Trichoderma viride
QQTVWGQCGGIGWSGPTNCAPGSACSTLNSYYAQCIPGATSMTTSTRPPSGPTTTTRATSTTSSTPPTSSGDRFVGVNVAGFDFGCSTDGTCVTSKVYPPLKNFTGSNNYPDGIGQMQHFVNDDGMTIFRLPVGWQYLVNNNLGGPLDPTSISKYDQLVQGCLSLGVYCIVDIHNYARWNGGIIGQGGPTNAQFTSLWSQLASKYASQSRVWFGIMNEPHDVNINTWAATVQEVVTAIRNAGATSQYISLPGNDWQSAAAFISDGSAAALSQVTNPDGSTTNLIFDLHKYLDSDNSGTHAECTTNNIDGAFAPLATWLRQNNRQAILTETGGGNVQSCIQYLCQQVQYLNQNSDVYLGYVGWGAGSFDNTYVLTETPTGSGNSWTDTSLVSSSLARK

SEQ ID NO: 25914 - protein, 515 aa, Trichoderma viride
MYRKLAVISAFLATARAQSACTLQTETHPSLTWQKCSSGGTCTQQTGSVVIDANWRWTHATNSSTNCYDGNTWSSTLCPDNETCAKNCCLDGAAYASTYGVTTSADSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSNDRYGGTCDPDGCDWNPYRLGNTSFYGPGSSFTLDTTKKLTVVTQFETSGAINRYYVQNGVTYKQPNAELGSYSGNELNDDYCTAEESEFGGSSFSDKGGLTQFKKATSGGMVLVMSLWDDYYANMLWLDSTYPTNETSSTPGAVRGSCSTSSGVPAQLESQSPNAKVVYSNIKFGPIGSTGNPSGGNPPGGNPPGTTTTRRPATTTGSSPGPTQTHYGQCGGIGYSGPTVCASGTTCQVLNEYYSQCPV

SEQ ID NO: 25915 - protein, 514 aa, Trichoderma viride
MYQKLAVISAFLATARAQSACTLQTETHPSLTWQKCSSGGTCTQQTGSVVIDANWRWTHATNSSTNCYDGNTWSSTLCPDNETCAKNCCLDGAAYASTYGVTTSADSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSNDRYGGTCDPDGCDWNPYRLGNTSFYGPGSSFTLDTTKKLTVVTQFETSGAINRYYVQNGVTYKQPNAELGSYSGNELNDDYCTAEESEFGGSSFSDKGGLTQFKKATSGGMVLVMSLWDDYYANMLWLDSTYPTNETSSTPGAVRGSCSTSSGVPAQLESQSPNAKVVYSNIKFGPIGSTGNPSGGNPPGGNPPGTTTTRRPATTTGSSPGPTQTHYGQCGGIGYSGPTVCASGTTCQVLNEYYSQCL

SEQ ID NO: 25916 - protein, 418 aa, Trichoderma viride
MNRTMAPLLLAASTLVGGVAAQQTVWGQCGGIGWSGPTNCAPGSACSTLNSYYAQCIPGATSITTSTRPPSGPTTTTRATSTTSSTPPTSSGDRFVGVNVAGFDFGCSTDGTCVTSKVYPPLKNFTGSNNYPDGIGQMQHFVNDDGMTIFRLPVGWQYLVNNNLGGALDPTSISKYDQLVQGCLSLGVYCIVDIHNYARWNGGIIGQGGPTNAQFTSLWSQLASKYASQSRVWFGIMNEPHDVNINTWAATVQEVVTAIRNAGATSQYISLPGNDWQSAAAFISDGSAAALSQVTNPDGSTTNLIFDVHKYLDSDNSGTHAECTTNNIDGAFAPLATWLRQNNRQAILTETGGGNVQSCIQYLCQQVQYLNQNSDVYLGYVGWGAGSFDNTYVLTETPTGSGNSWTDTSLVSSCLARK

SEQ ID NO: 25917 - protein, 470 aa, Trichoderma viride
MIVGILTTLATLATLAASVPLEERQACSSVWGQCGGQNWSGPTCCASGSTCVYSNDYYSQCLPGAASSSSSTRASSTTARASSTTSRSSATPPPGSSTTRVPPVGSGTATYSGNPFVGVTPWANAYYASEVSSLAIPSLTGAMATAAAAVAKVPSFMWLDTFDKTPLMEQTLADIRTANKNGGNYAGQFVVYDLPDRDCAALASNGEYSIADGGVDKYKNYIDTIRQIVVEYSDIRTLLVIEPDSLANLVTNLGTPKCANAQFAYLECINYAVTQLNLPNVAMYLDAGHAGWLGWPANQDPAAQLFANVYKNASSPRALRGLATNVANYNGWNITSPPSYTQGNAVYNEQLYIHAIGPLLANHGWSNAFFITDQGRSGKQPTGQQQWGDWCNVIGTGFGIRPSANTGDSLLDSFVWIKPGGECDGTSDSSAPRFDSHCALPDALQPAPQAGAWFQAYFVQFLTNANPSFL

SEQ ID NO: 25918 - protein, 344 aa, Trichoderma viride
MIQKLSNLLVTALAVATGVVGHGHINDIVINGVWYQAYDPTTFPYESNPPIVVGWTAADLDNGFVSPDAYQNPDIICHKNATNAKGHASVKARDTILFQWVPVPWPHPGPIVDYLANCNGDCETVDKTTLEFFKIDGVGLLSGGDPGTWASDVLISNNNTWVVKIPDNLAPGNYVLRHEIIALHSAGQANGAQNYPQCFNIAVSGSGSLQPSGVLGTDLYHATDPGVPINIYTSPLNYIIPGPTVVSGLPTSVAQGSSAATATASATAPGGGSGPTSRTTTTARTTQASSRPSSTPPATTSAPAGGPTQTLYGQCGGSGYSGPTRCAPPATCSTLNPYYAQCLN

SEQ ID NO: 25919 - protein, 459 aa, Trichoderma viride
MAPSVTLPLTTAILAIARLVAAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYISVSPRLYLLDSDGEYVMLKLNGQELSFDVDLSALPCGENGSLYLSQMDENGGANQYNTAGANYGSGYCDAQCPVQTWRNGTLNTSHQGFCCNEIDILEGNSRANALTPHSCTGTACDSAGCSFNPYGSGYKSYYGPGDTVDTSKTFTIITQFNTDNGSPSRNFVGITRKYQQNGVDIPSAQPGGDTISSCPSASAYGGLATMGKALSSGMVLVFSIRNDNSQYMNWLDSGNAGRCSSTEGNPSNILPNNPNTHFVFSNICWGDIGSTTNSTAPPPPPASSTTFSTTRRSSTTSSSPSCTQTHWGQCGAIGCSGCKTCTSGTTCQYSNDYYSQCL

SEQ ID NO: 25920 - protein, 344 aa, Trichoderma viride; identical to SEQ ID NO: 24636

SEQ ID NO: 25921 - protein, 418 aa, Trichoderma viride
MNRTMAPLLLAASILFGGAAAQQTVWGQCGGIGWSGPTSCAPGSACSTLNPYYAQCIPGATSITTSTRPPSGPTTTTRATSTTSSPPPTSSGVRFAGVNIAGFDFGCTTDGTCVTSKVYPPLKNFTGANNYPDGIGQMQHFVNDDGMTIFRLPVGWQYLVNNNLGGTLDSTSISKYDQLVQGCLSLGVYCIIDIHNYARWNGGIIGQGGPTNAQFTSLWSQLASKYASQSRVWFGIMNEPHDVNINTWAATVQEVVTAIRNAGATSQYISLPGNDYQSAAAFISDGSAAALSQVTNPDGSTTNLIFDVHKYLDSDNSGTHAECTTNNIDGAFAPLATWLRQNNRQAILTETGGGNVQSCIQDLCQQIQYLNQNSDVYLGYAGWGAGSFDSTYILTETPTGSGNSWTDTSLVSSCLARK

SEQ ID NO: 25922 - protein, 514 aa, Trichoderma viride
MYQKLALISAFLATARAQSACTLQAETHPPLTWQKCSSGGTCTQQTGSVVIDANWRWTHATNSSTNCYDGNTWSSTLCPDNETCAKNCCLDGAAYASTYGVTTSADSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICDGDSCGGTYSGDRYGGTCDPDGCDWNPYRLGNTSFYGPGSSFTLDTTKKLTVVTQFETSGAINRYYVQNGVTFQQPNAELGDYSGNSLDDDYCAAEEAEFGGSSFSDKGGLTQFKKATSGGMVLVMSLWDDYYANMLWLDSTYPTNETSSTPGAVRGSCSTSSGVPAQLESNSPNAKVVYSNIKFGPIGSTGNSSGGNPPGGNPPGTTTTRRPATSTGSSPGPTQTHYGQCGGIGYSGPTVCASGSTCQVLNPYYSQCL

SEQ ID NO: 25923 - protein, 15 aa, Trichoderma viride
SYPNKQPYGPSGFWM

SEQ ID NO: 25924 - protein, 89 aa, Trichoderma viride
MQFSIVALFATGALASVSVCPNGLYSNPRCCGANVLGVAALDCHTPRVDVLTGPIFQAVCAAEGGKQPLCCVVPVAGQDLLCEEAQGTF

SEQ ID NO: 25925 - protein, 471 aa, Trichoderma viride
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAPSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 25926 - protein, 514 aa, Trichoderma viride
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWDPYRLGNTSFYGPGSSFTLDTTKKLTVVTQFETSGAINRYYVQNGVTFQQPNAELGSYSGNGLNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGDPSGGNPPGGNPPGTTTTRRPATTTGSSPGPTQSHYGQCGGIGYSGPTVCASGTTCQVLNPYYSQCL

SEQ ID NO: 25927 - protein, 247 aa, Trichoderma viride
MKATLVLGSLIVGAVSAYKATTTRYYDGQEGACGCGSSSGAFPWQLGIGNGVYTAAGSQALFDTAGASWCGAGCGKCYQLTSTGQAPCSSCGTGGAAGQSIIVMVTNLCPNNGNAQWCPVVGGTNQYGYSYHFDIMAQNEIFGDNVVVDFEPIACPGQAASDWGTCLCVGQQETDPTPVLGNDTGSTPPGSSPPATSSSPPSGGGQQTLYGQCGGAGWTGPTTCQAPGTCKVQNQWYSQCLPWEGPR

SEQ ID NO: 25928 - protein, 418 aa, Trichoderma viride; identical to SEQ ID NO: 24661

SEQ ID NO: 25929 - protein, 459 aa, Trichoderma viride
MAPSVTLPLTTAILAIARLVAAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFNPYGSGYKSYYGPGDTVDTSKTFTIITQFNTDNGSPSGNLVGITRKYQQNGVDIPSAQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQCL

SEQ ID NO: 25930 - protein, 266 aa, Tsukamurella paurometabola
  strain ATCC 8368 / DSM 20162 / JCM 10117 / NBRC 16120 / NCTC 13040
MPSRTTHALIGATAALAAALTVAPVATAAPSPAPKPASDTKPKPDDQFADSSRTVVTRDGWKMVVTKTSEALRSVPPLNRSPQSFEAFSTIGGEATVAVADPKKPPKSKVKSAVLTTGLQVGCAVTADSLTVGGSISNATNVGVTPSVTANLTGTATGQGGTSGGSGGGSVSAGVTPGISATVGDTLTETGSISGVIKPGTSKDIPYAKKNLEGPDAATYTREVRVAVDNCIGGVQVRSYATIALQTDRTDDSITTYGKPIFITRP

SEQ ID NO: 25931 - protein, 222 aa, Tsukamurella paurometabola
  strain ATCC 8368 / DSM 20162 / JCM 10117 / NBRC 16120 / NCTC 13040
MGKPLSMSGRHRKQSTTGRTAAKVAATGALLGGATLAFSAPAANAAPDSQWDQVAKCESGGNWSINTGNGYHGGLQFSPSTWSAYGGQKYAPTANQASKAQQIAIAEKVLAGQGKGAWPSCGTGLGAATQRDVPTESAASPAKPAVQKPAVQKPAIQKPAAQKPAAQKPAAQKPAAPKPAVKPGQSVNAAYIQQVISQAQNGGQQVDPAVLAMLQQAAAKGY

SEQ ID NO: 25932 - protein, 107 aa, Tsukamurella paurometabola
  strain ATCC 8368 / DSM 20162 / JCM 10117 / NBRC 16120 / NCTC 13040
MKNIRKTLGMMAISGAIVAAPVAFGTGAANAGSVNWDAIAACESGGNWSTNTGNGYYGGLQFSPSTWRANGGSGLPHNASRAEQIRVAENVLASQGIGAWPSCGGRG

SEQ ID NO: 25933 - protein, 428 aa, Tsukamurella paurometabola
  strain ATCC 8368 / DSM 20162 / JCM 10117 / NBRC 16120 / NCTC 13040
MSEIIQVGAREILDSRGNPTVEVEIVLADGSFARAAVPSGASTGEHEAVELRDGGERYGGKGVTKAVEGVLEVIAPEVIGIPADEQRIIDQTLLDLDGTPDKSRLGANALLGVSLAASKAAAESAALPLFRYLGGPNAHILPVPMMNILNGGAHADSGVDVQEFMVAPIGAETFKESLRWGTEVYHSLKSVLKSKGLNTGLGDEGGFAPSVGGTREALELISEAIGKTGLKLGSDVALALDVAATEFYTAGSGYKFEGKVLSAAEMGEFYAKLITEFPLVSIEDPLSEDDWEGWVDLTDAVGDKIQLVGDDLFVTNPERLEDGIARGAGNALLVKVNQIGTLTETLDAVALAHNNGYKTMMSHRSGETEDTTIADLAVAVGSGQIKTGAPARSERVAKYNQLLRIEEELGDAARYAGDTAFPRFEFTS

SEQ ID NO: 25934 - protein, 485 aa, Tsukamurella paurometabola
  strain ATCC 8368 / DSM 20162 / JCM 10117 / NBRC 16120 / NCTC 13040
MPELDADNTTTADQRDGAQSGPEVLPATGQRTAEFDVARVQRRISGIDGSTVDLQVDQEILDLEAEVYGDEAADIATAEAEPATVEEPATVEEPATDEAPETESAPSKSRLQGVATRLENGPVRALTGAMLVAVMAGGGTAAAMYTEVTVTVDGQPREVSTMSRSVKSILNSAGIAAGADDKVTPALNQSVSSDQPITVQHARDIAVNVNGTVRTVKTTDLSMGAALASAGLGDPKNFVSVPADAPVPLDGAAVSVVTPVPLVVTDSGTKVEASAAGRTVGEYLAKMGAPLIQQDSVTPAASAPIRPGMTINVVRNRVTDVTVSEPYTAPPKKIDDPKLTNGKTEIKDPGKPGKQDVQYREHVVNGKVVSREKLSSTVTEPGVPGVTAVGTAPGAPYVPQGSVWDKLVQCESTGNWSINTGNGFYGGVQFDYGTWLRHGGGKYAPRADLATREEQIDIARKTLKAQGWGAWPSCSSKLGLSGNSE

SEQ ID NO: 25935 - protein, 546 aa, Alicyclobacillus acidocaldarius
  Bacillus acidocaldarius
MNKRAMLGAIGLAFGLMAWPFGASAKEKSMVWNEQWKTPSFVSGSLLKGEDAPEELVYRYLDQEKNTFQLGGQARERLSLIGKQTDELGHTVMRFEQRYRGIPVYGAVLVAHVNDGELSSLSGTLIPNLDKRTLKTEAAISIQQAEMIAKQDVADAVTKERPAAEEGKPTRLVIYPDGETPRLAYEVNVRFLTPVPGNWIYMIDAADGKVLNKWNQMDEAKPGGGQPVAGTSTVGVGRGVLGDQKYINTTYSSYYGYYYLQDNTRGSGIFTYDGRNRTVLPGSLWADGDNQFFASYDAAAVDAHYYAGVVYDYYKNVHGRLSYDGSNAAIRSTVHYGRGYNNAFWNGSQMVYGDGDGQTFLPFSGGIDVVGHELTHAVTDYTAGLVYQNESGAINEAMSDIFGTLVEFYANRNPDWEIGEDIYTPGIAGDALRSMSDPAKYGDPDHYSKRYTGTQDNGGVHTNSGIINKAAYLLSQGGVHYGVSVTGIGRDKMGKIFYRALVYYLTPTSNFSQLRAACVQAAADLYGSTSQEVNSVKQAFNAVGVY

SEQ ID NO: 25936 - protein, 426 aa, Alicyclobacillus acidocaldarius
  strain Tc-4-1 Bacillus acidocaldarius
MSEIFDVHAREVLDSRGNPTVEVEVELESGAKGRAIVPSGASTGAHEAVELRDGDKGRYQGKGVLKAVKNVNEIITPEIIGEDALDQIAIDNLLISLDGTPNKGKLGANAILAVSIAVAKAAAAEVGLPLYRYLGGTYAHTLPTPMMNILNGGKHADNTVDIQEFMVVPHGAPTFREALRMGAEIFHSLKKVLADKGLSTTVGDEGGFAPNLKTNEEAIQVIVEAIEKAGYKPGEQASIALDIASTELYKDGQYHFEGEGVTRSADELIHFYEGLLSKYPILSIEDGLAEDDWDGWKNLTAALGGKVQLVGDDLFVTNVERLKMGIDRGVGNSILVKVNQIGTLTETFAAVELAKKNRYTAIISHRSGESEDTTIADIAVALNTGQIKTGAPSRTDRVAKYNQLLRIEEELGAAAAYAGRGAFVQG

SEQ ID NO: 25937 - protein, 120 aa, Alicyclobacillus acidocaldarius
  strain Tc-4-1 Bacillus acidocaldarius
MNSVKMTKTVGDVADGLGDTANDVFYVVNVTVKNNGTSPTTIDDSMFTLQANGSTYDADTNADVDDNTDANNDMFLNQLNPGVSMSGNVVFDVPPNLTKNVDMVIQGGMLGLAQATVQLT

SEQ ID NO: 25938 - protein, 690 aa, Alicyclobacillus acidocaldarius
  strain Tc-4-1 Bacillus acidocaldarius
MTNTSQGDLDYCAWLQESPLTHGVPEAARRMAVYGPADDPVLRIAAAEWARAVRAAFGESLAPLAADPGGVPSAPCVAIGLLSAMPRGLREAAQAALAGVPSDEAYAILPVDGQGTAVVSRTPAGVLYGVFHLIRRLRLCESLHEPCVSSPKNAWRMLDHWDNADGTIERGYAGKSLFFRGGQIDFDGARVRDYARLLASIGVNAIAINNVNVHETETRFLTEAHLPSVARLADVFRPYGIRLFLSINFASPVDLGDLPIADPLDPRVQDWWSAAADRIYQHIPDFGGFLVKADSEFRPGPFTYGRDHADGANMLARALAPHGGVVIWRAFVYNCLMDWRDRRADRARAAYDHFVPLDGRFLDNVLIQIKNGPMDFQVREPVSPLVGGLSATNVMLEFQITQEYTGQQRHVCYLAPMWKEVLDFDTHARGPGSTVAEIASGRLFGRPHGGVAGVANVGDDVNWTGHSLAQANLYAFGRLAWDPSLDPAEIAHEWARLTYGDDPDVVRAVVGILMASWPAYEAYTAPLGVGWMVNPGHHDGPNPEGYEYSKWGTYHYADWQGVGVDRTMATGTGYTGQYHEPVRSLYEHLETCPDELLLFFHHVPYTHVLHSGKTVIQHIYDAHFDGVEAVAWMMEAWRRLQGRIDPVRFERVLARLEDQMQRAIEWRDVINTYFYRKCGIPDERGRHIYP

SEQ ID NO: 25939 - protein, 342 aa, Alicyclobacillus acidocaldarius
  strain Tc-4-1 Bacillus acidocaldarius
MSQPNIPNINPSITLTRDDAVNLLLSSIALEELGLGHLTNAEAEKIQYVLGTLTGATGTQPSLDDLLTLNQSVNATLDNIIRKELILDSKLSNVMSLANVGPTGPTGPTGPTGPTGPTGPTGPTGPTGPTGPTGPTGPTGPTGPTGPTGPTGPTGPTGPTGPTGPTGPAGSSAIIPYASGLPVALTTVAGGLVGTTSLVGFGSSVTGVTLLGSGQIDLTGAGGTLLNFAFSMPRAGTITSIVAYFSATAALNLLGTTVTITAQLYESTTPNNTFSPIPGASVMLTPLTGTIAVGQIATGSATGLSIPVSAGTRLLLVFSATASGLSLVQTVAGYASAGVAIS

SEQ ID NO: 25940 - protein, 690 aa, Alicyclobacillus acidocaldarius
  subsp. acidocaldarius
  strain ATCC 27009 / DSM 446 / 104-1A Bacillus acidocaldarius
MTNIPEGDLDYRAWLQESPLPRAVPEAARRMAVYGPADDPLLCTAAAEWGRAVRAACGESPARLARDPGGAPSVPCVAMGLLSAMPRGLREAAQAALAGAPSDEAYAILPVDGQGVAVVSRTPAGVLYGVFHLIRRLRLGEPLHEPCVSSPKNAWRMLDHWDNADGTIERGYAGKSLFYRGGQIDFDEGRVRDYARLLASVGVNAIAINNVNVHETETRFLTEAHLPGVARLADVFRPYGIRVFLSINFASPVDLGDLPTADPLDPRVEDWWRATADRIYRHIPDFGGFLVKADSEFRPGPFTYGRDHADGANMLARALAPHGGVVIWRAFVYNCLMDWRDRRADRARAAYDHFVPLDGRFLDNVLIQIKNGPMDFQVREPVSPLFGGLSATNVMLEFQITQEYTGQQRHVCYLAPMWKEVLDFDTHARGPGSTVAEIASGRLFGRPHGGVAGVANVGDDVNWTGHSLAQANLYAFGRLAWDPSLDPAGIAREWARLTYGDDPDVVRTVVGILMASWPAYEAYTAPLGVGWMVNPGHHDGPNPEGYEYSKWGTYHYADWRGVGVDRTMATGTGYTGQYHEPMRSLYEHLETCPDELLLFFHHVPYTHVLHSGKTVIQHIYDAHFDGVEAVAWMIEAWRRLQGRIDPVRFERVLARLEDQMQRAVEWRDVINTYFYRKCGIPDARGLHIYP

SEQ ID NO: 25941 - protein, 333 aa, Alicyclobacillus acidocaldarius
  subsp. acidocaldarius
  strain ATCC 27009 / DSM 446 / 104-1A Bacillus acidocaldarius
MSQPNIPNINPSISITRDDAVNLLLSSIALEELGLGHLTNAEAEKIQYVLGTLTGATGTQPSLDDLLTLNQSVNATLDNIIRKELILDSKLSNVMSLANVGPTGPTGPTGPTGPTGPTGPTGPTGPTGPTGPTGPTGPTGPTGPTGPTGPTGPTGPTGPAGSSAIIPFASGLPVALTTVAGGLVGTTSLVGFGSSVTGVTVLGSGQIDLTGAGGTLLNFAFSMPRDGVITSIAAYFSATAALSLLGTTVNITAQLYESTTPNNTFSPIPGASVALPPLTGTISIGQIVSGITTGLSIPVTAGTRLLLVFSATASGLSLINTVVGYASAGVAIS

SEQ ID NO: 25942 - protein, 426 aa, Alicyclobacillus acidocaldarius
  subsp. acidocaldarius
  strain ATCC 27009 / DSM 446 / 104-1A Bacillus acidocaldarius
MSEIFDVHAREVLDSRGNPTVEVEVELESGAKGRAIVPSGASTGAHEAVELRDGDKGRYQGKGVLRAVKNVNEIITPEIIGEDALDQIAIDNLLISLDGTPNKGKLGANAILAVSIAVAKAAAAEVGLPLYRYLGGTYAHTLPTPMMNILNGGKHADNTVDIQEFMVVPHGAPTFREALRMGAEIFHSLKKVLADKGLSTTVGDEGGFAPNLKTNEEAIQVIVEAIEKAGYKPGEQASIALDIASTELYKDGQYHFEGEGVTRSADDLIHYYEGLLAKYPILSIEDGLAEDDWDGWKNLTAALGGKVQLVGDDLFVTNVERLKMGIDRGVGNSILVKVNQIGTLTETFAAVELAKKNRYTAIISHRSGESEDTTIADIAVALNTGQIKTGAPSRTDRVAKYNQLLRIEEELGAAASYAGRGAFVQG

SEQ ID NO: 25943 - protein, 426 aa, Aspergillus niger
MATKIKLIPNLNYKRSGTKSYVHLMRKYRFHPTKPGPYTLSSSIQQTGRPYTEKPIGGRAHIRQLVRKKSTTSDEVGEVPAEDVQNDSMYLATVGIGTPAQNLKLDFDTGSADLWVWSNKLPSTLLSENKTHAIFDSSKSSTFKTLEGESWQISYGDGSSASGSVGTDDVNIGGVVVKNQAVELAEKMSSTFAQGEGDGLLGLAFSNINTVQPKSVKTPVENMILQDDIPKSAELFTAKLDTWRDTDDESFYTFGFIDQDLVKTAGEEVYYTPVDNSQGFWLFNSTSATVNGKTINRSGNTAIADTGTTLALVDDDTCEAIYSAIDGAYYDQEVQGWIYPTDTAQDKLPTVSFAVGEKQFVVQKEDLAFSEAKTGYVYGGIQSRGDMTMDILGDTFLKSIYAIFDVGNLRFGAVQREELRQSLKSE

SEQ ID NO: 25944 - protein, 480 aa, Aspergillus niger
MHLPQRLVTAACLCASATAFIPYTIKLDTSDDISARDSLARRFLPVPNPSDALADDSTSSASDESLSLNIKRIPVRRDNDFKIVVAETPSWSNTAALDQDGSDISYISVVNIGSDEKSMYMLLDTGGSDTWVFGSNCTSTPCTMHNTFGSDDSSTLEMTSEEWSVGYGTGSVSGLLGKDKLTIANVTVRMTFGLASNASDNFESYPMDGILGLGRTNDSSYDNPTFMDAVAESNVFKSNIVGFALSRSPAKDGTVSFGTTDKDKYTGDITYTDTVGSDSYWRIPVDDVYVGGTSCDFSNKSAIIDTGTSYAMLPSSDSKTLHSLIPGAKSSGSYHIIPCNTTTKLQVAFSGVNYTISPKDYVGATSGSGCVSNIISYDLFGDDIWLLGDTFLKNVYAVFDYDELRVGFAERSSNTTSASNSTSSGTSSTSGSTTTGSSTTTTSSASSSSSSDAESGSSMTIPAPQYFFSALAIASFMLWL

SEQ ID NO: 25945 - protein, 448 aa, Aspergillus niger
LAVPASRNQSTCDTVDQGYQCFSETSHLWGQYAPFFSLANESAISPDVPTGCRVTFAQVLSRHGARYPTDSKGKKYSALIEEIQQNATTFDGKYAFLKTYNYSLGADDLTPFGEQELVNSGIKFYQRYESLTRNIIPFIRSSGSSRVIASGKKFIEGFQSTKLKDPRAQPDQSSPKIDVVISEASSSNNTLDPGTCTVFEDSELADAVEANFTATFVPSIRQRLENDLSGVSLTDTEVTYLMDMCSFDTISTSTVDTKLSPFCDLFTHDEWINYDYLQSLKKYYGHGAGNPLGPTQGVGYANELIARLTHSPVHDYTSSNHTLDSSPATFPLNSTLYADFSHDNGIISILFALGLYNGTKPLSTTTVENITQTDGFSSAWTVPFASRLYVEMMQCQAEQEPLVRVLVNDRVVPLHGCPVDALGRCTRDSFVRGLSFARSGGDWAECFA

SEQ ID NO: 25946 - protein, 484 aa, Aspergillus niger
LSAAEWRTQSIYFLLTDRFGRTDNSTTATCDTGDQIYCGGSWQGIINHLDYIQGMGFTAIWISPITEQLPQDTADGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQKVLDGVLNYPIYWQLLYAFESSSGSISNLYNMIKSVASDCSDPTLLGNFIENHDNPRFASYTSDYSQAKNVLSYIFLSDGIPIVYAGEEQHYSGGKVPYNREATWLSGYDTSAELYTWIATTNAIRKLAISADSAYITYANDAFYTDSNTIAMRKGTSGSQVITVLSNKGSSGSSYTLTLSGSGYTSGTKLIEAYTCTSVTVDSSGDIPVPMASGLPRVLLPASVVDSSSLCGGSGRLYVE

SEQ ID NO: 25947 - protein, 727 aa, Aspergillus niger
  strain CBS 513.88 / FGSC A1513
MRPIGLVGLIGLANAACPYMSRDLSARDSSDASESTEEFLSQYYLNDNNTYLTSDVGGPIEDQNSLSAGERGPTLLEDFIFRQKIQRFDHERVPERAVHARGVGAHGVFVSYGDFSNLTAASFLSEQGKETPMFVRFSTVAGSRGSTDLARDVHGFATRFYTDEGNFDLVGNNIPVFFIQDAIQFPDLIHAVKPRGDSEIPQAATAHDSAWDFFSQQPSALHTLFWAMAGHGIPRSFRHVDGFGVHTYRLVTDSGASKLVKFHWKSLQGKASMVWEEAQQVSGKNSDFMRQDLWTSIEYGRYPEWELGVQIMDEEDQLRFGFDLFDPTKIVPEEYVPITKLGKMTLNRNPLNYFAETEQVMFQPGHIVRGVDFTEDPLLQGRLFSYLDTQLNRHGGPNFEQLPINQPRVPIHNNNRDGAGQMYIPLNPNAYSPNTLNSASPKQANQTTGNGFFTSPGRTTSGHLLRSTSPTFQDVWSQPRLFYNSLVPTEQQFLIDAIRFETSNVKSTTVRQNVIIQLNRISNDLARRVARAIDVPAPDPDPTYYHDNKTADVGTFGTKLKKLSNLRVGFLASVQTPSSITAAQDLATELKDDEVDVVVVAERLTDGVDQTYSASDAIQFDAVVVAPGAEGLFASGSVTAPQLNSTASAVSTLYPAGRPLQVLVDAFRFGKTVGAVGSGKGALQNAGIDDEREGVVVGQTIGADFVDSVREGLRTFRFLDRFALDEE

SEQ ID NO: 25948 - protein, 128 aa, Aspergillus niger
  strain CBS 513.88 / FGSC A1513
MQIFVKTLTGKTITLDVESSDTIDNVKTKIQDKEGIPPDQQRLIFAGKQLEDGRTLSDYNIQKESTLHLVLRLRGGIIEPSLKALASKYNCEKSICRKCYARLPPRATNCRKKKCGHTNQLRPKKKLK

SEQ ID NO: 25949 - protein, 945 aa, Aspergillus niger
  strain CBS 513.88 / FGSC A1513
MQHGGFACPSERGKVHIEPSSPSGSRPSEKEERLRKRKKQNMCSDHIICQTGNVVLCHTQYPPFPELDPMPKYADTMAAGIDRACHASALSSPESGYRPGPFVLPLAQVLSDCSGSNETVYGLLVSIMGSFTVSFLVTILCIFSLQVWAVPHGGWSNSSASRVMSALQYVPPITYQPKPSGIPYTIRNQSAKPWLYRTTAPVTHSTLAQDSLCASSSNTSGYWYEQIGHNGQSSFMDSKYKANYTVFRNVVKDFGADNTGKKDAAAAISAAIKAGPTNGPDRSSSSMGTTGQPAVIYLPAGTYLMKSSLQLYVGTVIIGDPTNPPVLKASSDFKDDHIIYGKDPNFGGTINFYIGIKNIIIDSTGIGTDKSITLLDWTVSQATQLTNVGFNMPTNTAKHVGLTTQYDYNSNLILNDLWFKGGATGMKLSGQQWVFKNISFSGTTTGVEAGGTDIVFLGCRFEQGTLGIDAQGTSGSLTVVDTTGVGMGTLISSSSSSTAGNSIVLDNVQNSGATVKIGGQTTLSGNVANTWVHGHLYTSKNAKFQSQQGQTVTTSRSSSLLSGKNYFTMAPPTYQEYGTGQVLNIKNVPGIPVYGDGETDDTHNINLILSRYKSSCSLMYFPAGTYIVTDTIFVPAGTRIIGDAFASTISAVGSNFEDESAPRAMFRVGYPGDVGVAQVSDMVFTVADVLPGCKLVEINIAARSPGDVGFWNTHFRIGGAAGSQVESKCTSDPNNCKAAWGLLHLTTTSSAYIENMWGWTADHDLDGDNPQTISTGRGLLVEGTAATWLIGTGSEHNTLYQYNFQYARNVFTAMQQSETPYWQGAGSRALNPAPWTYLDSSDPDYSNCAASDSKCRMALFERIYGSSDLFLYGGCNWVFFNNNGDCSGDCQTNAIDIANSTSIYLYGTNTKSTTNMVLEGTKVIATQSDNAGGWGGVIAGYLYDS

SEQ ID NO: 25950 - protein, 395 aa, Aspergillus niger
  strain CBS 513.88 / FGSC A1513
MSLQCVASMRFAMYHTSGLPGANQTQGITHAIMAFAQSTLFNSDSPPQFTPFESVSTMRSRFSPGTKLMIAIGGWGDTSGFSTAAKDETSRNQYAKNVAAMVNQVGFDGVDIDWEYPGGNGQDYKTTPNSAKVSEITTYPLFLQALRSALGPNKLLSIAVPGKKEDMIAFTNTTGPQIWPSVDMVNIMSYDLMNRRNNVTMHHTSVVDSFNTVQAYRDIGLPGNKTNLGMAYYAKWFETDPSDEQECEDQPIGCKVVVMENADGSDNGKSGSLTFEKSVMSAPPANLKTSTDGTCGFDKGMKCPAGSCCSQYGNWYVDYSYSPCERCMLICGDVAVQPTTSAKQVVYLITEHAKASRLRIHGGARKKTLNWMMSWVESTTSMTRSMCSGRGIPQT

SEQ ID NO: 25951 - protein, 618 aa, Aspergillus niger
  strain CBS 513.88 / FGSC A1513
MLLECYLVDLLFHTPPSGVYRHPVFPIKTNCSSHRSTLLNCIAPRSKDILASRETNYALAALTSLGTPVLTGRPAGEGLAVYILYPVLGLRPTACLYPDISIHFTKTLSATTACFGIMSHSIATPTHHDYTGNSSSGYTDPLANPTLCKRDIPILQELNTNVIRVYAIDPTKDHTTCMNLLAAAGIYVISDLSDPTQSIDRSDPTWETSLYTRYTNVIDELIQYNNTLAFFAGNEVSNDVATTDASAFVKAAVRDMKAYIKSQGYRSIGVGYATNDDSDIRVNMADYFNCGSEDESIDFWGYNIYSWCGDSSYTKSGYDERTEEFRNYSVPVFFSEYGCNTVQPRKFTDIKALFGDQMNDVWSGGIVYMYFQTDNDYGLVSAIDSTSVSKLADFTYYSSQIASATPSGTNKASYTPTNTALQSCPAVTSKSWLATSSPLPPTPNQELCTCMDNASGCVVKDSVSSSDYDDLFSTVCGFTSCDGIFHNGTTGTYGAYSMCGAKQQLNFVLDKYWKEQGKKADACGFDGSATTTATVKATGTCSALMKEAGTAGTGTVTSKPTGTAAGSSSASGTGGVSAVGSVGSASLGKGSAIISIGAWQVGAYVVTGVVAGLGMVLL

SEQ ID NO: 25952 - protein, 551 aa, Aspergillus niger
  strain CBS 513.88 / FGSC A1513
MKVSSAAVPVLSILPEASLGLGSTQLCCAALQATSLRNQVLYPTSAAYNESVASYFAVNVQLDPTCIVQPHSTEDVSLIVSTLTQTGETQCPFAVRSGGHTTWPGAADIGQGVTIDLSMMNSTTYHKDKGVASIQPGARWQAVYKALDPYGVTVPGGRGGPVGVGGFLIGGGNTFYTARVGFACDNIENFEVVLASGSIVNANRTSHPDLYKALKGGSINFGVVTKYDLKTLPHDMLWGGLVVYDNSTTARQLSAAVNFTNNIHNDPYASWIGMWEYSSTTGQNIIADALEYTKPVAFAPAFHEFTSIPNTTDTMRFATIYNLTQELVQAAGYRDVFTTGTYKNDVKVLRKAIDLHNNNIEKAKAHVKSDYWAMDTIIQPWPKLFAQHSVEKGGNVLGLERFDENLIQILFDYSWDDARDDDLFIGLGQSILEEVGEYAKSIGAHNEYIYLNYADKSQNPLKGYGEENVEFISRVAKQYDPDGVFQCLFKFAAQSTRIAVEPIMKPARAVSTRSELARSNRSPLGALPPILSTPPAVSRASGRPGFGPDDG

SEQ ID NO: 25953 - protein, 357 aa, Aspergillus niger
  strain CBS 513.88 / FGSC A1513
MDTVTTFGDTTVANGTVLQDVKTADFIVYNKEKGLDILGSNPSYEYVFAVNDAVHEAPVYVASQNKLYLSQLAPPPGYLPQLVIDLNQDPPTLSEYLSDPPVYAPNGGTFHDGKIIWGASGGNRSIGGTEQRISLRTLDPETNKTTSLVNNYFGYYFNTIDDLAVHPKTGDIWFTDPQYSWFNDITDTPPQLPCASYRYNTSSGAVVVVDDSIGQPNGIAFTPDGSIVYISDTAAVSAPIDPKYGHPGSTFNTTHRRTIYAFDVSEDGAHAYNKRAIYLAPGFVPDGLKVAANGYILTGCGRGVDVLDPSGELLLTVQTNYTVQNFAWTGPELKTLWLMGNGGISKVEWNLPGQVLK

SEQ ID NO: 25954 - protein, 589 aa, Aspergillus niger
  strain CBS 513.88 / FGSC A1513
MKLQTASVLLGSAAAASPSMQTRASVVIDYNVAPPNLSTLPNGSLFETWRPRAHVLPPNGQIGDPCLHYTDPSTGLFHVGFLHDGSGISSATTDDLATYKDLNQGNQVIVPGGINDPVAVFDGSVIPSGINGLPTLLYTSVSFLPIHWSIPYTRGSETQSLAVSSDGGSNFTKLDQGPVIPGPPFAYNVTAFRDPYVFQNPTLDSLLHSKNNTWYTVISGGLHGKGPAQFLYRQYDPDFQYWEFLGQWWHEPTNSTWGNGTWAGRWAFNFETGNVFSLDEYGYNPHGQIFSTIGTEGSDQPVVPQLTSIHDMLWVSGNVSRNGSVSFTPNMAGFLDWGFSSYAAAGKVLPSTSLPSTKSGAPDRFISYVWLSGDLFEQAEGFPTNQQNWTGTLLLPRELRVLYIPNVVDNALARESGASWQVVSSDSSAGTVELQTLGISIARETKAALLSGTSFTESDRTLNSSGVVPFKRSPSEKFFVLSAQLSFPASARGSGLKSGFQILSSELESTTVYYQFSNESIIVDRSNTSAAARTTDGIDSSAEAGKLRLFDVLNGGEQAIETLDLTLVVDNSVLEIYANGRFALSTWVR

SEQ ID NO: 25955 - protein, 704 aa, Aspergillus niger
  strain CBS 513.88 / FGSC A1513
MRKGNSYWDRNPSRDQVSCGERGHWRLAGLGGGMFCTQTLIILLSSQVLLTTNSTHRIVIPPGFLLASFFPSLPASAVSSPHLDGQEPAVDWLVPSSCLQILEHCRNAMSRSPFRPSTPATMNAADKQNNGHLAKPLTPALSAAFHRSQKSPLTPRLATPGGYRTPKRLAASEHPSSAPSKRDPEPSSSSLLSANVTPRSGSRNSRRDGAVSSPNNNNTPTNGQQSPQVTWTQPHVGQLSNTGRLRTERSPVRGAMLEPSRTTRARTVTMESNHLSRPNSASDNSAGAPMFFHASDARSTISEQEPRPKLQTKTSGTTFIYANGAQERQSPVSEVGGTYKRRSIGLTRSVVSAKPSASPRLRPARVDSNPRLSDGPSVVGSQDDSFEAGSQAHSPPMSSVSARPIPAVRHVKSSSLDSGHSGLSPPQKEGLRPSPLIISPSEPKIDASTIASEPLPGLRPRVFSNGSIASVDTHNSGMQSPSKSESGQANGALNARTERKIMDLEISNSSLLAINRTLEREMRKQNAELRRYRRLSRSGRLSMATSSRSVSGALSIPPEVEEASEHSSVRSPEELSDFSDEDSLEDGVLSPDSQADQDSQHRARDEKRFLIDLAKHQELLADSQRLNQSLKRCLGWTEELIREGQRALEYNVHVNDVQLGGRVLTPEELNELNELNELHEQQELEDISRPSSRSDSEPPSEDGS

SEQ ID NO: 25956 - protein, 685 aa, Aspergillus niger
  strain CBS 513.88 / FGSC A1513
MMHEQGTGGAPKYGTVSQLPLIGNISNPLSNITIGRSGADEASVGYYKAQTAEGTVVELSASAHAGIYQYTFPNGSDGNVLIDVSHVLPSYRGMGLSQGYKGGNITIFPDGHYEGHGVYDNGWNRSPDWSIYFCGHFDAAPVSNKTYVGTIAGGSVEQHSGFASSSSGSTRVGGLFTFKNAVVTSRVGISWISTEKACQNVEDEIPEDKEFQSVVDDAQSEWETKVLSKVTTTNTNETTLTLLYTSLYFMHLIPTNQTGENPQWTSQEPYYEDIFTYWDLFRCSTALMQVLQPAAYEEQIRSLIDIWRFEGYMPDARSSNYNGRTQGGSNADNILADAYVKGVRGAVNWEDGYKAMVKDAEVTPSNDPVDPQAPDSSTKEGRGALPDWLSLGYITPRFSRAVTRAVEYSCNDFGLYQVASGLGKTDDAEKYLNRSRNWRNHWNANQTSLGFSGFVVPRNESGFIETDPLNDSGYWGDPYYEASSWAYSWASIHDMKTMIEKMGGNQTVLDRLNIMFTEGASGSSGIIFDPTNEPMFNVPYLYHYIDRQDLSVFRSRDIAKSYYGTSVSGLPGNSDAGAMQTWILWNMIGLYPVTGQSTFLIHSPWFDSLVIDLGGGKKLNVSSSGGDGNGGGNIYVQSLRVNGKDWKKNWLTWDDIFAQGGTLDFELGATASDWFTGELPPSPAS

SEQ ID NO: 25957 - protein, 381 aa, Aspergillus niger
  strain CBS 513.88 / FGSC A1513
ALHGPAALRKAYRKYGIAPSSFNIDLADFKPITTTHAAAGSEIAEPDQTGAVSATSVENDAEFVSPVLIGGQKIVMTFDTGSSDFWVFDTNLNETLTGHTEYNPSNSSTFKKMDGYTFDVSYGDDSYASGPVGTDTVNIGGAIVKEQAFGVPDQVSQSFIEDTNSNGLVGLGFSSINTIKPEAQDTFFANVAPSLDEPVMTASLKADGVGEYEFGTIDKDKYQGNIANISVDSSNGYWQFSTPKYSVADGELKDIGSLNTSIADTGTSLMLLDEDVVTAYYAQVPNSVYVSSAGGYIYPCNTTLPSFSLVLGESSLATIPGNLINFSKVGTNTTTGQALCFGGIQSNGNTSLQILGDIFLKAFFVVFDMRGPSLGVASPKN

SEQ ID NO: 25958 - protein, 710 aa, Aspergillus niger
  strain CBS 513.88 / FGSC A1513
MSGRLSSDHNRSFSQSSRPPSQQIDSMHHRSMSARSSNPNVFSDEYSLEPIDSEQATLTPRSPSISSSVSSNTLRGSVPQQQQPKAYNTIPPTDAELAEDPFGDEARVSFDETPHRSSLPPKGVDLANRNSVASTAPSITSRSQSASSRFSMPVRALSPYTGATGPSHPYAMYPQVGVSRSPSVATTSTLRPVDRPLEDTTAPQHPYAMYPQNVVPEDDGIDNSMVPLGFPGHNAQVYQRPPNRADDDLGDLIGPDGHTEQLPPYSRYPENAVPKVEGTFATVNDAGIIQDETLHNERAGPPMSEVSSNTLVMENTTSGGGIGNGNGNGNRGLEEPPVTGVMAFEEKLKSKGKKKACCGLPVWTLVLVGVVMLIGGCIGGIIGGVLGARKAAEQDHGDKPSRPHIVTVTETPRMDATPVTATPTNLLTLPTGQYAIPASPKNQSKFCVADSDYRVSWGCLNSGKIPIVVGGTDEQRNITFEDSYDSAYSSSLTYGAQQPVFSNPTQNLSMMMDSNDLSFGPALTFMTFYDKLVIVPQDSFPSSSSSKRDYVTEDEVVSSMLSRKATAQAGDKPWFCWWNSTVMEFFLYINETTKEYQYSSTAVVTTTSTQIAQATQGSSNSHSKRDSIADYPRRIKMEEKRDNPSAANPYCQQMQVLDDGQVGPISQETVQIKVVQPTPTTTVEAASGTSQTYTAKAEYESVCYCISLTD

SEQ ID NO: 25959 - protein, 556 aa, Aspergillus niger
  strain CBS 513.88 / FGSC A1513
MFRNALRQSSRTVAAASATGRIASARAAVPGPLSGASKQIRSYAAEAKAAPTEVSSILEQRIRGVQEEAGLAETGRVLSVGDGIARVHGMTNVQAEELVEFASGVKGMCMNLEAGQVGVVLFGSDRLVKEGETVKRTGEIVDVPVGPEMLGRVVDALGNPIDGKGPIPTKVKSRAQLKAPGILPRRSVNQPVQTGLKCVDSMVPIGRGQRELIIGDRQTGKTAVALDAMLNQKRWNNTSDESKKLYCIYVAVGQKRSTVAQLVKTLEENDAMKYSIVVAATASEAAPLQYLAPFTGCAMGEWFRDNGRHAVIIYDDLSKQAVAYRQMSLLLRRPPGREAYPGDVFYLHSRLLERAAKMNEKHGGGSLTALPVIETQGGDVSAYIPTNVISITDGQIFLESELFYKGIRPAINVGLSVSRVGSAAQVKAMKQVAGSLKLFLAQYREVAAFAQFGSDLDASTKQTLNRGERLTELLKQKQYSPMAVSDMVPLIFAGVNGFLDSIPVAKILQWESDFLAHLKSNHPEIQETIEKEGQVSKELEAQLKEIIPTFNKSFNA

SEQ ID NO: 25960 - protein, 400 aa, Bacillus agaradhaerens
  Bacillus agaradherans
MKKITTIFVVLLMTVALFSIGNTTAADNDSVVEEHGQLSISNGELVNERGEQVQLKGMSSHGLQWYGQFVNYESMKWLRDDWGINVFRAAMYTSSGGYIDDPSVKEKVKEAVEAAIDLDIYVIIDWHILSDNDPNIYKEEAKDFFDEMSELYGDYPNVIYEIANEPNGSDVTWGNQIKPYAEEVIPIIRNNDPNNIIIVGTGTWSQDVHHAADNQLADPNVMYAFHFYAGTHGQNLRDQVDYALDQGAAIFVSEWGTSAATGDGGVFLDEAQVWIDFMDERNLSWANWSLTHKDESSAALMPGANPTGGWTEAELSPSGTFVREKIRESASIPPSDPTPPSDPGEPDPTPPSDPGEYPAWDPNQIYTNEIVYHNGQLWQAKWWTQNQEPGDPYGPWEPLN

SEQ ID NO: 25961 - protein, 380 aa, Bacillus alcalophilus
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPNAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 25962 - protein, 170 aa, Bacillus alcalophilus ATCC 27647
GDDENEERTETDSESSGGGMASELEFNDQLELGIGDTAQISSNLGAYEITIHSLKQEETVEDKSSMFDYFIVVDVTVKNIDDETLDASNPVGVLDQTSSLEGSGSGDYSQNYETIDSISGDLQPGEERNGQVLFHARNGEEQFIRIQPGLIAAGGVYNEAVWTFTEDEME

SEQ ID NO: 25963 - protein, 214 aa, Bacillus alcalophilus ATCC 27647
KKMMKAIGITILAGSLLVACNNNEEAENNEPVTEEEVTDAENNETDDEGENTENDSESGGGSAFAPGNFEDQLDLKIGDTGQVSSNVGDFELTIESIKFEDEVDNRSAQFEHFYVADVKFKNIGEEAMLAEDMVGIFDITHELSQTGTGTYINQYFDSFEAVSGRVNPGEEISAQLLFDVYGSDEHYIRVNEGLVASNGVKNQVIWTFSESDLD

SEQ ID NO: 25964 - protein, 429 aa, Bacillus alcalophilus ATCC 27647
MTMITDVYAREVLDSRGNPTVEVEVYLESGAMGRALVPSGASTGEYEAVELRDGGERFLGKGVLKAVENVNEIIAPEIIGVDALDQLGIDKLMIDLDGTENKSKLGANAILGVSMAVAHAAANALGIPLYVYLGGFSAKQLPVPMMNIINGGEHADNNVDIQEFMVMPVGAENFKEAVRMGAEIFHNLKSVLKSKGYNTAVGDEGGFAPNLSSNEEALSTIIEAIEKAGYKPGEEVQLAMDVASSELYNREDGKYHLSGEGKVLTSEQMVEFYEDLVSKYPIISIEDGLDENDWDGHKLLTDRLGKKVQLVGDDLFVTNTKKLAEGIEKGIGNSILIKVNQIGTLTETFEAIEMAKRAGYTAVISHRSGETEDATIADIAVATNAGQIKTGAPSRTDRVAKYNQLLRIEDELAAVATYQGLNSFYNLKK

SEQ ID NO: 25965 - protein, 1364 aa, Bacillus alcalophilus ATCC 27647
MKNQLWKKVIYLSLVFLLMFTHFLPALTPQVKAAEDVISVSEAIENNSGRATVEGYIVGTVTSATNFRLEPPFTTNTNLALADSPDETDLTKMIPVQLPAGNVRNGLNLVSNPGNYQAKVQITGNLQNYFSIPGLHSASSYQILEAGQEPPEEGDLELISIVEARTKSLDSQVIVQGVVTVDSSAISGNQYTTYIQDETAGINVFNFNQNQFPDLYEGDLIEVRGNLVEYNGLLEVVPVANGIEKISEGNPLPLPVEVTLADLNDPAIAEPLEGQLVTVHGFVQNIPSSPAGGGYNISFIDEDFQATTVRVMEGTNAIDSIEQGNWYEVTGVLSQFNTYQVLPRKASDFTLAELQPAPPSSEGTYESTVGRITDGDTIHLASPVLGSTAVRFLNMDTPETYHSVRNELDENQKYHGDEATEYMHELLSVGDEVIVEVGPEATDQYGRLLAQIIRKSDGLNINLEMVRAGYATTYFIWPVGNEDDYELFQSTVREAKEAELGIWNPENPLLEQPFEFRARETGNGLHRYVGHSDTMTYVEPENWKEVPVDKRVFFASSEEAEANGYLPFNEPQIPDEELISMQLLGMNDLHGKIDQTYNVTVGDDVLQVGRFDYVAAYLKQWEERNENTFIIHSGDMIGGSSPVAALFQDEPVIEMMNEIGFDFGTVGNHEFDEGTEELLRMVHGGDHPEGKGSEGYAGMDFPLVCANCVEKESGEHFLPPYEVVEVEGEQVAFVGVNTTDTVNMVVPDGIKDIDFTNEVEAVNEAVAELKEQGVRAIIVLAHMAASQSGETAVGPAADLARNVDDEVDIILAGHNHQIVNAIVDDTLIVQALDYGKAFAAIDVLIDPETGDIVEKEAEIVFVDQSKVEPDSAVGAILADYENRVAPILNEVVGVAAIDMIGDYSNDGDTPLGNLIADSMIWEMESDFALMNGGGIRDHLPAGEITFNRLFNILPFNNVLVKFELTGAELREILNAQITSYGPDFSIAGFSYTWDKDSLEVVDMFLPDGSALVEEATYTVTTNNYMAESNGDKYQLIGQYAKNLVTGPEDLEAFISFVKTFSEPIAYYPDGRIAEISTLPEEPGTPEEPEEPKEPGTDPEEPSELDYVVVEAIIVNGKITISTEMLRNLADDAILSIQMSDFKNSVTLSLTAEQAAILKEKNVTLEVVTGGITVAIPTSIFSGQQEINFFLSLNDRFHNEVSSVFELKLQEGEQFLTKFDKPITLIFNVDIESVSDLDKLQVYYLNEATNKWELVGGSYSDDHKVTATTDHFSLFTVLESTEEVLPEDTVDVPQKEGDNSKEELKEGGKGEGKEKEGGAESSKDKIEKGKVLPNTATSNYQLILIGAVLLLIAAGMMYQSKRLKV

SEQ ID NO: 25966 - protein, 224 aa, Bacillus alcalophilus ATCC 27647
SMKKTMKAVGITLLAGSILVACNSDEGTDTSEDPTGEGIPNEQVDESDNEEEESNSGDDENEESNETDSESSGGGMSSDQDFNDQLNLGIGDTAQFSSNQGAYEITIDSIRKEKTIDGESPMFDYFIIVDLTVKNIGDSVIDVTNPVGILEQTIYLDVSGSNDMSQNFESIDALTGELQPGEQLSGEALFSVREGEEDQYIRVQPGLIAAGGVYNEAVWTFTED

SEQ ID NO: 25967 - protein, 190 aa, Bacillus alcalophilus ATCC 27647
MKKMMKAIGITLLAGSLLVACNSEEGTDTSEDTTGSGGGMASDLEFNDQLDLGIGDTAQISSNQGAYEITIHSVKREEEVDGETSMFDYMIVVDVTVKNIGDEVIDAYNPIGILDQTDRLESSGSGDFSRDFPSVDEISGDLGPGEEIKGQALFDMYQNEEQFIRISPGLIAAGGVYNEVVWTFTEDEME

SEQ ID NO: 25968 - protein, 1125 aa, Bacillus alcalophilus ATCC 27647
MTFLAFILVFSGSSFLFPNTGYVDDFQVQAAESEIPENALRIHYQTDDGDYTNLGLWTWDDVESPTDNWPTGGIPFVEEQMTDYGVYLDIPLKSGARNVGFLVLDVTTGAKDEAGERGGDKRLEMFSPHINEVWIQEGSDDISLYEPVELGEDVVRIHYKKADGNYENLGLWLWGDVKVASGDAGEWPSAATPFTNEQVGKYGAYLDIELNEGAEEIGILAVNRETGDQEMDREFTNLSSANQLFIVEGDDGVYTNPYGAVATELLAAELLSDTKMVLSFTRTDELTEEGLLEGLTIENVAGELVSFHEIQFLEDGKSVELNGEFPLEQSPYTVTFEEKTVTTKVGWRMLDEMYAYDGELGATLHGDGTATIKIWSPKAESVSVVLYDKEDQNTVITELEMILGERGVWQIDLDQQNTGLAHLNGYYYHYEIERDGEKKLALDPYAKSLAAWNNAGDDPIAKAAIVDPATIGPELDFAQIDGFEKKEDAIIYEVHVRDFTSDPNIADELSAQFGTFASFVEKLDYIEELGVTHIQLLPVMSYFFANEFENDVRMLEYASTNTNYNWGYDPQSYFSLTGMYSENPEDPELRIEEFKQLIDEIHDRGMGVILDVVYNHTARVSIFEDLVPNYYHFMDADGTPRESFGGGRLGTTHEMARRVLVDSIMYWVEEFKVDGFRFDMMGDHDAETIQMAYDKAKELNPNIVMIGEGWITYVGDEDDTNVQAADQHWMQYTDSVGVFSDEFRNELKSGFGSEGQPMFITGGARNIDLIFDNIKAQPHNFVADDPGDVVPYIEAHDNLTLHDVIAQSIQKDPEFHQEEIHQRIRLGNLMVLTSQGTAFLHAGQEFGRTKQFRAETAGAPYKSTYMTDEEGNPFTYPYFIHDSYDSTDIINRFDWEQATDEAEYPINNLTREYTTGLIELRKSSDAFRLGTKELVDSHVTKVEAPEIEEQDLVIAYRNEATNEDAYYVFVNADTTERILTLEDDLTEGIVVVDQVQAGTTEIVEPVGVEITADSIKIEPLTAVVVKVGDVEVTDPPETPEPPVDPKDPEDDPIEEEEPPVKEENGTEEDDEKESDTTTPTPEKEEQKRGEGLPNTATSLYNYLAIGAALLLAGAGLYWVRRRKLN

SEQ ID NO: 25969 - protein, 572 aa, Bacillus alcalophilus ATCC 27647
MKYVSIFLILIMSLFLVFPVHTDAKVNQSELNDFLKEIGWTEQELTEYLFEHWGTDLKEFDSVEELIIWLSPVLNEELTISILDEFFMEKHELQTLLTSHDRIIDDFKFYDDLYFFMTDHVVFNDVHLERYLASLEWTSSQLKSYLRTHYGMKLSDFQNVHEIHLTLGPALTEENLTELLSYYRWTEAELKAQLLEDGLSLTDFKFYENLDNYLYDYTMIDEAELAIYLEKIGWTKEELEAYLEDQYGMSLDDLAFVDELDWLLGQPLSEENLSILLEEYELTKEELISLLDEFGLTLNDFKFYDELDWFLFEYFYYNDWLISDLFDEETLELFRLVGLEEYELEQLFYHVIYKMEENPDLFMKLLELDEYLTSLGEFHSADELSIVQLTEFALKLKGFLDAFELNIDFFLVEDGEETPLSYQNLLKLTSLENQDLLIKIYDFDGYLLADLFMNDELINSELFQKLLAGLIDGPEDNLKPEIPEKPEKDSDESKKPAPPTTGSTSDDNTSSSDQEKEKKEGLTPLAKKPSDDAKQTLPNTATNSFNYLLIGAIFVLIGLTVFMTRKFRAVKP

SEQ ID NO: 25970 - protein, 72 aa, Bacillus alcalophilus ATCC 27647
TDVCSSDLQPGQPGQPGQPSEQPSGGNKDDKSQKLPDTATSYYNWLLIGSLLLLTAAGFFLINKRKTKTNNS

SEQ ID NO: 25971 - protein, 150 aa, Bacillus alcalophilus ATCC 27647
GMASDLEFGDQLDLGIGDTAQISSNIGAYEITLNSVSQTEEVDGKSSPLSHFIIMNLTIKNIGEQALDAYDTVSVLHQNNDVEGSGAADYSHLYESVEGFEGSIEPGQEVTADAIYNARDGNEQFLFINPGLIAAKGVYNDVVWTFTEDE

SEQ ID NO: 25972 - protein, 204 aa, Bacillus alcalophilus ATCC 27647
MKKLMRAVGITILAGSILAACNSDEGTGVPDEIRASDDQVDDNTEEEETGEAVFDQDFGDQLDLAIGDTARISSNTGEFEITIHSVELIDNEIDGEAPMFDHFIKAEVTITNIGESVLERESTISILEITDNLEASGTPDYSSQFESIEYLDGKIAPGDTVSVEALFDIYAGEEQYIRVNPGLIASDAVQNDVRWTFDLNEARN

SEQ ID NO: 25973 - protein, 215 aa, Bacillus alcalophilus ATCC 27647
MKQIMKVAGISLLAVGVLFACNNDNGAGAPEDVGSDETVNDVDGGNSSENESTTNNDDSGETEGPVASEEFEDQLDLSIGDTGRVSSTLGAFEMTVDSISKEVEIDGKSSPLDFHLVVDVTLKNIGDTTYDAEDIAGAYRITNTPDGSGQSDITNNLDSIGKITGDLEPGEEISGKLVFDVQGEGEQYLKINGGLIASDAVHNDTVWTFTEEEME

SEQ ID NO: 25974 - protein, 246 aa, Bacillus alcalophilus ATCC 27647
MKFKNNRSCCGSQSRLPLNFAGGIAGRRDPFDRGGIGPRGPQGPPGPEGPTGATGPAGATGPAGPPGPPGPTGPVGDGSIIPFSSGTVPAVLTTVIGGLANTSSLIGFGSSVPGVELVGGVIDTTELLNTAFTVPRDGTITSISAFFSTTLGVDLVGSEVTITAQLFSAEPLSNEFTEVPGATVTLEPPLTGTIVVGETAAGTTDGLSIPVTTGTRLLMVFSSEVTGGVDLVSVIEGNASAGINII

SEQ ID NO: 25975 - protein, 686 aa, Bacillus alcalophilus ATCC 27647
MIKKEKSLEAYKAWLRYETIADKNWLNENEKWLKTIVSLVDTELGQSAKTELYDAITKMSGEKPTTVDSTSTHQIVLATTENQNLISHQLFDRLNDEGYIIRTITEHEKPTILLSAKTDKGLLYASFHFLRLIQTKQHLGSLNIVENPKNQLRMINHWDNMDGSIERGYAGKSIFFENNAFTTNLERIKDYARILSSVGINAISINNVNVHTVETKLITDEFLPDVATVANIFRSYGIQTFLSINYASPIQLGQLTTADPLDPTVRNWWKEKAKDVYRFIPDFGGFVVKADSEHRPGPFTYERNHADGSNMLAEALEPFGGIVIWRCFVYNCMQDWRDRKTDRARAAYDHFKPLDGQFYDNVVLQIKNGPMDFQVREANSPLFGAMTKTNQILEFQVTQEYTGQQIDLCYLISQWKEILEFDTFAAGAGTPIKRIVDGSTFENKISGIAAVSNIGNDDNWTGHQLAQANLYGYGRLIWNPDLSTEVITDEWVRATFGHDPEVVEHVTAMLFDSWPIYENYTSPLGVGWMVNPNHHYGPNVDGYEYSVWGTYHFADNEGIGVDRTVSSGTGYTAQYFKENKEIYESLEICPDDLLLFFHHVPYTHKLQSGVTVIQHIYNTHFEGVEQAIGLMERWSLLKDKVDEERYQNVMNRLNQQIENAKQWRDMINTYFFRKSGIKDEKNRTIY

SEQ ID NO: 25976 - protein, 463 aa, Bacillus alcalophilus ATCC 27647
TVEPTEGPLTVTVETDSTAELVAMKWLLGEKTVEDFAHEGENISLEESSFEVTANGTYTVFVENSLGVQAVQTITVENITEPNQESFSIDLTASTKELTEGPVTITVDTNTEAELVSIKWLQGEKEVLDFAEAGNEVDLDAKSFDVTENGTYTVYVKNDLDVEEVQTITITNIIDPNLAPVEVTLTPSTTDPTEGPITITVDTDSELDLVAMKWLQGEKEVADFAEAGHTIDLAEKSFEVSENGTYTVYVKNSADVEAVQVIEVDNITEPAVEPELTLIPSTVEPTEGPITVTVETDADVEALKWLSGELTVSDFAEAGQDIDLETKAFQVTENGTYTVYLKDALGFEVVQSITINNIKEVEEDPVTEDPDKEDPVKEDPSKEDPDKEDPVKEDPKTESPTKEAPKDKDSNVKDKETGKDVSGSGSDKKLPDTATNTYNLIALGVTLLLIGALAMSVRTRRRA

SEQ ID NO: 25977 - protein, 274 aa, Bacillus alcalophilus ATCC 27647
MLKVLKRKSSKVAGMAIAAVALFSFAGADAASAHGYIEEPKARGLLCQEGANQDCGGVVWEPQSLEGPKGFPGLSVADGEIASAGGVFPQLDQQSSNRWAKVDMNSGLNTINWHLTARHSTSKWHYYITKPDWNPNLPLTRDQFELVPFYEIYDGGARPEQKVSHEVTVPQRTGYHVILGLWDVADTENAFYNVIDVNFGGGTNPDPDPGEPDPDPDPGQPDPEEPELPDLPTWDPGTAYTGGSQVIYNGKVYQARWWTLGEKPETASYVWEQL

SEQ ID NO: 25978 - protein, 161 aa, Bacillus alcalophilus ATCC 27647
MKGKIVLLGSLCVLLALVVIYLNREAPSTETISPNNEQPKEEVKFGTQEIHSLEISVNDVRSESVMENEDSQLVVVDITIKNQGDDVRNISLLNFTLVDGEGYAYSHSSNSELKGILGGQLHPERKNRGEMAFEVPVSSEYELVYTEHTRTGQLIWPLELD

SEQ ID NO: 25979 - protein, 205 aa, Bacillus alcalophilus ATCC 27647
MKKIMKAIGITILAGSLLVACNNDDTDGTDKSNEIEQENEDTEDVDESNVGAEGNTSTNEYVDQLDLKLGDTAQVSTNTGEFEITVKSVKREDEIDEENSQLDTFHIVSVEVKNIGSAAIDAGELKGMFEMTDFLEGSGEPEVSNWFESFDALDGEINEGQGLTGEMVYQVYEADTYYLRITDGLVASDAVKNQVTWSFAQDEVQ

SEQ ID NO: 25980 - protein, 595 aa, Bacillus amyloliquefaciens
  Bacillus velezensis
MKKVFSNKKFLVFSFIFVMLLSLSFFNGESAKASSDKSSKMIGYYPSWGAYGRDFQVWDMDASKVSHINYAFADICWEGRHGNPDPTGPNPQTWSCQDENGVIDVPNGSIIMGDPWIDVQKSNHGDTWDEPIRGNFKQLLKLKKNHPHLKTFISVGGWSWSNRFSDVAADPQQRENFAASAVNFLRKYGFDGIDLDWEYPLSAGLLGNSTRPEDKRNYTLLLQDVREKLDAAEAKDGKKYLLTIASGASPEYVSNTELDKIAETVDWINIMTYDFNGGWQSISAHNAPLFYDPKAKEAGVPNAETFNIESTVKRYKEAGVKADKLVLGTPFYGRGWSNCEPADNGEYQKCGPAKEGTWEKGVFDFSDLEKNYINKNGYKRYWNDRAKVPFLYNAENGNFITYDDEESYGYKTDLIQSNGLSGAMFWDFSCDSKQTLLNKLAADLWFAPGEGNPEPPSSAPGNLRVTERTPPSISLAWDAPSDGANIAEYVLSYEGGAVSVKDTSATIGQLKPNTTYSFTVSAKDADGKLHTGPTIEATTNSDQTCGYNEWKDTAVYTGGDRVVFNGKVYEAKWWTKGEQPDQAESGVWKLIGDCK

SEQ ID NO: 25981 - protein, 2200 aa, Bacillus amyloliquefaciens
  Bacillus velezensis
MNNPIMNGGFETGTLAGWSSANTQINSLFAHSGRYSAQFIGTQPYAYLSQIVPISAKSLTLFVSLATLGNEPSPQVTLQIIFVSAAGEEISSIQENITPGNLPNVLFHTWSEIYKTSTVPSGTASAVIILSKVSSGTVLIDDVSLAQTGGDPGSTGITGPTGATGPTGATGVTGARGATGATGVTGATGVTGPTGPTGATGATGVTGSKGVTGVTGVTGPTGATGSTGPTGPTGETGSTGATGVTGSTGSTGATGPTGTTGPTGVTGSTGATGATGSTGATGATGSTGPTGTTGATGSIGSTGVTGETGPTGLTGEIGPTGPTGITGLTGVTGATGSTGATGPTGATGTTGATGPTGPTGETGVTGLTGLTGSTGATGPTGITGSTGSTGVTGSTGTTGATGVTGVTGVMGSTGATGVTGETGPTGPTGETGVTGSTGVTGETGPTGSTGITGSTGATGVTGPTGATGVTGATGATGVTGSTGSTGAAGVTGATGVTGSTGSTGSTGITGVTGSTGITGSTGATGVTGATGLTGITGPTGATGSTGVTGVTGVTGSTGVTGSTGETGPTGVTGATGVTGETGPTGPTGSTGVTGATGVTGETGVTGETGATGVTGPTGATGITGSTGTTGATGSTGETGVTGPTGITGSTGVTGVTGSTGPTGITGSTGATGATGPTGTTGETGATGSTGPTGPTGVTGSTGATGITGSTGVTGPTGATGEIGSTGPTGITGSTGPTGSTGVTGPTGETGPTGVTGTTGATGPTGATGPTGATGPTGVTGSTGVTGSTGATGETGVTGATGSTGATGSTGSTGATGSTGSTGATGSTGTTGEIGPTGATGATGITGATGETGSTGTTGVTGTTGETGPTGVTGETGTTGSTGVTGSTGPTGTTGVTGVTGPTGITGSTGVTGVTGSTGLTGSTGPTGITGSTGSTGVTGPTGATGATGVTGVTGVTGSTGAIGPTGVTGPTGVTGSTGATGPTGVTGPTGVTGATGTTGPTGTTGVTGVTGPTGSTGPTGSTGVTGPTGSTGVTGSTGETGPTGVTGSTGETGPTGVTGSTGETGPTGVTGSTGETGPTGETGPTGVTGSTGATGPTGVTGSTGVTGVTGSTGSTGTTGSTGATGSTGATGSTGEIGPTGPTGITGPTGTTGATGETGATGSTGATGSTGSTGVTGSTGTTGATGVTGVTGVAGSTGATGVTGETGTTGPTGSTGVTGATGSTGTTGEIGPTGVTGSTGATGSTGVTGITGETGSTGPTGPTGATGSTGSTGATGPTGATGPTGVTGETGSTGVTGSTGSTGVTGSTGATGATGPTGITGPIGETGVTGVTGATGEIGSTGSTGVTGETGPTGSTGITGSTGPTGSTGVTGPTGSTGETGPTGVTGSPGTTGATGPTGSTGATGPTGVTGATGATGPTGVTGPTGATGSTGETGATGITGTMGPTGPTGVTGSTGATGATGPTGITGSTGATGPTGSTGPTGSTGPTGETGVTGVTGATGEIGSTGVTGETGPTGSTGITGSTGPTGSTGATGPTGVTGPTGSTGPTGLTGSTGATGSTGVTGPTGLTGETGPTGVTGSPGTTGATGPTGATGPTGSTGSTGATGSTGSTGSTGSTGSTGSTGSTGSTGATGITGSTGVTGPTGSTGITGSTGITGSTGATGPTGVTGSTGVTGPTGSTGATGPTGATGVTGETGSTGPTGEIGASGATGSTGSTGSTGSTGSTGSTGATGSTGSTGSTGATGITGATGVTGPTGVTGTTGATGPTGATGITGATGVTGPTGSTGATGITGATGVTGSTGVTGPTGSTGPTGSTGSTGSTGSTGVTGSTGVTGATGATGSTGVTGVTGPTGPTGSTGVTGPTGPTGSTGATGPTGSTGVTGATGVTGPTGPTGSTGATGPTGSTGVTGATGPTGTTGITGATGATGPTGSTGVTGATGPTGSTGATGATGVTGSTGSTGSTGVTGSTGPTGSTGSTGPTGSTGSTGPTGSTGSTGPTGSTGATGPTGSTGSTGATGITGSTGVTGPTGSTGITGSTGITGSTGATGPTGVTGSTGVTGPTGSTGSTPTLLFTRTNGPLTVYPPLNTEIPVATLAIPVNALQNIKLDYSVSVEVTSTANSNFVFEIRLYRGAVQIHTRLLSRSIISATTERFPIADTTVDTAPTAGTNTYQLRVVFTTASNITTATALNIDFNSISFPTTS

SEQ ID NO: 25982 - protein, 159 aa, Bacillus amyloliquefaciens
  Bacillus velezensis
MTTIAGGLIGTVSLVGFGSSVTGVNVGGGGAIDLTGAGGTLLNFAFSAPRSGTITSIAAYFSTTAALSLVGSTVTITAQLYSSTVPNNTFTPIPGASVTLAPALTGVLSIGSISNGITTGLNIAVTPQTRLLMVFSATATGLSLINTVAGYASAGVTIS

SEQ ID NO: 25983 - protein, 278 aa, Bacillus amyloliquefaciens; identical to SEQ ID NO: 4292
  Bacillus velezensis

SEQ ID NO: 25984 - protein, 430 aa, Bacillus amyloliquefaciens; identical to SEQ ID NO: 5169
  Bacillus velezensis

SEQ ID NO: 25985 - protein, 586 aa, Bacillus amyloliquefaciens
  Bacillus velezensis
MSQPNLPNITPVVTLSRDDTINLLLSAIAMEELGMAHILNAEGEKIQYALGTIPGLTGPPSSLADILNLNESVRDTLDSLMKQELLLGSKLDSISNIPTLAGPTGATGPTGPAGGPTGPTGAIGPAGATGPTGPTGPTGVTGAGLQGIIAFNPLIAPTYTPGQVVLYNGSSYVVNTASPAGVPDTSADYTLLAAAGPTGPTGPTGATGAGLTGLTAFDPAAAPFYTAGQVVLYEGASYVVNIDNPSGIPGISPDYTLLAAAGPTGPTGVTGAGLQGIVPFDPLAAPSYTAGQTVTFNGSSYVANVNSPAGTPGASADYTLLAATGTAGATGGSGPTGITGVTGTTGPTGVTGVTGATGPTGGTGVTGTTGPTGITGAAGATGPTGVTGVTGDTGPTGITGVTGDTGPTGITGATGATGPTGGTGVTGATGPTGFTGATGGSGPTGITGVTGATGPTGITGVTGGGIVAVVVGGTTISLPNDQNLSADITANAANTVFTVAPAGRYYISYHINLTAGLLVSSRVLINGTPFTSSIIAPVASLANFNNSFIVTLAADSTIQLQLFGLLGAATLLGGSVGAALNIIRLS

SEQ ID NO: 25986 - protein, 331 aa, Bacillus amyloliquefaciens
  Bacillus velezensis
MSIKKMSAVFFILLLTAFTAACSSETSGGKESGTAKVKIKDTAWVTSDDAEHPTALKVTVTVKNTGNDPLTVKSSDFSLYQNDAKTAAADKEDRMQSGTLHADKTVTGSLYFTADEGKSYELVYQPQAKDAKPLSYKLKVKGTAPKAKPDPADALSAYIDVMLYGRHNKDFTRLTGVNEKMTAAAYQESAKASFIASAGISKEQADSKAISAIIDAMSSALRDHTELKVQTKSMSDGKAVLEAKVTPLDMSPLAGRLQDRVQDYAGKHPDADENEIVSHLLSVYPEEFMRLKPASSSVTKEIEMKKNARGQWYLDTDADLEGLTEAFLKTS

SEQ ID NO: 25987 - protein, 212 aa, Bacillus amyloliquefaciens
  Bacillus velezensis
MAGNLVSCKACGKEIAKGVKKCPNCGKDQRNFFMRHKIITFILAVVVIIILANIGGGGGSSSSKTASSKAAESKEKLYNIGDTVKTEKTEVTLTKVEKRDSVGTQYIEKKASDGGVIVAVQYTVKNVSNKPLSSFSIPSVKLVDSKGTSYDPDIDASSTYATETKVNNSKILSDLNPNIKVTGVKAFEVDKNAYAKGTWKIKFSNDVEVKVK

SEQ ID NO: 25988 - protein, 514 aa, Bacillus amyloliquefaciens
  Bacillus velezensis
MIQKRKRTVSFRLVLMCTLLFVSLPITKTSAVNGTLMQYFEWYTPNDGQHWKRLQNDAEHLSDIGITAVWIPPAYKGLSQSDNGYGPYDLYDLGEFQQKGTVRTKYGTKSELQDAIGSLHSRNVQVYGDVVLNHKAGADATEDVTAVEVNPANRNQETSEEYQIKAWTDFRFPGRGNTYSDFKWHWYHFDGADWDESRKISRIFKFRGEGKAWDWEVSSENGNYDYLMYADVDYDHPDVVAETKKWGIWYANELSLDGFRIDAAKHIKFSFLRDWVQAVRQATGKEMFTVAEYWQNNAGKLENYLNKTSFNQSVFDVPLHFNLQAASSQGGGYDMRRLLDGTVVSRHPEKAVTFVENHDTQPGQSLESTVQTWFKPLAYAFILTRESGYPQVFYGDMYGTKGTSPKEIPSLKDNIEPILKARKEYAYGPQHDYIDHPDVIGWTREGDSSAAKSGLAALITDGPGGSKRMYAGLKNAGETWYDITGNRSDTVKIGSDGWGEFHVNDGSVSIYVQK

SEQ ID NO: 25989 - protein, 382 aa, Bacillus amyloliquefaciens
  Bacillus velezensis
MRGKKVWISLLFALALIFTMAFGSTSSAQAAGKSNGEKKYIVGFKQTMSTMSAAKKKDVISEKGGKVQKQFKYVDAASATLNEKAVKELKKDPSVAYVEEDHVAHAYAQSVPYGVSQIKAPALHSQGYTGSNVKVAVIDSGIDSSHPDLKVAGGASMVPSETNPFQDNNSHGTHVAGTVAALNNSIGVLGVAPSASLYAVKVLGADGSGQYSWIINGIEWAIANNMDVINMSLGGPSGSAALKAAVDKAVASGVVVVAAAGNEGTSGSSSTVGYPGKYPSVIAVGAVDSSNQRASFSSVGPELDVMAPGVSIQSTLPGNKYGAYNGTSMASPHVAGAAALILSKHPNWTNTQVRSSLENTTTKLGDSFYYGKGLINVQAAAQ

SEQ ID NO: 25990 - protein, 521 aa, Bacillus amyloliquefaciens
  Bacillus velezensis
MGLGKKLSVAVAASFMSLTISLPGVQAAENPQLKENLTNFVPKHSLVQSELPSVSDKAIKQYLKQNGKVFKGNPSERLKLIDQTTDDLGYKHFRYVPVVNGVPVKDSQVIIHVDKSNNVYAINGELNNDVSAKTANSKKLSANQALDHAYKAIGKSPEAVSNGTVANKNKAELKAAATKDGKYRLAYDVTIRYIEPEPANWEVTVDAETGKILKKQNKVEHAATTGTGTTLKGKTVSLNISSESGKYVLRDLSKPTGTQIITYDLQNREYNLPGTLVSSTTNQFTTSSQRAAVDAHYNLGKVYDYFYQKFNRNSYDNKGGKIVSSVHYGSRYNNAAWIGDQMIYGDGDGSFFSPLSGSMDVTAHEMTHGVTQETANLNYENQPGALNESFSDVFGYFNDTEDWDIGEDITVSQPALRSLSNPTKYGQPDNFKNYKNLPNTDAGDYGGVHTNSGIPNKAAYNTITKIGVNKAEQIYYRALTVYLTPSSTFKDAKAALIQSARDLYGSQDAASVEAAWNAVGL

SEQ ID NO: 25991 - protein, 472 aa, Bacillus amyloliquefaciens
  Bacillus velezensis
MNIKKIVKQATVLTFTTALLAGGATQAFAKENNQKAYKETYGVSHITRHDMLQIPKQQQNEKYQVPQFDQSTIKNIESAKGLDVWDSWPLQNADGTVAEYNGYHVVFALAGSPKDADDTSIYMFYQKVGDNSIDSWKNAGRVFKDSDKFDANDPILKDQTQEWSGSATFTSDGKIRLFYTDYSGKHYGKQSLTTAQVNVSKSDDTLKINGVEDHKTIFDGDGKTYQNVQQFIDEGNYTSGDNHTLRDPHYVEDKGHKYLVFEANTGTENGYQGEESLFNKAYYGGGTNFFRKESQKLQQSAKKRDAELANGALGIIELNNDYTLKKVMKPLITSNTVTDEIERANVFKMNGKWYLFTDSRGSKMTIDGINSNDIYMLGYVSNSLTGPYKPLNKTGLVLQMGLDPNDVTFTYSHFAVPQAKGNNVVITSYMTNRGFFEDKKATFGPSFLMNIKGNKTSVVKNSILEQGQLTVN

SEQ ID NO: 25992 - protein, 289 aa, Bacillus amyloliquefaciens
  Bacillus velezensis
MTKKLWFLPIVCLFFILGWTAPSASAGAPADTNLYSRLAVSTAGGTTLFPQTSSAVITPSADTETYYKEASGKSGTALKSALHRIISGHTKLSYSQVWNALKETDEDPANPNNVILLYTQESRAKSKNGGSVGDWNREHVWAKSHGNFGTAAGPGTDIHHLRPADVQVNSARGNMDFDNGGSEYPKAPGNYYDGDSWEPRDEVKGDVARMLFYMAVRYEGGDGYPDLELNDKTGNGSAPYMGKLSVLLKWNKQDPVDSKEKRRNEIIYEDYQHNRNPFIDHPEWADEIW

SEQ ID NO: 25993 - protein, 274 aa, Bacillus amyloliquefaciens
  Bacillus velezensis
MKAKVDSWKKTAVSLLIFTMFFTLMMNNTVFAAGLNKDQKRRAEQLTSIFENGMTEIQYGYVEHLPDGRGYTCGRAGFTTATGDALEVVEVYTKAVPNNKLKKYLPELRRLAKEESDDISNLKGFDSAWRSLGKDKDFRAAQDTVNDRLYYQPAMKQSDNIGLKTALAKAVMYDTIIQHGGGDDPDSLNSLIKRTNKKAGGSPKNGVDEKKWLNKFLDVRYDDLMNPADPDTRDEWRESVARVDVLRSIAKANNYNLNGPINVYSEEYGDFVIK

SEQ ID NO: 25994 - protein, 278 aa, Bacillus amyloliquefaciens
  Bacillus velezensis
MKISLKKKAGFWKKTAVSSLIFTMFFTLMMSGTVFAAGLNKDQKRRAEQLTSIFENGKTEIQYGYVEALDDGRGYTCGRAGFTTATGDALEVVEVYTKAVPNNKLKKYLPELRRLAKDESDDISNLKGFASAWRSLGNDKAFRAAQDKVNDSLYYQPAMKRSENAGLKTALAKAVMYDTVIQHGDGDDPDSFYALIKRTNKKMGGSPKDGTDEKKWLNKFLDVRYDDLMNPADEDTQDEWRESVARVDVFRDIVKEKNYNLNGPIHVRSSEYGNFTIQ

SEQ ID NO: 25995 - protein, 488 aa, Bacillus amyloliquefaciens
  strain ATCC 23350 / DSM 7 / BCRC 11601 / NBRC 15535 / NRRL B-14393
MWESKFSKEGLTFDDVLLVPAQSDVLPRDVDLSVELTKTLKLNIPVISAGMDTVTESAMAIAMARQGGLGIIHKNMSIEQQAEHVDKVKRSERGVITNPFFLTPDHQVFDAEHLMGKYRISGVPIVDNKDDQKLVGIITNRDLRFISDYSMKISDVMTKEELVTAPVGTTLDEAEKILQKHKIEKLPLVDDQNKLKGLITIKDIEKVIEFPNSSKDEHGRLIVGAAVGVTGDTMTRVSKLVEANVDVIVVDTAHGHSRGVLNTVAKIRETYPELNIIAGNVATAEATKALIEAGANIVKVGIGPGSICTTRVVAGVGVPQITAIYDCATEARKHGATIIADGGIKFSGDITKALASGGHAVMLGSLLAGTSESPGETEIYQGRRFKVYRGMGSVAAMEKGSKDRYFQEENKKFVPEGIEGRTPYKGPVEETVYQLVGGLRSGMGYCGSKDLRALREEAQFIRMTGAGLRESHPHDVQITKESPNYTIS

SEQ ID NO: 25996 - protein, 141 aa, Bacillus amyloliquefaciens; identical to SEQ ID NO: 653
  strain ATCC 23350 / DSM 7 / BCRC 11601 / NBRC 15535 / NRRL B-14393

SEQ ID NO: 25997 - protein, 396 aa, Bacillus amyloliquefaciens
  strain ATCC 23350 / DSM 7 / BCRC 11601 / NBRC 15535 / NRRL B-14393
MAKEKFDRSKSHANIGTIGHVDHGKTTLTAAISTVLHKKSGKGTAMAYDQIDGAPEERERGITISTAHVEYETDTRHYAHVDCPGHADYVKNMITGAAQMDGAILVVSAADGPMPQTREHILLSKNVGVPYIVVFLNKCDMVDDEELLELVEMEVRDLLSEYDFPGDDVPVVKGSALKALEGDAEYEEKILELMAAVDEYIPTPERDTEKPFMMPVEDVFSITGRGTVATGRVERGQVKVGDEVEIIGLQEENSKTTVTGVEMFRKLLDYAEAGDNIGALLRGVAREDIQRGQVLAKPGTITPHSKFKAEVYVLSKEEGGRHTPFFSNYRPQFYFRTTDVTGIINLPEGVEMVMPGDNTEMIVELISTIAIEEGTRFSIREGGRTVGSGVVSTITE

SEQ ID NO: 25998 - protein, 388 aa, Bacillus amyloliquefaciens
  strain ATCC 23350 / DSM 7 / BCRC 11601 / NBRC 15535 / NRRL B-14393
MRLNARYIKNQVMAQQVLQRYSSKTNVKDAAKGTDSLLIQAGGSRDLSQVNYSTSGVTEKGSSLSRLYQSANQKTMTDNGNETVIQANNPYESESDIASKILNEKYSRINEINKRKPDPLGYIKDKYQRANSPYFRSDLSESERQAAYHNETEWLFKGKAQSYDFRDAAFRGETLSGEIEGENEKVFQRGQVNQQIEMLFHRNHIQIPEGANLTFTISPIDYLLKVSGTDDEELTKQIEAVLNSGENSKELFAHIIRSRSDDSSQFTAEAYEKYQVVREMYEVTGYHLKDLQIVNGKYVTEDGRDLLDVYKEALQQDPLLKHTAAEAAAHYGQGLTKLARTGYDAIPDLVLSIDYRDGSLRDVGQRKQYGSGGTDWLSEWKRQLGVRI

SEQ ID NO: 25999 - protein, 331 aa, Bacillus amyloliquefaciens; identical to SEQ ID NO: 25986
  strain ATCC 23350 / DSM 7 / BCRC 11601 / NBRC 15535 / NRRL B-14393

SEQ ID NO: 26000 - protein, 716 aa, Bacillus amyloliquefaciens
  strain ATCC 23350 / DSM 7 / BCRC 11601 / NBRC 15535 / NRRL B-14393
MRRNKKKIAVNKEKKKSLPIRLNFLFLAAFLIFTWIIVELGIKQIVQGDDYKNAANKQEESDVSTAVPRGKIYDRNLNPIVTNKALNAITYTRSASTTQAQRLKIAKKLSGMIKVSTKKVTERDKKDYWMLTRPDEAKKLITAKEKQKAEDKKLSDDDLYQLQLKRITDKQLNELTSKDMQVLAIKRQMDSGYSLTPQYIKNEGVSAKEMAVVSEHLDELPGVDVTSDWERSYPNKGLLKSVLGSVSSSNEGLPSNLLEHYLSLGYSRNDRVGKSYLEYQYENLLQGQKEKVRNVTDSSGNVTDTETVTKGKAGDDLVLTIDTELQKDVEKIIEKNLRAAKARPSTQLLDRAFVVMMDPRNGEVLTMAGKQIKQVNGKYKIDDYALGTMTSSYNMGSAVKGATLLTGYQTGAIKIGNIFTDEVLNIKDSPPKKSVSVMGPINDLTALERSSNVYMFKTAIAIGKGKYISGHSLPLDYSAFDKFRYYFSEFGLGVKTGIDLPNEATGYVGTKRQSGFLLDFAIGQFDTYTPLQMAQYVSTIANGGFRMKPQIVKEVRKPDSKKGIGAVVESVNPEVMNRLDMTESEIKRVQQGFKLVMQGAQGTARANFANKSYNPAGKTGTAQAFYDGPIKSRTGASTYNTTLVAYAPADHPEVAISVVVPWAYENYNDRYSITNDIGEAVLDKYFELKKKQEENNTKQKNEDKIQKDAENGNTNN

SEQ ID NO: 26001 - protein, 312 aa, Bacillus amyloliquefaciens
  strain ATCC 23350 / DSM 7 / BCRC 11601 / NBRC 15535 / NRRL B-14393
MGKTRSKVSVIGAGFTGATTAFLTAQKELADVVLVDIPQLENPTKGKALDMLEASPVQGFDAKITGTSNYEDTAGSDIVVITAGIARKPGMSRDDLVSTNEKIMRSVTREIVKYSPDCIIVVLTNPVDAMTYAVYKESGFPKERVIGQSGVLDTARFRTFVAEELNLSVKDVTGFVLGGHGDDMVPLVRYSYAGGIPLETLIPKDRLDAIVERTRKGGGEIVNLLGNGSAYYAPAASLTEMVEAILKDQRRVLPTIAYLEGEYGHEGIYLGVPTIIGGNGLEQIIELELTDYEKAQLSKSVESVKNVMKVLS

SEQ ID NO: 26002 - protein, 621 aa, Bacillus amyloliquefaciens
  strain ATCC 23350 / DSM 7 / BCRC 11601 / NBRC 15535 / NRRL B-14393
MRKGDTWYSRCDSWDCDCRHCNDCCCHSQHKRRNQRRSYHNRAHCCEGCCCENSCCHERWCPCCHPNHYHGRGETGATGLTGATGVTGATGVTGATGDPGATGPTGATGVTGPTGDPGVTGTTGVTGATGITGVTGATGITGATGAMGITGATGVTGVTGATGVTGVTGATGVTGATGDPGATGPTGATGITGATGSTGVTGATGVTGATGATGVTGDTGTTGITGATGATGVTGTTGATGSTGVTGATGVTGSTGDTGTTGVTGATGATGITGATGSTGVTGVTGVTGVTGATGVTGSTGDTGSTGVTGATGITGVTGVTGDTGATGVTGATGTTGATGSTGVTGVTGVTGATGATGVTGSTGDTGSTGVTGATGITGATGATGVTGVTGVTGATGITGATGITGATGVTGSTGDTGATGSTGVTGATGVTGATGVTGTTGATGATGAGAIIPYASGLPTAVTTIAGGLIGTVSLVGFGSSVTGVNVGGGGAIDLTGAGGTLLNFAFSAPRSGTITSIAAYFSTTAALSLVGSTVTITAQLYSSTVPNNTFTPIPGASVTLAPALTGVLSIGSISNGITTGLNIAVTPQTRLLMVFPATATGLSLINTVAGYASAGVTIS

SEQ ID NO: 26003 - protein, 481 aa, Bacillus amyloliquefaciens
  strain ATCC 23350 / DSM 7 / BCRC 11601 / NBRC 15535 / NRRL B-14393
MSSNKLTTSWGAPVGDNQNSITAGDRGPTLIQDVHLLEKLAHFNRERVPERVVHAKGAGAHGYFEVTNDVTKYTKAAFLSEVGKRTPLFIRFSTVAGELGSSDTVRDPRGFAVKFYTEDGNYDIVGNNTPVFFIRDAIKFPDFIHTQKRDPRTHLKNPTAVWDFWSLSPESLHQVTILMSDRGIPATLRHMHGFGSHTFKWTNDKGEGVWIKYHFKTEQGVKNLDVNTAAKLAGENPDYHTEDLFNAIENGDFPAWKLYVQIMPLEDANTYRFDPFDVTKVWSQKDYPLIEVGRMVLDRNPENYFAEVEQATFSPGTLVPGIDVSPDKMLQGRLFAYHDAHRYRVGANHQALPINRSRNEVKNYQRDGQMRFDDNGGRSVYYEPNSFGGPKESPEDKQAAYPVSGLADSVSYDHHDHYTQAGDLYRLMSEEERARLVANIVSAMEPVEKEEIKLRQIGHFYKADPEYGRRVAEGLGLPLPK

SEQ ID NO: 26004 - protein, 430 aa, Bacillus amyloliquefaciens; identical to SEQ ID NO: 5169
  strain ATCC 23350 / DSM 7 / BCRC 11601 / NBRC 15535 / NRRL B-14393

SEQ ID NO: 26005 - protein, 328 aa, Bacillus amyloliquefaciens
  strain ATCC 23350 / DSM 7 / BCRC 11601 / NBRC 15535 / NRRL B-14393
MRINHNIAALNTSRQLNAGSNAASKNMEKLSSGLRINRAGDDAAGLAISEKMRSQIRGLDMASKNAQDGISLIQTSEGALNETHSILQRMSELATQAANDTNTDSDRSELQKEMDQLASEVTRISTDTEFNTKKLLDGTAKDLTFQIGANEGQTMSLSINKMDSESLQVGTTYTANTDGSKLVTADGKEATLVTDGSKGPNGYYDTDDKLVYQADSALAADTKVTKGIDISSSAKAASSALTTIKTAIDTVSSERAKLGAVQNRLEHTINNLGTSSENLTSAESRIRDVDMASEMMEYTKNNILTQASQAMLAQANQQPQQVLQLLKG

SEQ ID NO: 26006 - protein, 622 aa, Bacillus amyloliquefaciens
  strain ATCC 23350 / DSM 7 / BCRC 11601 / NBRC 15535 / NRRL B-14393
MSQPNLPNITPVVTLSRDDTINLLLSAIAMEELGMAHILNAEGEKIQYALGTIPGLTGPPSSLADILNLNESVRDTLDSLMKQELLLGSKLDSISNIPTLAGPTGATGPTGPAGGPTGPTGAIGPAGATGPTGPTGPTGVTGAGLQGIIAFNPLIAPTYTPGQVVLYNGSSYVVNTASPAGVPDTSADYTLLAAAGPTGPTGPTGATGAGLTGLTAFDPAAAPFYTAGQVVLYEGASYVVNIDNPSGIPGISPDYTLLAAAGPTGPTGVTGAGLQGIVPFDPLAAPSYTAGQTVTFNGSSYVANVNSPAGTPGASADYTLLAATGTAGATGGSGPTGITGVTGTTGPTGVTGVTGATGPTGGTGVTGTTGPTGITGAAGATGPTGVTGVTGDTGSTGATGATGVTGPTGITGATGATGPTGITGVTGDTGPTGITGVTGDTGPTGITGATGATGPTGGTGVTGATGPTGFTGATGGSGPTGITGVTGATGPTGITGVTGGGIVAVVVGGTTISLPNDQNLSADITANAANTVFTVAPAGRYYISYHINLTAGLLVSSRVLINGTPFTSSIIAPVASLANFNNSFIVTLAADSTIQLQLFGLLGAATLLGGSVGAALNIIRLS

SEQ ID NO: 26007 - protein, 212 aa, Bacillus amyloliquefaciens; identical to SEQ ID NO: 654
  strain ATCC 23350 / DSM 7 / BCRC 11601 / NBRC 15535 / NRRL B-14393

SEQ ID NO: 26008 - protein, 285 aa, Bacillus amyloliquefaciens
  strain ATCC 23350 / DSM 7 / BCRC 11601 / NBRC 15535 / NRRL B-14393
MPLVSMTEMLNTAKEKGYAVGQFNLNNLEFTQAILQAAQEEKSPVILGVSEGAGRYMGGFKTVVAMVKALMEEYKVTVPVAIHLDHGSSFESCAKAIHAGFTSVMIDASHHPFEENVATTAKVVELAHFHGVSVEAELGTVGGQEDDVIAEGVIYADPKECQELVERTGIDCLAPALGSVHGPYKGEPNLGFKEMEDIGKTTGLPLVLHGGTGIPTADIKKSISLGTAKINVNTENQISSAKAVRETLAAKPNEYDPRKYLGPAREAIKETVIGKMREFGSSNQA

SEQ ID NO: 26009 - protein, 418 aa, Bacillus amyloliquefaciens
  strain ATCC 23350 / DSM 7 / BCRC 11601 / NBRC 15535 / NRRL B-14393
MSDEQNKEKQIHRRDVLKWGAVAGAAVAVGASGLGGLAPLFKPAATASKKSQGKSESDQIVPFYGKHQAGITTAHQTYVYFAALDVMSSDKADVISLFRNWTSLTQLLTSGAALSGEQKNKYMPPQDTGESQDLAPANLTVTFGFGPGFFEKDGKDRFGLKDKKPKHLADIPPMPNDKLDKKQGGGDIVIQVCADNEQSAFHAVRNLIKQAVGVCEVRFLNKGFLSGGKNGETPRNLFGFKDGTGNQSTKDENLMNSIVWVQSGEPDWMTGGTYMAFRKIKMFLEIWDRSSLKDQEDTFGRMKSSGAPFGQKKETDPVKLNQIPADSHVSVAKSTGRQILRRAFSYTDGIDPKTGYVDAGLLFISFQKDPDRQFVPMLKALAAKDALNEYTQTIGSSLFACPGGCKKGEYIAQRLLES

SEQ ID NO: 26010 - protein, 212 aa, Bacillus amyloliquefaciens
  strain ATCC 23350 / DSM 7 / BCRC 11601 / NBRC 15535 / NRRL B-14393
MAGNLVSCKACGKEIAKGVKKCPNCGKDQRNFFMRHKIITLLLAVVVIIILVNIGGGGGSSSSKTASSKAAESKEKLYNIGDTVKTEKTEVTVTKVEKRDSVGSEFVEKKASDGGVIVAVQYTVKNVSNKPLSSFSIPSVKLVDSKGTSYDPDIDASSTYATETKVNNSKILSDLNPNIKVTGVKAFEVDKNAYAKGTWKIKFSNDVEVKVK

SEQ ID NO: 26011 - protein, 293 aa, Bacillus amyloliquefaciens; identical to SEQ ID NO: 655
  strain ATCC 23350 / DSM 7 / BCRC 11601 / NBRC 15535 / NRRL B-14393

SEQ ID NO: 26012 - protein, 187 aa, Bacillus amyloliquefaciens
  strain ATCC 23350 / DSM 7 / BCRC 11601 / NBRC 15535 / NRRL B-14393
MSLIGKEVLPFEAKAFKNGEFIDVTNEDLKGQWSVFCFYPADFSFVCPTELEDLQGQYAALKELGVEVYSVSTDTHFVHKGWHDSSEKIGKITYAMIGDPSQTISRNFDVLDEESGLADRGTFIIDPDGVIQTVEINAGGIGRDASNLVNKVKAAQYVRQNPGEVCPAKWEEGGETLTPSLDLVGKI

SEQ ID NO: 26013 - protein, 331 aa, Bacillus amyloliquefaciens
  strain FZB42
MSIKKMSAVFFILLLTAFTAACSSETSGGQESSTAKVKIKETAWAASDDTEHPAALKVTVTVKNTGKDPLTVKSSDFSLYQDDAKTAKTDKEDLMQSGTLHAGKTVTGNLYFTADEGKSYELVYQPQAKDAKPLSYKLKVKGTASNAKPDPADALSAYIDVMLYGKHNKDFTRLTGVNEKMTAAAYQESAKASFIASAGISQEQADSKAISAIIDAMSSALRDNTELKVHTKSMSGKKAVLEAKVTPLDMSPLAGQLQDRVQDYAGKHPDADENEIVSHLLSVYPEEFMRLKPASSSVTREIEMKKNARGQWYLDTDADLEGLTEAFLKTS

SEQ ID NO: 26014 - protein, 665 aa, Bacillus amyloliquefaciens
  strain FZB42
MAIQNLINNGSFESGDLTGWSGVNASIVSAFAHTGAFSAQFAGGITSASLSQTVPVSPQQSFQLFISLGKIGTIANPEINLRVLYLDASNAVVGTGLNINVTIGNMPNTIFDTWTEVYQTTTAAPAAAVQAQILISKTAGSSNTPVVLIDDVAFVEVTGITGATGPTGATGATGSTGATGATGPTGATGDTGPTGVTGATGPTGATGATGPTGVTGDIGPTGATGATGPTGATGATGPTGATGATGPTGVTGATGPTGATGTTGPTGATGATGPTGATGATGPTGATGATGPTGATGATGPTGVTGDTGPTGVTGATGPTGATGATGPTGATGATGPTGATGATGPTGATGATGPTGVTGATGPTGATGATGPTGATGATGPTGATGATGPTGATGATGATGPTGITGDIGSTGATGATGPTGVTGATGPTGATGITGPTGATGDTGATGPTGATGDTGPTGATGATGPTGATGDTGPTGATGATGPTGVTGATGPTGVTGDTGPTGATGDTGPTGATGATGPTGATGSQPTVAFQNAVDQVVIPLDGTPTSVLTATITAVATQLVKIDTTIQLNITLNPLTPDFSLVLSLDFERNGIIISTETLELNLFYSAGQSIIIPHTFVDQVPASGITVYNAVLTVGNTNNVTQVDITNRALNATSFPLP

SEQ ID NO: 26015 - protein, 416 aa, Bacillus amyloliquefaciens
  strain FZB42
MAIDNLIVNGGFESGDLNGWDVANAAVNSIFAHSGTYSAQFLIETNVASLSQIVPVTVGQAYHFQVSLGTIGTASNPQVNLQILYLNSLGEPIATGLDAAITIGHLPNVIFNTWTEVYQTTAVVPDGVTDAQIMISKASVNTNTTILIDDVSLLQIIVNSGPTGSTGSTGPTGPTGRTGTTGVTGSTGAMGVTGSTGVTGTTGPTGATGITGPTGRTGTTGVTGSTGATGVTGTTGATGITGPTGRTGTTGVTGSTGATGVTGTTGATGVTGVTGVTGPTASTPALLFTRTNGPLTVYPPLNTEVPVAALEIPVNTLQNVKLDYSVSVDVTSTANSNFVFEIRLYRGAVQIHTRLLSRSVISATTQRFGVADTTVDTAPTAGTNTYQLRIIFTTANNLTTATALNIDFNSISFPTT

SEQ ID NO: 26016 - protein, 278 aa, Bacillus amyloliquefaciens
  strain FZB42
MKISLKKKAGFWKKTAVSSLIFTMFFTLMMSGTVFAAGLNKDQKRRAEQLTSIFENGKTEIQYGYVEALDDGRGYTCGRAGFTTATGDALEVVEVYTKAVPNNKLKKYLPELRRLAKDESDDISNLKGFASAWRSLGNDKAFRAAQDKVNDSLYYQPAMERSENAGLKTALAKAVMYDTVIQHGDGDDPDSFYALIKRTNKKMGGSPKDGTDEKKWLNKFLDVRYDDLMNPSDEDTQDEWRESVARVDVFRDIVKEKNYNLNGPIHVRSSEYGNFTIQ

SEQ ID NO: 26017 - protein, 430 aa, Bacillus amyloliquefaciens; identical to SEQ ID NO: 5169
  strain FZB42

SEQ ID NO: 26018 - protein, 212 aa, Bacillus amyloliquefaciens
  strain FZB42
MAGNLVSCKACGKEIAKGVKKCPNCGKDQRNFFMRHKIITLLLAVVVIIILVNIGGGGGSSSSKTASSKAAESKEKLYNIGDTVKTEKTEVTVTKVEKRDSVGSQFVEKKASDGGVIVAVQYTVKNVSNKPLSSFSIPRAKLVDSKGTSYDSDIDASSSYATETKVDNSKILSDLNPNIKVTDVKAFEVDKNAYSKGTWKLKFSNDVEVKIK

SEQ ID NO: 26019 - protein, 41 aa, Bacillus amyloliquefaciens
  strain FZB42
MTQIKVPTALIASVHGEGQHLFEPMAARCTCTTIISSSSTF

SEQ ID NO: 26020 - protein, 232 aa, Bacillus amyloliquefaciens
  subsp. plantarum AS43.3
MSSGRNQYMILKQKPYKYMSRHMKHRYEQLPCEHERPETGTEKRFPSSDENRSALCVPGLRGPEGKRGPAGSRGPQGEAGPPGPPGPEGPPGAVPAVAFQNTADQMMIPLEGTPINVLSAVIAAPTDQLVKTDAVIQVNVELDPLASHFSLVLALELQRNGVSIQTQRQERNLFSSGGQIIGIPFTYIDEMKADETAAYQLYLSVLSSNYVTQVAAANRSLIATGFPIQGSD

SEQ ID NO: 26021 - protein, 331 aa, Bacillus amyloliquefaciens
  subsp. plantarum AS43.3
MSIKKMSAVFFILLLTAFTAACSSETSGGQESSTAKVKIKETAWAASNDTEHPAALKVTVTVKNTGKDPLTVKSSDFSLYQDDAKTAKTDKEDLMQSGTLHAGKTVTGNLYFTADEGKSYELVYQPQAKDAKPLSYKLKVKGTASNAKPDPADALSAYIDVMLYGKHNKDFTRLTGVNEKMTAAAYQESAKASFIASAGISQEQADSKAISAIIDAMSSALRDNTELKVHTKSMSGKKAVLEAKVTPLDMSPLAGQLQDRVQDYAGKHPDADENEIVSHLLSVYPEEFMRLKPASSSVTREIEMKKNARGQWYLDTDADLEGLTEAFLKTS

SEQ ID NO: 26022 - protein, 209 aa, Bacillus amyloliquefaciens
  subsp. plantarum AS43.3
MAPVTPVSPVTPVAPVTPVAPVTPVAPVAPVDPVSPVAPVTPVAPVTPVAPVTPVAPVIPVAPVTPVVPVTPVAPVTPVTPVTPVAPVIPVVPVTPVEPVTPVAPVTPVAPVTPVTPVTPVAPVIPVEPVTPVAPVNPIAPVTPVAPVIPVAPVFPVEPVAPVNPVAPVNPVAPVSPVAPVSPVAPVHPVAPVHPVAPVHPVAPVNPLT

SEQ ID NO: 26023 - protein, 176 aa, Bacillus amyloliquefaciens
  subsp. plantarum AS43.3
MSLPNIPNITPDITLSRCETLNLLLSSVAMEEIGLSHILQAEAERIQMFLGASGDPSLEELSSINRSTERLLRTVMKSQLLLQTKLEDIIFLQDSEVCMDPDDPSNPSNPGDPDDPWNPDDPSNPSDPGDPDDPWNPDDPSDPEDPCDGLFYGRIGCCECGDCEDCGWKKKGGERS

SEQ ID NO: 26024 - protein, 278 aa, Bacillus amyloliquefaciens
  subsp. plantarum AS43.3
MKISLKKKADFWKKTAVSSLIFTMFFTLMMSGTVLAAGLNKDQKRRAEQLTSIFENGKTEIQYGYVEALDDGRGYTCGRAGFTTATGDALEVVEVYTKAVPNNKLKKYLPELRRLAKDESDDISNLKGFASAWRSLGNDKAFRAAQDKVNDSLYYQPAMERSENAGLKTALAKAVMYDTVIQHGDGDDPDSFYALIKRTNKKMGGSPKDGTDEKKWLNKFLDVRYDDLMNPSDEDTQDEWRESVARVDVFRDIVKEKNYNLNGPIHVRSSEYGNFTIQ

SEQ ID NO: 26025 - protein, 248 aa, Bacillus amyloliquefaciens
  subsp. plantarum AS43.3
MRGIPGVTGPAGPVGATGPAGPAGATGATGAIGPAGATGATGVTGAAGVTGATGATGATGATGATGVTGATGVTGVTGATGDIGPTGPAGATGATGVTGAAGVTGATGATGSGLSEYAYVYNLSAETVAIEAPVIFDSTGITTAGITHAPGTAQIIVTTPGDYEVTFSVSGVEPNQFTLFVNGGPVTNTVYGSGAGTQQNNGQAIITLAAGDILTLVNHTSAAAVTLQTLAGGTQTNVNASIVLKKLN

SEQ ID NO: 26026 - protein, 212 aa, Bacillus amyloliquefaciens
  subsp. plantarum AS43.3
MAGNLVSCKACGKEIAKGVKKCPNCGKDQRNFFMRHKIITLLLAVVVIIILVNIGGGGGSSSSKTASSKAAESKEKLYNIGDTVKTEKTEVTVTKVEKRDSVGSQFVEKKASDGGVIVAVQYTVKNVSNKPLSSFSIPRAKLVDSKGTSYDSDIDASSSYATETKVDNSKILSDLNPNIKVTDVKAFEVDKNAYSKGTWKIKFSNDVEVKIK

SEQ ID NO: 26027 - protein, 331 aa, Bacillus amyloliquefaciens
  subsp. plantarum CAU B946
MSIKKMSAVFFILLLTAFTAACSSETSGGQESSTAKVKIKETAWAASDDTEHPAALKVTVTVKNTGKDPLTVKSSDFSLYQDDAKTAAADKDDQMQSGTLHAGKTVTGNLYFTADEGKSYELVYQPQAKDAKPLSYKLKVKGTASNAKPDPADALSAYIDVMLYGKHNKDFTRLTGVNEKMTAAAYQESAKASFIASAGISQEQADSKAISAIIDAMSSALRDNTELKVHTKSMSGKKAVLEAKVTPLDMSPLAGQLQDRVQDYAGKHPDADENEIVSHLLSVYPEEFMRLKPASSSVTREIEMKKNARGQWYLDTDADLEGLTEAFLKTS

SEQ ID NO: 26028 - protein, 278 aa, Bacillus amyloliquefaciens
  subsp. plantarum CAU B946
MKISLKKKAGFWKKTAVSSLIFTMFFTLMMSGTVFAAGLNKDQKRRAEQLTSIFENGKTEIQYGYVEALDDGRGYTCGRAGFTTATGDALEVVEVYTKAVPNNKLKKYLPELRRLAKDESDDISNLKGFASAWRSLGNDKAFRAAQDKVNDSLYYQPAMKRSENAGLKTALAKAVMYDTVIQHGDGDDPDSFYALIKRTNKKMGGSPKDGTDEKKWLNKFLDVRYDDLMNPSDEDTQDEWRESVARVDVFRDIVKEKNYNLNGPIHVRSSEYGNFTIQ

SEQ ID NO: 26029 - protein, 430 aa, Bacillus amyloliquefaciens
  subsp. plantarum CAU B946
MPYIVDVYAREVLDSRGNPTVEVEVYTETGAFGRALVPSGASTGEYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGMNTAVGDEGGFAPNLGSNEEALQTIVEAIEKAGFKPGEEVKLAMDAASSEFYNKEDGKYHLSGEGVVKTSAEMVDWYEEMVSKYPIISIEDGLDENDWEGHKLLTERLGKKVQLVGDDLFVTNTKKLAEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 26030 - protein, 186 aa, Bacillus amyloliquefaciens
  subsp. plantarum CAU B946
MKKWLVLFMSLGLALALAACGSSENASSDNNGESKNEKAEKKSSDKEVKMGQDIKVGDMIYNIKSRKATDQVGPSVLPEKANDKYLVIEATLKNTGNDKITVDASFFKLKKGKKTYEADSAASVSANQKEDGSIDNSFLMQDLNPDSTMSGKVVFDVAPEVANAKDLKLVVQTGIYGTQKGTISLK

SEQ ID NO: 26031 - protein, 228 aa, Bacillus amyloliquefaciens
  subsp. plantarum CAU B946
MSSGRNQYMILKQKPYKYMSRHMKRRYEQLPCELESPETGTEKRFPSSDENRSALCVPGLRGPEGKRGPAGSRGPQGEAGPPGPPGPEGPPGAVPAVAFQNTADLMTLPLEGTPINVLSAVIAAPTDQLVKTDAVIQVNVELDPLASHFSLVLAVELQRNGVTIQTQRQERNLFSSGGQIIGIPFTYIDEMKADETAAYQLYLSVLSSNYVTQVAAANRSLIATGFPI

SEQ ID NO: 26032 - protein, 212 aa, Bacillus amyloliquefaciens; identical to SEQ ID NO: 26018
  subsp. plantarum CAU B946

SEQ ID NO: 26033 - protein, 194 aa, Bacillus amyloliquefaciens
  subsp. plantarum CAU B946
MSLPNIPNITPDITLSRCETLNLLLSSVAMEEIGLSHILQAEAERIQMFLSASGDPSLGELSSINRSTERLLRTVMKSQLLLQTKLEDIIYLQDAEACIDPDDPSNPSDPGDPDDPWNPDDPSNPSDPGDPDDPWNPDDPSNPSDPGDPDDPWNPDDPSDPEDPCDDLFYGRIGCCECGDCEDCDWKKKGGERS

SEQ ID NO: 26034 - protein, 230 aa, Bacillus amyloliquefaciens
  subsp. plantarum CAU B946
MILFMGFLTIFSTIGFIVGLIFLVFRKTRKKAYWLVPSTLILAIIGFSFMSKPVEELGEREEQPISSANIEPMDSDAQEDSDEDDSTLIEDGNEDDSTVVHELNWSEKKNDTTFKIDRVGIVKDEMESGAEGAIAVHFVIDNGSKKDISTFPNQGTLLTNTKEQIDASLSLSEDIGGEIMSGAKKEGYVLYPIKKLNDPNDIKSIRVKWDFWPDKDVTTNVQDFDISLTW

SEQ ID NO: 26035 - protein, 132 aa, Bacillus amyloliquefaciens
  subsp. plantarum CAU B946
MAKLDNILNESNGVLTSARDNGKGVPITDISVADNSEENPLYVKGLKGDPGEPGPKGEKGDPGDPGPKGEKGDPAVIEEGSIAHEMLGEKSVRSKNVGTGSIMLEHLNSEVKAVLDGMQKQIDELKPTTPAE

SEQ ID NO: 26036 - protein, 65 aa, Bacillus amyloliquefaciens
  subsp. plantarum CAU B946
MNSFYDVQQLFKSFGHIVYFGDRQAEIDFMKDELKEMYLSNVIERDLWQKAAGVLQRESERIRGS

SEQ ID NO: 26037 - protein, 190 aa, Bacillus amyloliquefaciens
  subsp. plantarum M27
GVTGVTGATGVTGATGVTGATGVTGATGVTGATGVTGVTGPTGVTGPTGPTGPTGSTPTLLFTRTNGPLTVYPPLNTEVPVATLAIPVNALQNVKLDYALSAALTTAANSNFVFEVRLYRGAVQIHTRTLSRTNTTAATDSFSIADTTVDTAPTAGTNTYQLRVVFTTANNITAASALNIDFNSIRFPTT

SEQ ID NO: 26038 - protein, 235 aa, Bacillus amyloliquefaciens
  subsp. plantarum M27
MSSGRNQYMILKQKPYKYMSRHMKRRYEQLPCELESLETGTEKRFPSSDENRSALCVPGLRGPEGKRGPAGSRGPQGEAGPPGPPGPPGPGGPPGAVPAVAFQNIADLMTLPLEGTPINVLSAVIAAPTDQLVKTDAVIQVNVELDPLASHFSLVLAVELQRNGVTIQTQRQERNLFSSGGQIIGIPFTYIDEMKADETAAYQLYLSVLSSNYVTQVAAANRSLIATGFPIQGSD

SEQ ID NO: 26039 - protein, 951 aa, Bacillus amyloliquefaciens
  subsp. plantarum M27
ITGPTGSTGATGPTGATGSTGETGVTGPTGETGTTGSAGVTGATGETGATGVTGPTGATGVTGETGPIGATGSTGATGEIGSTGDTGATGVTGPTGITGATGATGVTGATGSTGATGAIGSTGPTGSTGATGPTGVTGLTGVTGSTGATGVTGVTGSTGATGLTGETGATGSTGPTGATGPTGLTGSTGATGTTGSTGVTGATGETGATGATGVTGEIGPTGSTGATGETGSTGSTGATGVTGPTGATGSTGATGVTGPTGATGSTGETGATGSTGATGPTGVTGATGETGSTGATGASGATGATGITGETGATGSTGVTGVTGATGSTGSTGVTGSTGSTGVTGATGSTGVTGSTGSTGVTGATGATGVTGATGPTGSTGSTGVTGATGSTGSIGETGLTGVTGSTGITGVTGSTGPTGETGATGVTGPTGVTGSTGETGPTGATGATGVTGATGVTGSTGITGSTGPTGPTGVTGETGTTGSTGVTGTTGITGPTGSTGETGATGSTGVTGVTGATGATGVTGITGGTGTTGPTGATGITGATGPTGVTGATGATGATGSTGDTGATGVTGATGVTGSTGETGPTGVTGETGTTGSTGVTGTTGETGATGVTGATGLTGSTGATGSTGVTGTTGETGATGSTGVTGATGVTGSTGITGPTGSTGSTGETGATGSTGVTGVTGSTGATGVTGVTGVTGSTGATGVTGITGGTGTTGPTGATGITGATGETGPTGSTGDTGATGVTGATGVTGSTGETGATGVTGSTGITGATGSTGSTGETGPTGVTGSTGVTGATGEAGPTGVTGETGATGSTGVTGSTGVTGATGVTGATGVTGSTGATGVTGSTGATGVTGATGITGATGATGVTGSTGETGPTGVTGLTGATGVTGPTGPTGVTGATGVTGATGVTGATGVTGATGVTGATGVTGATGVTGATGVTGATGVTGATG

SEQ ID NO: 26040 - protein, 194 aa, Bacillus amyloliquefaciens; identical to SEQ ID NO: 26033
  subsp. plantarum M27

SEQ ID NO: 26041 - protein, 430 aa, Bacillus amyloliquefaciens; identical to SEQ ID NO: 26029
  subsp. plantarum M27

SEQ ID NO: 26042 - protein, 331 aa, Bacillus amyloliquefaciens
  subsp. plantarum M27
MSIKKMSAVFFILLLTAFTAACSSETSGGQESSTAKVKIKETAWAASDDTEHPAALKVTVTVKNTGKDPLTVKSSDFSLYQDDAKTAAADKDDQMQSGTLHAGKTVTGNLYFTADEGKSYELVYQPQAKDAKPLSYKLKVKGTASNAKPDPADALSAYIDVMLYGKHNKDFTRLTGVNEKMTAAAYQESAKASFIASAGISQEQADSKAISAIIDAMSSALRDNTELKVHTKSMSGKKAVLEAKVTPLDMSPLAGQLQDRVQDYAGKHPDADENEIVSHLLSVYPEEFMRLKPASSSVTREIEMKKNARGQWYLDTDADLEGLTEAFLKAS

SEQ ID NO: 26043 - protein, 212 aa, Bacillus amyloliquefaciens; identical to SEQ ID NO: 26018
  subsp. plantarum M27

SEQ ID NO: 26044 - protein, 278 aa, Bacillus amyloliquefaciens; identical to SEQ ID NO: 26028
  subsp. plantarum M27

SEQ ID NO: 26045 - protein, 230 aa, Bacillus amyloliquefaciens
  subsp. plantarum YAU B9601-Y2
MGIFLSFIGVFLFIGFIAGLVLFFIKRTRKLGKLTAPLCFVASIFFFYLGGQFSDTSSRNRDTGTELGDNTNITSLDEEKNEISSKDKEVSVSDDDSTVVHELNWSEKQNDTTFKIDRIGIVKDEMESGAEGTIAVHFVIDNGSKKDISTFPNQGTLLTNTKEQIDASLSLSEDIGGEIMSGAKKEGYVLYPIKKLKDPNEIKSVRIKWDFWPDKDVTTNVKDFDINLTW

SEQ ID NO: 26046 - protein, 159 aa, Bacillus amyloliquefaciens
  subsp. plantarum YAU B9601-Y2
MAKLNNILNESNGVLTSARDNGKGTPITDISVADNSEENPLYVKGLKGDPGEQGPKGDTGAQGPKGEKGDPGEQGPQGEPGPAGPKGETGEQGPKGEKGDPAVIGEGSIVHEMLADKSVRSNNIGTGSVMMDHLNSEVKAVLDGMQKQIDELKSTTPAE

SEQ ID NO: 26047 - protein, 219 aa, Bacillus amyloliquefaciens
  subsp. plantarum YAU B9601-Y2
MILFMGFLTIFSTVGFIVGLIFLVFRKTRKKAYWLVPSTLILAIIGFSFMSKPVEELGEREEQPISSANIEPMDSDAQEDSDEDDSTVVHKLNWSEKKNDTTFKIDRVGIVKNEMESGAEGAIAVHFVIDNRSKKDISTFPNQGTLLTNTKEQIDASLSLSEDIGGEIMSGAKKEGYVLYPIKKLNDPNDIKSIRVKWDFWPDKDVTTNAQDFDINLTW

SEQ ID NO: 26048 - protein, 141 aa, Bacillus amyloliquefaciens
  subsp. plantarum YAU B9601-Y2
MAKLDNILNESNGVLTSARDNGKGVPITDISVADNSEENPLYVKGLKGDPGEPGPQGEPGPPGPQGEPGEPGEPGPKGEPGEPAVIEEGSIAHEMLAEKSVRSKNVGTGSIMLEHLNSEVKAVLDGMQKQIDELKPTTPAE

SEQ ID NO: 26049 - protein, 94 aa, Bacillus amyloliquefaciens
  subsp. plantarum YAU B9601-Y2
MNERRPIYGGGFGGGYGGFGGYPGYGFGGYGGFGGYPGHGFGGGYGYPGYGFGGYGGFGGYGGFGGYPGYGFGGYGGGYGGYPFHHHHRDSQYI

SEQ ID NO: 26050 - protein, 232 aa, Bacillus amyloliquefaciens
  subsp. plantarum YAU B9601-Y2
MSSGRNQYMILKQKPYKYMSRHMKRRYEQLPCELERPETGAEKRFPSSDENRSALCVPGLRGPEGKRGPAGSRGPQGEAGPPGPPGPEGPPGAVPAVAFQNTADQMMIPLEGTPINVLSTVIAAPTDQLVKTDAVIQVNVELDPLASHFSLVLAVDLQRNGVSIQTQRQERNLFSSGGQIIGIPFTYIDEMKADETAAYQLYLSVLSSNLVTQVAAANRSLIATGFPIQGSD

SEQ ID NO: 26051 - protein, 680 aa, Bacillus amyloliquefaciens
  subsp. plantarum YAU B9601-Y2
MNNPIINGSFETGTLAGWSSANTQINSLFAHSGRYSAQFIGAQPYAYLSQIVPISAKSLTLFVSLATLGNEPSPQVTLQIIYVSAAGEQISSIQENITPGNLPNVLFHTWSEIYKTSSVPSGAASAVIVLSKVSSGTVLIDDVSLAQTGGEPGVTGITGPTGVTGPTGVTGARGVTGVTGVTGSTGSTGARGATGSTGAPGVTGPTGATGSTGATGGTGSTGATGTTGSTGPTGVTGAAGSTGPTGEIGPTGVTGPIGITGVTGPTGVTGSTGSTGATGSTGLTGSTGDTGPTGSTGETGATGSTGSTGVTGAIGPAGPTGATGATGAIGPTGGSGSTGSTGEIGPTGATGSTGVTGATGITGATGVTGSSGVTGSTGITGATGVTGTTGVTGVTGATGPTGATGVTGVTGITGVTGSTGSAGATGPTGVAGPTGVTGSTGVTGSTGPTGEIGPTGVTGETGSTGEIGATGVTGATGTTGVTGSTGATGATGVTGVTGATGITGATGAGAIIPYASGLPTAVTTIAGGLIGTVSLVGFGNSVTGVNVGGGGAIDLTGAGGTLLNFAFSAPRSGTITSIAAYFSTTAALSLVGSTVTITAQLYSSTVPNNTFTPIPGASVTLAPPLTGILSIGSISNGITTGLNIAVTPQTRLLMVFSATATGLSLINTVAGYASAGVTIS

SEQ ID NO: 26052 - protein, 278 aa, Bacillus amyloliquefaciens; identical to SEQ ID NO: 26028
  subsp. plantarum YAU B9601-Y2

SEQ ID NO: 26053 - protein, 430 aa, Bacillus amyloliquefaciens; identical to SEQ ID NO: 5169
  subsp. plantarum YAU B9601-Y2

SEQ ID NO: 26054 - protein, 189 aa, Bacillus amyloliquefaciens
  subsp. plantarum YAU B9601-Y2
MSLPNIPNITPDITLSRCETLNLLLSSVAMEEIGLSHILQAEAERIQMFLGASGDPSLEELSSINRSTERLLRTVMKSQLLLQTKLEDIIFLQDSEACMDPDDPSNPSNPGDPDDPWNPDDPSNPSDPGDPDDPWNPDDPSDPEDPCDPCFPNPHPEDPCDGLFYGRIGCCECGDCEDCGWKKKGGERS

SEQ ID NO: 26055 - protein, 621 aa, Bacillus amyloliquefaciens
  subsp. plantarum YAU B9601-Y2
MSQPNLPNITPVVTLSRDDTINLLLSSIAMEELGMAHILNAEGEKIQYALGTIPGLTGPPSSLADILNLNESVRDTLDSLMKQELLLGSKLDSISNIPTLAGPTGATGPTGPAGGPAGSTGPIGPAGATGPTGPTGPTGVTGAGLQGIVAFNPLIAPTYTPGQVVLYNGSSYVVNTPSPAGIPDTSADYTLLAAAGSTGPIGPTGATGAGLTGLTAFDPAAAPFYTAGQVVLYEGASYVVNINNPSGIPGTSPDYTLLAAAGPTGPTGVTGAGLQGIVPFDPLAAAAYTAGQPVTFNGSSYVANVNSPAGTPGASADYTLLAAAGITGATGGTGPTGSTGATGVSGPTGITGATGGTGPTGSTGATGGTGPTGFTGATGVSGPTGFTGATGGTGPTGSTGATGETGPTEFTGATGGTGPTEFTGATGGTGPTGSTGATGGTGPTGSTGATGGTGPTGITGATGVTGPTGSTGATGGTGPTGSTGTSLTATSGYASNTGGGVVAVIVGGTTISLPNEQNLSADITANAANTVFTVAPAGRYYISYHINLTAGLLVSSRILINGTPPASSIIAPVASLANFNNSFIVTLPAGSTIQLQLFGLLGAATLLGGSVGAALNIIRLS

SEQ ID NO: 26056 - protein, 212 aa, Bacillus amyloliquefaciens; identical to SEQ ID NO: 26018
  subsp. plantarum YAU B9601-Y2

SEQ ID NO: 26057 - protein, 430 aa, Bacillus amyloliquefaciens TA208; identical to SEQ ID NO: 5169

SEQ ID NO: 26058 - protein, 331 aa, Bacillus amyloliquefaciens TA208
MSIKKMSAVFFILLLTAFTAACSSETSGGKESGTAKVKIKDTAWVTSDDAEHPTALKVTVTVKNTGNDPLTVKSSDFSLYQNDAKTAAADKEDRMQSGTLHADKTVTGSLYFTADEGKSYELVYQPQAKDAKPLSYKLKVKGTAPKAKPDPADALSAYIDVMLYGRHNKDFTRLTGVNEKMTAAAYQESAKASFIASAGISKEQADSKAISAIIDAMSSALREHTELKVQTKSMSDGKAVLEAKVTPLDMSPLAGRLQDRVQDYAGKHPDADENEIVSHLLSVYPEEFMRLKPASSSVTKEIEMKKNARGQWYLDTDADLEGLTEAFLKTS

SEQ ID NO: 26059 - protein, 481 aa, Bacillus amyloliquefaciens TA208
MGITGATGVTGVTGATGVTGVTGATGVTGATGDPGATGPTGATGITGATGSTGVTGATGVTGATGATGATGVTGDTGTTGITGATGATGVTGTTGATGSTGVTGATGVTGSTGDTGTTGVTGATGATGITGATGSTGVTGVTGVTGVTGATGVTGSTGDTGSTGVTGATGITGVTGVTGDTGATGVTGATGTTGATGSTGVTGVTGVTGATGATGVTGSTGDTGSTGVTGATGITGATGSTGVTGVTGVTGATGITGATGITGATGVTGSTGDTGATGSTGVTGATGVTGATGVTGTTGATGATGATGAGAIIPYASGLPTAVTTIAGGLIGTVSLVGFGSSVTGVNVGGGGAIDLTGAGGTLLNFAFSAPRSGTITSIAAYFSTTAALSLVGSTVTITAQLYSSTVPNNTFTPIPGASVTLAPALTGVLSIGSISNGITTGLNIAVTPQTRLLMVFSATATGLSLINTVAGYASAGVTIS

SEQ ID NO: 26060 - protein, 212 aa, Bacillus amyloliquefaciens TA208; identical to SEQ ID NO: 25987

SEQ ID NO: 26061 - protein, 278 aa, Bacillus amyloliquefaciens TA208
MRSGLKKKSGFWKKTAVSSLIFTMFFTLMMSGTVLAAGLNKDQKRRAEQLTSIFENGKTEIQYGYVEELDDGRGYTCGRAGFTTATGDALEVVEVYTKAVPNNKLKKYLPELRRLAKNESDDTSNLKGFASAWRSLGNDKAFRAAQDEVNDRLYYQPAMKRSDQAGLKTALAKAVMYDTVIQHGDGDDPDSFYALIKRTNKKMGGSPKDGTDEKKWLNKFLDVRYDDLMNPSDEDTQDEWRESVARVDVFRDIVKAKNYNLDGPIHVRSSEYGNFTIQ

SEQ ID NO: 26062 - protein, 430 aa, Bacillus amyloliquefaciens XH7; identical to SEQ ID NO: 5169

SEQ ID NO: 26063 - protein, 212 aa, Bacillus amyloliquefaciens XH7; identical to SEQ ID NO: 25987

SEQ ID NO: 26064 - protein, 331 aa, Bacillus amyloliquefaciens XH7; identical to SEQ ID NO: 26058

SEQ ID NO: 26065 - protein, 622 aa, Bacillus amyloliquefaciens XH7; identical to SEQ ID NO: 26006

SEQ ID NO: 26066 - protein, 278 aa, Bacillus amyloliquefaciens XH7; identical to SEQ ID NO: 26061

SEQ ID NO: 26067 - protein, 331 aa, Bacillus amyloliquefaciens Y2; identical to SEQ ID NO: 347

SEQ ID NO: 26068 - protein, 70 aa, Bacillus amyloliquefaciens Y2
MNNYHVNLKDRKQGRKNGFRLQMKIDLPCAYPGCEVPKAKEDPPAPAVRKGRPVRPVPRGLRGRRERFLR

SEQ ID NO: 26069 - protein, 190 aa, Bacillus amyloliquefaciens Y2
MASIFFFYLGGQFSDTSSRNRDTGTELGDNTNITSLDEEKNEISSKDKEVSVSDDDSTVVHELNWSEKQNDTTFKIDRIGIVKDEMESGAEGTIAVHFVIDNGSKKDISTFPNQGTLLTNTKEQIDASLSLSEDIGGEIMSGAKKEGYVLYPIKKLKDPNEIKSVRIKWDFWPDKDVTTNVKDFDINLTW

SEQ ID NO: 26070 - protein, 227 aa, Bacillus amyloliquefaciens Y2
MLNNRGIIMILFMGFLTIFSTVGFIVGLIFLVFRKTRKKAYWLVPSTLILAIIGFSFMSKPVEELGEREEQPISSANIEPMDSDAQEDSDEDDSTVVHKLNWSEKKNDTTFKIDRVGIVKNEMESGAEGAIAVHFVIDNRSKKDISTFPNQGTLLTNTKEQIDASLSLSEDIGGEIMSGAKKEGYVLYPIKKLNDPNDIKSIRVKWDFWPDKDVTTNAQDFDINLTW

SEQ ID NO: 26071 - protein, 280 aa, Bacillus amyloliquefaciens Y2
MAMKISLKKKAGFWKKTAVSSLIFTMFFTLMMSGTVFAAGLNKDQKRRAEQLTSIFENGKTEIQYGYVEALDDGRGYTCGRAGFTTATGDALEVVEVYTKAVPNNKLKKYLPELRRLAKDESDDISNLKGFASAWRSLGNDKAFRAAQDKVNDSLYYQPAMKRSENAGLKTALAKAVMYDTVIQHGDGDDPDSFYALIKRTNKKMGGSPKDGTDEKKWLNKFLDVRYDDLMNPSDEDTQDEWRESVARVDVFRDIVKEKNYNLNGPIHVRSSEYGNFTIQ

SEQ ID NO: 26072 - protein, 430 aa, Bacillus amyloliquefaciens Y2; identical to SEQ ID NO: 5169

SEQ ID NO: 26073 - protein, 212 aa, Bacillus amyloliquefaciens Y2; identical to SEQ ID NO: 26018

SEQ ID NO: 26074 - protein, 179 aa, Bacillus anthracis
CVFFLAFSYYFAPDHRTVLELYAPDMFEYMNKLEKGGFEKISESLKKEGVEKDRIDVLKGEKALKASGLVPEHADAFKKIARELNTYILFRPVNKLATNLIKSGVATKGLNVHGKSSDWGPVAGYIPFDQDLSKKHGQQLAVEKGNLENKKSITEHEGEIGKIPLKLDHLRIEELKENG

SEQ ID NO: 26075 - protein, 251 aa, Bacillus anthracis
EHYTESDIKRNHKTEKNKTEKEKFKDSINNLVKTEFTNETLDKIQQTQDLLKKIPKDVLEIYSELGGEIYFTDIDLVEHKELQDLSEEEKNSMNSRGEKVPFASRFVFEKKRETPKLIINIKDYAINSEQSKEVYYEIGKGISLDIISKDKSLDPEFLNLIKSLSDDSDSSDLLFSQKFKEKLELNNKSIDINFIKENLTEFQHAFSLAFSYYFAPDHRTVLELYAPDMFEYMNKLEKGGFEKISESLKKE

SEQ ID NO: 26076 - protein, 262 aa, Bacillus anthracis
AGGHGDVGMHVKEKEKNKDENKRKDEERNKTQEEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEVQEVFAKAFAYYIEPQHRDVLQLYAPEAFNYMDKFNEQEINLSLEELKDQ

SEQ ID NO: 26077 - protein, 233 aa, Bacillus anthracis
GYYFSDLNFQAPMVVTSSTTGDLSIPSSELENIPSENQYFQSAIWSGFIKVKKSDEYTFATSADNHVTMWVDDQEVINKASNSNKIRLEKGRLYQIKIQYQRENPTEKGLDFKLYWTDSQNKKEVISSDNLQLPELKQKSSNSRKKRSTSAGPTVPDRDNDGIPDSLEVEGYTVDVKNKRTFLSPWISNIHEKKGLTKYKSSPEKWSTASDPYSDFEKVTGRIDKNVSPEARH

SEQ ID NO: 26078 - protein, 809 aa, Bacillus anthracis
MNIKKEFIKVISMSCLVTAITLSGPVFIPLVQGAGGHGDVGMHVKEKEKNKDENKRKDEERNKTQEEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEVQEVFAKAFAYYIEPQHRDVLQLYAPEAFNYMDKFNEQEINLSLEELKDQRMLSRYEKWEKIKQHYQHWSDSLSEEGRGLLKKLQIPIEPKKDDIIHSLSQEEKELLKRIQIDSSDFLSTEEKEFLKKLQIDIRDSLSEEEKELLNRIQVDSSNPLSEKEKEFLKKLKLDIQPYDINQRLQDTGGLIDSPSINLDVRKQYKRDIQNIDALLHQSIGSTLYNKIYLYENMNINNLTATLGADLVDSTDNTKINRGIFNEFKKNFKYSISSNYMIVDINERPALDNERLKWRIQLSPDTRAGYLENGKLILQRNIGLEIKDVQIIKQSEKEYIRIDAKVVPKSKIDTKIQEAQLNINQEWNKALGLPKYTKLITFNVHNRYASNIVESAYLILNEWKNNIQSDLIKKVTNYLVDGNGRFVFTDITLPNIAEQYTHQDEIYEQVHSKGLYVPESRSILLHGPSKGVELRNDSEGFIHEFGHAVDDYAGYLLDKNQSDLVTNSKKFIDIFKEEGSNLTSYGRTNEAEFFAEAFRLMHSTDHAERLKVQKNAPKTFQFINDQIKFIINS

SEQ ID NO: 26079 - protein, 809 aa, Bacillus anthracis
MNIKKEFIKVISMSCLVTAITLSGPVFIPLVQGAGGHGDVGMHVKEKEKNKDENKRKDEERNKTQEEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEVQEVFAKAFAYYIEPQHRDVLQLYAPEAFNYMDKFNEQEINLSLEELKDQRMLSRYEKWEKIKQHYQHWSDSLSEEGRGLLKKLQIPIEPKKDDIIHSLSQEEKELLKRIQIDSSDFLSTEEKEFLKKLQIDIRDSLSEEEKELLNRIQVDSSNPLSEKEKEFLKKLKLDIQPYDINQRLQDTGGLIDSPSINLDVRKQYKRDIQNIDALLHQSIGSTLYNKIYLYENMNINNLTATLGADLVDSTDNTKINRGIFNEFKKNFKYSISSNYMIVDINERPALDNERLKWRIQLSPDTRAGYLENGKLILQRNIGLEIKDVQIIKQSEKEYIRIDAKVVPKSKIDTKIQEAQLNINQEWNKALGLPKYTKLITFNVHNRYASNIVESAYLILNEWKNNIQSDLIKKVTNYLVDGNGRFVFTDITLPNIAEQYTHQDEIYEQVHSKGLYVPESRSILLHGPSKGVELRNDSEGFIHCFGHAVDDYAGYLLDKNQSDLVTNSKKFIDIFKEEGSNLTSYGRTNEAEFFAEAFRLMHSTDHAERLKVQKNAPKTFQFINDQIKFIINS

SEQ ID NO: 26080 - protein, 764 aa, Bacillus anthracis
MKKRKVLIPLMALSTILVSSTGNLEVIQAEVKQENRLLNESESSSQGLLGYYFSDLNFQAPMVVTSSTTGDLSIPSSELENIPSENQYFQSAIWSGFIKVKKSDEYTFATSADNHVTMWVDDQEVINKASNSNKIRLEKGRLYQIKIQYQRENPTEKGLDFKLYWTDSQNKKEVISSDNLQLPELKQKSSNSRKKRSTSAGPTVPDRDNDGIPDSLEVEGYTVDVKNKRTFLSPWISNIHEKKGLTKYKSSPEKWSTASDPYSDFEKVTGRIDKNVSPEARHPLVAAYPIVHVDMENIILSKNEDQSTQNTDSQTRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNEPNGNLQYQGKDITEFDFNFDQQTSQNIKNQLAELNATNIYTVLDKIKLNAKMNILIRDKRFHYDRNNIAVGADESVVKEAHREVINSSTEGLLLNIDKDIRKILSGYIVEIEDTEGLKEVINDRYDMLNISSLRQDGKTFIDFKKYNDKLPLYISNPNYKVNVYAVTKENTIINPSENGDTSTNGIKKILIFSKKGYEIG

SEQ ID NO: 26081 - protein, 809 aa, Bacillus anthracis
MNIKKEFIKVISMSCLVTAITLSGPVFIPLVQGAGGHGDVGMHVKEKEKNKDENKRKDEERNKTQEEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEVQEVFAKAFAYYIEPQHRDVLQLYAPEAFNYMDKFNEQEINLSLEELKDQRMLARYEKWEKIKQHYQHWSDSLSEEGRGLLKKLQIPIEPKKDDIIHSLSQEEKELLKRIQIDSSDFLSTEEKEFLKKLQIDIRDSLSEEEKELLNRIQVDSSNPLSEKEKEFLKKLKLDIQPYDINQRLQDTGGLIDSPSINLDVRKQYKRDIQNIDALLHQSIGSTLYNKIYLYENMNINNLTATLGADLVDSTDNTKINRGIFNEFKKNFKYSISSNYMIVDINERPALDNERLKWRIQLSPDTRAGYLENGKLILQRNIGLEIKDVQIIKQSEKEYIRIDAKVVPKSKIDTKIQEAQLNINQEWNKALGLPKYTKLITFNVHNRYASNIVESAYLILNEWKNNIQSDLIKKVTNYLVDGNGRFVFTDITLPNIAEQYTHQDEIYEQVHSKGLYVPESRSILLHGPSKGVELRNDSEGFIHEFGHAVDDYAGYLLDKNQSDLVTNSKKFIDIFKEEGSNLTSYGRTNEAEFFAEAFRLMHSTDHAERLKVQKNAPKTFQFINDQIKFIINS

SEQ ID NO: 26082 - protein, 800 aa, Bacillus anthracis
MTRNKFIPNKFSIISFSVLLFAISSSQAIEVNAMNEHYTESDIKRNHKTEKNKTEKEKFKDSINNLVKTEFTNETLDKIQQTQDLLKKIPKDVLEIYSELGGEIYFTDIDLVEHKELQDLSEEEKNSMNSRGEKVPFASRFVFEKKRETPKLIINIKDYAINSEQSKEVYYEIGKGISLDIISKDKSLDPEFLNLIKSLSDDSDSSDLLFSQKFKEKLELNNKSIDINFIKENLTEFQHAFSLAFSYYFAPDHRTVLELYAPDMFEYMNKLEKGGFEKISESLKKEGVEKDRIDVLKGEKALKASGLVPEHADAFKKIARELNTYILFRPVNKLATNLIKSGVATKGLNVHGKSSDWGPVAGYIPFDQDLSKKHGQQLAVEKGNLENKKSITEHEGEIGKIPLKLDHLRIEELKENGIILKGKKEIDNGKKYYLLESNNQVYEFRISDENNEVQYKTKEGKITVLGEKFNWRNIEVMAKNVEGVLKPLTADYDLFALAPSLTEIKKQIPQKEWDKVVNTPNSLEKQKGVTNLLIKYGIERKPDSTKGTLSNWQKQMLDRLNEAVKYTGYTGGDVVNHGTEQDNEEFPEKDNEIFIINPEGEFILTKNWEMTGRFIEKNITGKDYLYYFNRSYNKIAPGNKAYIEWTDPITKAKINTIPTSAEFIKNLSSIRRSSNVGVYKDSGDKDEFAKKESVKKIAGYLSDYYNSANHIFSQEKKRKISIFRGIQAYNEIENVLKSKQIAPEYKNYFQYLKERITNQVQLLLTHQKSNIEFKLLYKQLNFTENETDNFEVFQKIIDEK

SEQ ID NO: 26083 - protein, 814 aa, Bacillus anthracis
MAKTNSYKKVIAGTMTAAMVAGVVSPVAAAGKTFPDVPADHWGIDSINYLVEKGAVKGNDKGMFEPGKELTRAEAATMMAQILNLPIDKDAKPSFADSQGQWYTPFIAAVEKAGVIKGTGNGFEPNGKIDRVSMASLLVEAYKLDTKVNGTPATKFKDLETLNWGKEKANILVELGISVGTGDQWEPKKTVTKAEAAQFIAKTDKQFGTEAAKVESAKAVTTQKVEVKFSKAVEKLTKEDIKVTNKANNDKVLVKEVTLSEDKKSATVELYSNLAAKQTYTVDVNKVGKTEVAVGSLEAKTIEMADQTVVADEPTALQFTVKDENGTEVVSPEGIEFVTPAAEKINAKGEITLAKGTSTTVKAVYKKDGKVVAESKEVKVSAEGAAVASISNWTVAEQNKADFTSKDFKQNNKVYEGDNAYVQVELKDQFNAVTTGKVEYESLNTEVAVVDKATGKVTVLSAGKAPVKVTVKDSKGKELVSKTVEIEAFAQKAMKEIKLEKTNVALSTKDVTDLKVKAPVLDQYGKEFTAPVTVKVLDKDGKELKEQKLEAKYVNKELVLNAAGQEAGNYTVVLTAKSGEKEAKATLALELKAPGAFSKFEVRGLEKELDKYVTEENQKNAMTVSVLPVDANGLVLKGAEAAELKVTTTNKEGKEVDATDAQVTVQNNSVITVGQGAKAGETYKVTVVLDGKLITTHSFKVVDTAPTAKGLAVEFTSTSLKEVAPNADLKAALLNILSVDGVPATTAKATVSNVEFVSADTNVVAENGTVGAKGATSIYVKNLTVVKDGKEQKVEFDKAVQVAVSIKEAKPATK

SEQ ID NO: 26084 - protein, 862 aa, Bacillus anthracis
MAKTNSYKKVIAGTMTAAMVAGIVSPVAAAGKSFPDVPAGHWAEGSINYLVDKGAITGKPDGTYGPTESIDRASAAVIFTKILNLPVDENAQPSFKDAKNIWSSKYIAAVEKAGVVKGDGKENFYPEGKIDRASFASMLVSAYNLKDKVNGELVTTFEDLLDHWGEEKANILINLGISVGTGGKWEPNKSVSRAEAAQFIALTDKKYGKKDNAQAYVTDVKVSEPTKLTLTGTGLDKLSADDVTLEGDKAVAIEASTDGTSAVVTLGGKVAPNKDLTVKVKNQSFVTKFVYEVKKLAVEKLTFDDDRAGQAIAFKLNDEKGNADVEYLNLANHDVKFVANNLDGSPANIFEGGEATSTTGKLAVGIKQGDYKVEVQVTKRGGLTVSNTGIITVKNLDTPASAIKNVVFALDADNDGVVNYGSKLSGKDFALNSQNLVVGEKASLNKLVATIAGEDKVVDPGSISIKSSNHGIISVVNNYITAEAAGEATLTIKVGDVTKDVKFKVTTDSRKLVSVKANPDKLQVVQNKTLPVTFVTTDQYGDPFGANTAAIKEVLPKTGVVAEGGLDVVTTDSGSIGTKTIGVTGNDVGEGTVHFQNGNGATLGSLYVNVTEGNVAFKNFELVSKVGQYGQSPDTKLDLNVSTTVEYQLSKYTSDRVYSDPENLEGYEVESKNLAVADAKIVGNKVVVTGKTPGKVDIHLTKNGATAGKATVEIVQETIAIKSVNFKPVQTENFVEKKINIGTVLELEKSNLDDIVKGINLTKETQHKVRVVKSGAEQGKLYLDRNGDAVFNAGDVKLGDVTVSQTSDSALPNFKADLYDTLTTKYTDKGTLVFKVLKDKDVITSEIGSQAVHVNVLNNPNL

SEQ ID NO: 26085 - protein, 735 aa, Bacillus anthracis
EVKQENRLLNESESSSQGLLGYYFSDLNFQAPMVVTSSTTGDLSIPSSELENIPSENQYFQSAIWSGFIKVKKSDEYTFATSADNHVTMWVDDQEVINKASNSNKIRLEKGRLYQIKIQYQREDPTEKGLDFKLYWTDSQNKKEVISSDNLQLPELKQKSSNSKKRRSTSAGPTVPDRDNDGIPDSLEVEGYTVDVKNKRTFLSPWISNIHEKKGLTKYKSSPEKWSTASDPYSDFEKVTGRIDKNVSPEARHPLVAAYPIVHVDMENIILSKNEDQSTQNTDSQTRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNEPNGNLQYQGKDITEFDFNFDQQTSQNIKNQLAELNATNIYTVLDKIKLNAKMNILIRDKRFHYDRNNIAVGADESVVKEAHREVINSSTEGLLLNIDKDIRKILSGYIVEIEDTEGLKEVINDRYDMLNISSLQQDGKTFIDFKKYNDKLPLYISNPNYKVNVYAVTKENTIINPSENGDTSTNGIKRILIFSKKGYEIG

SEQ ID NO: 26086 - protein, 561 aa, Bacillus anthracis
VPDRDNDGIPDSLEVEGYTVDVKNKRTFLSPWISNIHEKKGLTKYKSSPEKWSTASDPYSDFEKVTGRIDKNVSPEARHPLVAAYPIVHVDMENIILSKNEDQSTQNTDSQTRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNEPNGNLQYQGKDITEFDFNFDQQTSQNIKNQLAELNATNIYTVLDKIKLNAKMNILIRDKRFHYDRNNIAVGADESVVKEAHREVINSSTEGLLLNIDKDIRKILSGYIVEIEDTEGLKEVINDRYDMLNISSLRQDGKTFIDFKKYNDKLPLYISNPNYKVNVYAVTKENTIINPSENGDTSTNGIKKILIFSKKGYEIG

SEQ ID NO: 26087 - protein, 800 aa, Bacillus anthracis
MTRNKFIPNKFSIISFSVLLFAISSSQAIEVNAMNEHYTESDIKRNHKTEKNKTEKEKFKDSINNLVKTEFTNETLDKIQQTQGLLKKIPKDVLEIYSELGGEIYFTDIDLVEHKELQDLSEEEKNSMNSRGEKVPFASRFVFEKKRETPKLIINIKDYAINSEQSKEVYYEIGKGISLDIISKDKSLDPEFLNLIKSLSDDSDSSDLLFSQKFKEKLELNNKSIDINFIKENLTEFQHAFSLAFSYYFAPDHRTVLELYAPDMFEYMNKLEKGGFEKISESLKKEGVEKDRIDVLKGEKALKASGLVPEHADAFKKIARELNTYILFRPVNKLATNLIKSGVATKGLNVHVKSSDWGPVAGYIPFDQDLSKKHGQQLAVEKGNLENKKSITEHEGEIGKIPLKLDHLRIEELKENGIILKGKKEIDNGKKYYLLESNNQVYEFRISDENNEVQYKTKEGKITVLGEKFNWRNIEVMAKNVEGVLKPLTADYDLFALAPSLTEIKKQIPQKEWDKVVNTPNSLEKQKGVTNLLIKYGIERKPDSTKGTLSNWQKQMLDRLNEAVKYTGYTGGDVVNHGTEQDNEEFPEKDNEIFIINPEGEFILTKNWEMTGRFIEKNITGKDYLYYFNRSYNKIAPGNKAYIEWTDPITKAKINTIPTSAEFIKNLSSIRRSSNVGVYKDSGDKDEFAKKESVKKIAGYLSDYYNSANHIFSQEKKRKISIFRGIQAYNEIENVLKSKQIAPEYKNYFQYLKERITNQVQLLLTHQKSNIEFKLLYKQLNFTENETDNFEVFQKIIDEK

SEQ ID NO: 26088 - protein, 809 aa, Bacillus anthracis; identical to SEQ ID NO: 26081

SEQ ID NO: 26089 - protein, 764 aa, Bacillus anthracis; identical to SEQ ID NO: 26080

SEQ ID NO: 26090 - protein, 252 aa, Bacillus anthracis
MKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSY

SEQ ID NO: 26091 - protein, 736 aa, Bacillus anthracis
MEVKQENRLLNESESSSQGLLGYYFSDLNFQAPMVVTSSTTGDLSIPSSELENIPSENQYFQSAIWSGFIKVKKSDEYTFATSADNHVTMWVDDQEVINKASNSNKIRLEKGRLYQIKIQYQRENPTEKGLDFKLYWTDSQNKKEVISSDNLQLPELKQKSSNSRKKRSTSAGPTVPDRDNDGIPDSLEVEGYTVDVKNKRTFLSPWISNIHEKKGLTKYKSSPEKWSTASDPYSDFEKVTGRIDKNVSPEARHPLVAAYPIVHVDMENIILSKNEDQSTQNTDSQTRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNEPNGNLQYQGKDITEFDFNFDQQTSQNIKNQLAELNATNIYTVLDKIKLNAKMNILIRDKRFHYDRNNIAVGADESVVKEAHREVINSSTEGLLLNIDKDIRKILSGYIVEIEDTEGLKEVINDRYDMLNISSLRQDGKTFIDFKKYNDKLPLYISNPNYKVNVYAVTKENTIINPSENGDTSTNGIKKILIFSKKGYEIG

SEQ ID NO: 26092 - protein, 882 aa, Bacillus anthracis
MRMVKLSLLAYALAIINLSKYYDKNTSPIKFTITESQTTSATVTAKNSLTKGGIELTKVNAADEKETLEGAVFKIVNRDTNEDARTNLVTNSEGKLVVDDLRPGNYKLIETKAPTYYDVNVEPIEFTIEKGQQTLLPLTFKNSLTKGKVKLIKEDDVESSIALAGAVFTLQDANGTEIAKDLKTDEHGVLVIPDLAPGDYQFIETAAPEHYKLDQTPIKFTIERSQTKHVFVTATNSLTKGSVELIKVDDVEENTTLEGAVFKIVNKDGHDVRTDLTTDKNGRLVVDELPPGDYEFIETKAPTHYDLNETPIKFTVKKGQEKIASVTATNSLTKGAVELSKVDDIDGSTLKDAVFKIVDMNGNDVRTDLTTNKDGKISVSDLRPGDYQFVETKAPTHYDLNQTPINFTVEKSQTATASVTAKNSLTKGAVELTKVDDIDGTTLEGAIFKIVDQNGNDVRTDLTTDKDGKISVSDLRPGDYQFVETKAPTHYDLNQTPINFTVEKSQTATASVTATNSLTKGAVELTKVDDIDGATLEGAVFKIVDMNGNDVRTDLTTDKDGKISVSDLRPGDYQFIETKAPKHYDLNQNPINFTVEKSQTATASVTATNSLTKGAVELMKVDDIDGTTLEGAIFKIVDSNGHDVRADLTTDKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPKTQTNKQQDDRNTGKELPNTGHKNDSTQTVGIILLLAGLLSVLATKRKKYY

SEQ ID NO: 26093 - protein, 647 aa, Bacillus anthracis
MVKVVEGNGGKSKIKSPLNSNFKILSDLVGPTFPPVPTGMTGITGSTGATGNTGPTGETGATGSAGITGSTGPTGNTGGTGSTGPTGNTGATGSTGVTGSTGVTGSTGVTGSTGVTGSTGPTGETGGTGSTGVTGSTGATGSTGVTGNTGPTGSTGATGNTGSIGETGGTGSMGPTGETGVTGSTGGTGSTGVTGNTGPTGSTGVTGSTGVTGSTGPTGSTGVTGSTGPTGSTGVTGSTGVTGNMGPTGSTGVTGNTGSTGTTGATGETGPMGSTGATGTTGPTGETGETGETGGTGSTGPTGNTGATGSTGVTGSTGVTGSTGVTGETGPTGSTGATGNTGPTGETGGTGSTGATGSTGVTGNTGPTGSTGVTGNTGATGETGPTGNTGATGNTGPTGETGVTGSTGPTGETGVTGSTGPTGNTGATGETGATGSTGVTGNTGSTGETGPTGSTGPTGSTGATGVTGNTGPTGSTGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26094 - protein, 780 aa, Bacillus anthracis
MKKSKKMLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTIPPTGEGDNGENPTTPPTGEGNNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 26095 - protein, 240 aa, Bacillus anthracis
MTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKAPEEQMIGINNVNNQLNKGKGKLSFSMNGNQLKATSSNAGYGISYEDKN

SEQ ID NO: 26096 - protein, 87 aa, Bacillus anthracis
MKKAKGIAKSVAVASVIMSGSLGLQATSAFADSKGTVENLQNGGKVYNSFKTTYDMKQNIKNSIKVSFIEDPYADKKLQLLPLMVVI

SEQ ID NO: 26097 - protein, 378 aa, Bacillus anthracis
MHNVLLLDTFSFGLIRTEIVKDLKKVKSHNRVFDLFITIHMEVWNVKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 26098 - protein, 148 aa, Bacillus anthracis
MKKKLLPICAIALLTVGYSSVASADTGTVTKEEATQLQQDKAKKEAAIKEQQKIEEEKKRIAQEQLKNDMAKKEEAIKAQQKSEEGKKEAAQVQPKNAATKKEVAKPAVQGEKLPNTASNNVAMMALSACLVGIGTLFGLKRRNKVKA

SEQ ID NO: 26099 - protein, 469 aa, Bacillus anthracis
MEGNGGKSKIKSPLNSNFKILSDLVGPTFPPVPTGMTGITGSTGATGNTGPTGETGATGSAGITGSTGPTGNTGGTGSTGSTGNTGATGSTGVTGSTGVTGSTGVTGSTGVTGSTGPTGETGGTGSTGVTGSTGATGSTGVTGSTGVTGETGPTGSTGATGNTGPTGETGGTGSTGATGSTGVTGNTGPTGSTGVTGNTGATGETGPTGNTGATGNTGPTGETGVTGSTGPTGETGVTGSTGPTGNTGATGETGATGSTGVTGNTGSTGETGPTGSTGPTGSTGATGVTGNTGPTGSTGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26100 - protein, 774 aa, Bacillus anthracis
MLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTIPPTGEGDNGENPTTPPTGEGNNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 26101 - protein, 960 aa, Bacillus anthracis
MNKNLKFTQMMIGISTMALSFGSIQTHVSAEETASYNILQMKPIGTETSKDEIVHATKADETLTFEERLKVGDFSQRPTLVMERDEIQLKQSYTLAELNKMPNSELIDTLSKISWNQITDLFQFNQDTKAFYQNKERMNVIINELGQRGRTFTKENSKGIETFVEVLRSAFYVGYYNNELSYLKERSFHEKCLPALKAIAKNPNFTLGTAEQDRVVAAYGKLIGNASSDTETVQYAVNVLKQYNDNLTTYVSDYAKGQAVYEIVKGIDYDIQSYLQDTNKQPNETMWYGKIDNFINEVNRIALVGNITNENSWLINNGIYYAGRLGKFHSNPYKGLEVITQAMSLYPRLSGPYFVAVEQIKTNYGGKDYSGKAVDLQKIREEGKRQYLPKTYTFDDGSIVFKTGDKVTEEKIKRLYWAAKEVKAQYHRVIGNDKALEPGNADDVLTIVIYNNPDEYQLNRQLYGYETNNGGIYIEEKRTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFDTFDKLQDLIRVNDVKNYDSYRESLSNNTQLNAEYQAYMQQLIDNQDKYNVPQVTNDYLIQHAPKPLAEVKNEIVDVANIKDAKITKYESQFFNTFTVEGKYTGGTSKGESEDWKTMSKQVNRTLEQLSQKGWSGYKTVTAYFVNYRVNAANQFEYDIVFHGVATEEKEKTNTIVNMNGPYSGIVNEEIQFHSDGTKSENGKVTSYLWNFGDGTTSTEANPTHVYEEKGTYTVELTVKDRRGKESKEQTKVTVKQDPQTGEFHEEEKVLLFNTLVKGNLVTPDQTDVYTFDVTDTKEVDISVVNEQNIGMTWVLYHESDMQNYVACGEDEGNVIKGKFEAKPGKYYLNVYKFDDKNGEYSLLVK

SEQ ID NO: 26102 - protein, 372 aa, Bacillus anthracis
MKTKQTIAASTLALAMIAGANSAHAEVNDATPQQSTGDRLAEIKQHKQGLDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKSNLDSLSANLELAKQDVKNKLAALQEARQDLINKINEIKQSKQTVSDDLSKKKQDLDIKINDFKHTEKKIDDKLAEIHTTKQNIDNKINEVSQSKQTETKTGTTNANNNARELPNAGSKQSNNMALGMLSVLGGILLVTRNKIKTLFSK

SEQ ID NO: 26103 - protein, 455 aa, Bacillus anthracis
MNNRLLKQLQNMKMNKKSLGAVALTAGIIGTTLIPQNTYAHGFVEKPGSRSALCSPTYGALNVNCGSVMYEPQSLEAPKGFPQGGPVDGQIASAGGKFGGILDQQTADRWFKNTITGGENTFTWKYTAPHLTSKWHYYITKKGWNPNKALTRADFEPIGTVQHDGSAASNHLTHKINVPTDRSGYHVILAVWDVADTANAFYNVIDVTLINDVKPDTEAPSIPNGIQAQKVTANSIELAWTASTDNVGVKGYQIFRNGEMIDTVPGTHFIDKKLQPSTEYSYTVKAIDAAGNASKESAKLTVKTTVEAPDTEAPTQPKGLHSMGTTTSSVDLMWSPSDDNIGVGHYDIYRETEGSMKKIATSNTTSYMDKNLLPNTTYKYVVKAVDVAGNESVQSDIFTITTKTEGVSYEEWDAKKAYEKGDKVLHEGKVYEAVQSYKGNGDPNWIYALSLWKTV

SEQ ID NO: 26104 - protein, 503 aa, Bacillus anthracis
MFNKKMVAMAMTVPLVMGTLSTVSAVETKKQVKVEAYSPQKKAIEYLKGNANQYGLKPDLSDLQYISTTETPVASYVRFQQVVNGAPVFSNQITVTLNGEGKGVLAVSDYQPIKAVKQVTEKISEKDAIQKSMAYVGEASEQNLWAPTEKEFGYIIEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAAAYSSSDPTCLRRLDTNKVYPKDMKNQVHADGEIWSQGQYEMAQAFGRDVATKIILQSHWSLTPNSKFSDGAKAIKQADALLYGGQHAADIDRIWAARGISTN

SEQ ID NO: 26105 - protein, 338 aa, Bacillus anthracis
MEVWNVKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 26106 - protein, 431 aa, Bacillus anthracis
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 26107 - protein, 971 aa, Bacillus anthracis
MKGYSKKVLVGVSFASLMLGSFQGGALAEGTKGEQASYRNVLKMEPVGVQLPVQELAHSSKVLENKSFEKRLQFADLSQRPPELKKESKQLATAKTYTIAELNQLSNQQLVDLLVTIDWEQITGLFQFNKDSLAFYQNDSRIQAIIDKLKQQGQDYTKDDSKGIETLVEVLRSGFYLGFYHTELSKLNERSYHDKCLPALKTIANNANFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGMNTEEGAVNKAPVAVINGPYSGNVNEAISFKSDGSKDEDGKIVAYKWEFGDGTVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 26108 - protein, 965 aa, Bacillus anthracis
MNKKSKINKVMLSISTMALSLGAIQTHVSAEEKVPYNVLHSKPVGIEKPVDEIGHVSKAEETLSFQERLKVGDFSQRPASITNKVTVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTTEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQHLIDNQDKYNVPEVADDYLAEHTPKSLTAVEKEITETLPMKDAKMTKHSSQFFNTFTLEGTYTGSVTKGDSEDWNAMSKKVNEALEQLAQKEWSGYKTVTAYFVNYGVNSSNQFEYDVVFHGIAKDDEENKAPTVNINGPYNGLVKEGIQFKSDGSKDEDGKIVSYLWDFGDGSTSAEVNPVHVYESEGSYKVALIVKDDKGKESKSEITVTVKGGSLTESEPNNRPEEANRIGLNTTIKGSLIGGDHTDVYTFNVASAKNIDISVLNEYGIGMTWVLHHESDMQNYAAYGQANGNHIEANFNAKPGKYYLYVYKYDNGDGTYELSVK

SEQ ID NO: 26109 - protein, 531 aa, Bacillus anthracis
MNTKGIIAKLTAGALIANLLICPANTLAEKKTFTDVPNWAQQSVNYLMKKALDGKPDGTFSPSEKIDRGSAAKLMAMVLGLQINKQAKPSFQDAKNHWASPYIAAVEKAGVIYGDGSGNFNPSKDIDRASMASMLVEAYKLNNRIIGDLPTQFEDLKGHWGAKLANALVALGISKGTGDGWKPNGIVTRAEAVQFIAQTDMKKADTSKRMYMNRHFITYHQPSLSSGVTSNQHAPQIIVVKEQRADGWIKIVTNIGDKWTPLYEKRETIHSTFTTYPEASHSSKVLGTHSPQTVTVIEEKGSWIRIRTNAGFQWLDKNQLTLPKKQNNFLEGKTIIIDPGHGGIDGGHKGIYMNESPVVYDTAVRVQKLFAQKTPFTALLTRDAYSRPGKNATDSLGKRVEFAKKNKGDIFVSIHANGFNGNAHGTETFYYKAPTQKSNPYVNDSRILAEKIQKRLITALQTRDRGVKIGNLYVLRENTMPSVLTELGFVDNKADGKKLDSPEWRQRAAEAIYAGILDYYEWKGHNMSAYY

SEQ ID NO: 26110 - protein, 965 aa, Bacillus anthracis; identical to SEQ ID NO: 26108
  strain A0248

SEQ ID NO: 26111 - protein, 431 aa, Bacillus anthracis; identical to SEQ ID NO: 26106
  strain A0248

SEQ ID NO: 26112 - protein, 333 aa, Bacillus anthracis
  strain A0248
MKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 26113 - protein, 372 aa, Bacillus anthracis; identical to SEQ ID NO: 26102
  strain A0248

SEQ ID NO: 26114 - protein, 960 aa, Bacillus anthracis; identical to SEQ ID NO: 26101
  strain A0248

SEQ ID NO: 26115 - protein, 971 aa, Bacillus anthracis; identical to SEQ ID NO: 26107
  strain A0248

SEQ ID NO: 26116 - protein, 780 aa, Bacillus anthracis; identical to SEQ ID NO: 26094
  strain A0248

SEQ ID NO: 26117 - protein, 503 aa, Bacillus anthracis; identical to SEQ ID NO: 26104
  strain A0248

SEQ ID NO: 26118 - protein, 469 aa, Bacillus anthracis; identical to SEQ ID NO: 26099
  strain A0248

SEQ ID NO: 26119 - protein, 148 aa, Bacillus anthracis; identical to SEQ ID NO: 26098
  strain A0248

SEQ ID NO: 26120 - protein, 455 aa, Bacillus anthracis; identical to SEQ ID NO: 26103
  strain A0248

SEQ ID NO: 26121 - protein, 800 aa, Bacillus anthracis; identical to SEQ ID NO: 26082
  strain A0248

SEQ ID NO: 26122 - protein, 764 aa, Bacillus anthracis; identical to SEQ ID NO: 26080
  strain A0248

SEQ ID NO: 26123 - protein, 809 aa, Bacillus anthracis; identical to SEQ ID NO: 26081
  strain A0248

SEQ ID NO: 26124 - protein, 309 aa, Bacillus anthracis
  strain CDC 684 / NRRL 3495
MSSWRNNINGYCSCNNQNGVHVDSCCFSCDGTVPKLGPTGPTGATGATGATGVTGVTGVTGATGITGATGITGATGITGVTGPTGATGITGATGPTGATGPTGATGITGATGATGATGATGVTGVTGATGITGATGITGVTGPTGATGITGATGPTGATGITGATGPTGVTGTSITATYAFANNTSGTAISVLLGGTNVPLPNNQNIGPGITVSGGNTVFTVANAGNYYISYTINITASLLVSSRITINGAPLAGTINSPAVATTSFSATIITTLAAGSAISLQLFGLLAVATLSTTTPGAVLTIIRLS

SEQ ID NO: 26125 - protein, 763 aa, Bacillus anthracis
  strain CDC 684 / NRRL 3495
MEGNGGKSKIKSPLNSNFKILSDLVGPTFPPVPTGMTGITGSTGATGNTGPTGETGATGSAGITGSTGPTGNTGGTGSTGPTGNTGATGSTGVTGSTGVTGSTGVTGSTGVTGSTGPTGETGGTGSTGVTGSTGATGSTGVTGNTGPTGSTGATGNTGSIGETGGTGSMGPTGETGVTGSTGGTGSTGVTGNTGPTGSTGVTGSTGVTGSTGPTGSTGVTGSTGPTGSTGVTGSTGVTGNMGPTGSTGVTGNTGSTGTTGATGETGPMGSTGATGTTGPTGETGETGETGGTGSTGPTGNTGATGSTGVTGSTGVTGSTGVTGETGPTGSTGATGNTGPTGETGGTGSTGATGSTGVTGNTGPTGSTGVTGNTGPTGSTGATGNTGPIGETGGTGSTGPTGETGGTGSTGVTGSTGVTGNTGATGETGPTGSTGATGNTGPTGSTGVTGNTGPIGSTGATGETGPTGSMGATGNTGATGETGPTGSTGVTGNTGATGETGPTGNTGATGNTGPTGETGVTGSTGPTGETGVTGSTGPTGNTGATGETGATGSTGVTGNTGSTGETGPTGSTGPTGSTGATGVTGNTGPTGSTGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26126 - protein, 971 aa, Bacillus anthracis; identical to SEQ ID NO: 26107
  strain CDC 684 / NRRL 3495

SEQ ID NO: 26127 - protein, 148 aa, Bacillus anthracis; identical to SEQ ID NO: 26098
  strain CDC 684 / NRRL 3495

SEQ ID NO: 26128 - protein, 960 aa, Bacillus anthracis; identical to SEQ ID NO: 26101
  strain CDC 684 / NRRL 3495

SEQ ID NO: 26129 - protein, 372 aa, Bacillus anthracis
  strain CDC 684 / NRRL 3495
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKSNLDSLSANLELAKQDVKNKLAALQEARQDLINKINEIKQSKQTVSDDLSKKKQDLDIKINDFKHTEKKIDDKLAEIHTTKQNIDNKINEVSQSKQTETKTGTTNANNNARELPNAGSKQSNNMALGMLSVLGGILLVTRNKIKTLFSK

SEQ ID NO: 26130 - protein, 431 aa, Bacillus anthracis; identical to SEQ ID NO: 26106
  strain CDC 684 / NRRL 3495

SEQ ID NO: 26131 - protein, 824 aa, Bacillus anthracis
  strain CDC 684 / NRRL 3495
MNAADEKETLEGAVFKIVNRDTNEDARTNLVTNSEGKLVVDDLRPGNYKLIETKAPTYYDVNVEPIEFTIEKGQQTLLPLTFKNSLTKGKVKLIKEDDVESSIALAGAVFTLQDANGTEIAKDLKTDEHGVLVIPDLAPGDYQFIETAAPEHYKLDQTPIKFTIERSQTKHVFVTATNSLTKGSVELIKVDDVEENTTLEGAVFKIVNKDGHDVRTDLTTDKNGRLVVDELPPGDYEFIETKAPTHYDLNETPIKFTVKKGQEKIASVTATNSLTKGAVELSKVDDIDGSTLKDAVFKIVDMNGNDVRTDLTTNKDGKISVSDLRPGDYQFVETKAPTHYDLNQTPINFTVEKSQTATASVTAKNSLTKGAVELTKVDDIDGTTLEGAIFKIVDQNGNDVRTDLTTDKDGKISVSDLRPGDYQFVETKAPTHYDLNQTPINFTVEKSQTATASVTATNSLTKGAVELTKVDDIDGATLEGAVFKIVDMNGNDVRTDLTTDKDGKISVSDLRPGDYQFIETKAPKHYDLNQNPINFTVEKSQTATASVTATNSLTKGAVELMKVDDIDGTTLEGAIFKIVDSNGHDVRADLTTDKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPKTQTNKQQDDRNTGKELPNTGHKNDSTQTVGIILLLAGLLSVLATKRKKYY

SEQ ID NO: 26132 - protein, 269 aa, Bacillus anthracis
  strain CDC 684 / NRRL 3495
MILAVWDVADTANAFYNVIDVTLINDVKPDTEAPSIPNGIQAQKVTANSIELAWTASTDNVGVKGYQIFRNGEMIDTVPGTHFIDKKLQPSTEYSYTVKAIDAAGNASKESAKLTVKTTVEAPDTEAPTQPKGLHSMGTTTSSVDLMWSPSDDNIGVGHYDIYRETEGSMKKIATSNTTSYMDKNLLPNTTYKYVVKAVDVAGNESVQSDIFTITTKTEGVSYEEWDAKKAYEKGDKVLHEGKVYEAVQSYKGNGDPNWIYALSLWKTV

SEQ ID NO: 26133 - protein, 333 aa, Bacillus anthracis; identical to SEQ ID NO: 26112
  strain CDC 684 / NRRL 3495

SEQ ID NO: 26134 - protein, 965 aa, Bacillus anthracis; identical to SEQ ID NO: 26108
  strain CDC 684 / NRRL 3495

SEQ ID NO: 26135 - protein, 240 aa, Bacillus anthracis; identical to SEQ ID NO: 26095
  strain CDC 684 / NRRL 3495

SEQ ID NO: 26136 - protein, 87 aa, Bacillus anthracis; identical to SEQ ID NO: 26096
  strain CDC 684 / NRRL 3495

SEQ ID NO: 26137 - protein, 774 aa, Bacillus anthracis; identical to SEQ ID NO: 26100
  strain CDC 684 / NRRL 3495

SEQ ID NO: 26138 - protein, 503 aa, Bacillus anthracis; identical to SEQ ID NO: 26104
  strain CDC 684 / NRRL 3495

SEQ ID NO: 26139 - protein, 800 aa, Bacillus anthracis; identical to SEQ ID NO: 26082
  strain CDC 684 / NRRL 3495

SEQ ID NO: 26140 - protein, 764 aa, Bacillus anthracis
  strain CDC 684 / NRRL 3495
MKKRKVLIPLMALSTILVSSTGNLEVIQAEVKQENRLLNESESSSQGLLGYYFSDLNFQAPMVVTSSTTGDLSIPSSELENIPSENQYFQSAIWSGFIKVKKSDEYTFATSADNHVTMWVDDQEVINKASNSNKIRLEKGRLYQIKIQYQRENPTEKGLDFKLYWTDSQNKKEVISSDNLQLPELKQKSSNSRKKRSTSAGPTVPDRDNDGIPDSLEVEGYTVDVKNKRTFLSPWISNIHEKKGLTKYKSSPEKWSTASDPYSDFEKVTGRIDKNVSPEARHPLVAAYPIVHVDMENIILSKNEDQSTQNTDSQTRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNESNGNLQYQGKDITEFDFNFDQQTSQNIKNQLAELNVTNIYTVLDKIKLNAKMNILIRDKRFHYDRNNIAVGADESVVKEAHREVINSSTEGLLLNIDKDIRKILSGYIVEIEDTEGLKEVINDRYDMLNISSLRQDGKTFIDFKKYNDKLPLYISNPNYKVNVYAVTKENTIINPSENGDTSTNGIKKILIFSKKGYEIG

SEQ ID NO: 26141 - protein, 809 aa, Bacillus anthracis; identical to SEQ ID NO: 26081
  strain CDC 684 / NRRL 3495

SEQ ID NO: 26142 - protein, 455 aa, Bacillus anthracis str. A0174; identical to SEQ ID NO: 26103

SEQ ID NO: 26143 - protein, 960 aa, Bacillus anthracis str. A0174; identical to SEQ ID NO: 26101

SEQ ID NO: 26144 - protein, 503 aa, Bacillus anthracis str. A0174; identical to SEQ ID NO: 26104

SEQ ID NO: 26145 - protein, 763 aa, Bacillus anthracis str. A0174; identical to SEQ ID NO: 26125

SEQ ID NO: 26146 - protein, 148 aa, Bacillus anthracis str. A0174; identical to SEQ ID NO: 26098

SEQ ID NO: 26147 - protein, 780 aa, Bacillus anthracis str. A0174; identical to SEQ ID NO: 26094

SEQ ID NO: 26148 - protein, 333 aa, Bacillus anthracis str. A0174; identical to SEQ ID NO: 26112

SEQ ID NO: 26149 - protein, 431 aa, Bacillus anthracis str. A0174; identical to SEQ ID NO: 26106

SEQ ID NO: 26150 - protein, 324 aa, Bacillus anthracis str. A0174
MSSWRNNINGYCSCNNQNGVHVDSCCFSCDGTVPKLGPTGPTGATGATGATGVTGVTGVTGATGITGATGITGATGITGVTGPTGATGITGATGATGPTGATGPTGATGITGATGATGATGATGVTGVTGATGITGATGITGVTGPTGATGITGATGPTGATGITGATGPTGATGITGATGPTGVTGTSITATYAFANNTSGTAISVLLGGTNVPLPNNQNIGPGITVSGGNTVFTVANAGNYYISYTINITASLLVSSRITINGAPLAGTINSPAVATTSFSATIITTLAAGSAISLQLFGLLAVATLSTTTPGAVLTIIRLS

SEQ ID NO: 26151 - protein, 965 aa, Bacillus anthracis str. A0174; identical to SEQ ID NO: 26108

SEQ ID NO: 26152 - protein, 971 aa, Bacillus anthracis str. A0174; identical to SEQ ID NO: 26107

SEQ ID NO: 26153 - protein, 800 aa, Bacillus anthracis str. A0174
MTRNKFIPNKFSIISFSVLLFAISSSQAIEVNAMNEHYTESDIKRNHKTEKNKTEKEKFKDSINNLVKTEFTNETLDKIQQTQDLLKKIPKDVLEIYSELGGEIYFTDIDLVEHKELQDLSEEEKNSMNSRGEKVPFASRFVFEKKRETPKLIINIKDYAINSEQSKEVYYEIGKGISLDIISKDKSLDPEFLNLIKSLSDDSDSSDLLFSQKFKEKLELNNKSIDINFIKENLTEFQHAFSLAFSYYFAPDHRTVLELYAPDMFEYMNKLEKGGFEKISESLKKEGVEKDRIDVLKGEKALKASGLVPEHADAFKKIARELNTYILFRPVNKLATNLIKSGVATKGLNVHGKSSDWGPVAGYIPFDQDLSKKHGQQLAVEKGNLENKKSITEHEGEIGKIPLKLDHLRIEELKENGIILKGKKEIDNGKKYYLLESNNQVYDFRISDENNEVQYKTKEGKITVLGGKFNWRNIEVMAKNVEGVLKPLTADYDLFALAPSLTEIKKQIPQKEWDKVVNTPNSLEKQKGVTNLLIKYGIERKPDSTKGTLSNWQKQMLDRLNEAVKYTGYTGGDVVNHGTEQDNEEFPEKDNEIFIINPEGEFILTKNWEMTGRFIEKNITGKDYLYYFNRSYNKIAPGNKAYIEWTDPITKAKINTIPTSAEFIKNLSSIRRSSNVGVYKDSGDKDEFAKKESVKKIAGYLSDYYNSANHIFSQEKKRKISIFRGIQAYNEIENVLKSKQIAPEYKNYFQYLKERITNQVQLLLTHQKSNIEFKLLYKQLNFTENETDNFEVFQKIIDEK

SEQ ID NO: 26154 - protein, 764 aa, Bacillus anthracis str. A0174
MKKRKVLIPLMALSTILVSSTGNLEVIQAEVKQENRLLNESESSSQGLLGYYFSDLNFQAPMVVTSSTTGDLSIPSSELENIPSENQYFQSAIWSGFIKVKKSDEYTFATSADNHVTMWVDDQEVINKASNSNKIRLEKGRLYQIKIQYQRENPTEKGLDFKLYWTDSQNKKEVISSDNLQLPELKQKSSNSRKKRSTSAGPTVPDRDNDGIPDSLEVEGYTVDVKNKRTFLSPWISNIHEKKGLTKYKSSPEKWSTASDPYSDFEKVTGRIDKNVSPEARHPLVAAYPIVHVDMENIILSKNEDQSTQNTDSQTRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNEPNGNLQYQGKDITEFDFNFDQQTSQNIKNQLAELNVTNIYTVLDKIKLNAKMNILIRDKRFHYDRNNIAVGADESVVKEAHREVINSSTEGLLLNIDKDIRKILSGYIVEIEDTEGLKEVINDRYDMLNISSLRQDGKTFIDFKKYNDKLPLYISNPNYKVNVYAVTKENTIINPSENGDTSTNGIKKILIFSKKGYEIG

SEQ ID NO: 26155 - protein, 809 aa, Bacillus anthracis str. A0174; identical to SEQ ID NO: 26081

SEQ ID NO: 26156 - protein, 960 aa, Bacillus anthracis str. A0193; identical to SEQ ID NO: 26101

SEQ ID NO: 26157 - protein, 971 aa, Bacillus anthracis str. A0193; identical to SEQ ID NO: 26107

SEQ ID NO: 26158 - protein, 455 aa, Bacillus anthracis str. A0193; identical to SEQ ID NO: 26103

SEQ ID NO: 26159 - protein, 763 aa, Bacillus anthracis str. A0193; identical to SEQ ID NO: 26125

SEQ ID NO: 26160 - protein, 148 aa, Bacillus anthracis str. A0193; identical to SEQ ID NO: 26098

SEQ ID NO: 26161 - protein, 780 aa, Bacillus anthracis str. A0193; identical to SEQ ID NO: 26094

SEQ ID NO: 26162 - protein, 965 aa, Bacillus anthracis str. A0193; identical to SEQ ID NO: 26108

SEQ ID NO: 26163 - protein, 333 aa, Bacillus anthracis str. A0193; identical to SEQ ID NO: 26112

SEQ ID NO: 26164 - protein, 503 aa, Bacillus anthracis str. A0193; identical to SEQ ID NO: 26104

SEQ ID NO: 26165 - protein, 431 aa, Bacillus anthracis str. A0193; identical to SEQ ID NO: 26106

SEQ ID NO: 26166 - protein, 809 aa, Bacillus anthracis str. A0193; identical to SEQ ID NO: 26081

SEQ ID NO: 26167 - protein, 764 aa, Bacillus anthracis str. A0193; identical to SEQ ID NO: 26154

SEQ ID NO: 26168 - protein, 800 aa, Bacillus anthracis str. A0193; identical to SEQ ID NO: 26153

SEQ ID NO: 26169 - protein, 455 aa, Bacillus anthracis str. A0389; identical to SEQ ID NO: 26103

SEQ ID NO: 26170 - protein, 960 aa, Bacillus anthracis str. A0389; identical to SEQ ID NO: 26101

SEQ ID NO: 26171 - protein, 643 aa, Bacillus anthracis str. A0389
MEGNGGKSKIKSPLNSNFKILSDLVGPTFPPVPTGMTGITGSTGATGNTGPTGETGATGSAGITGSTGPTGNTGGTGSTGPTGNTGATGSTGVTGSTGVTGSTGVTGSTGVTGSTGPTGETGGTGSTGVTGSTGATGSTGVTGNTGPTGSTGATGNTGSIGETGGTGSMGPTGETGVTGSTGGTGSTGVTGNTGPTGSTGVTGSTGVTGSTGPTGSTGVTGSTGPTGSTGVTGSTGVTGNMGPTGSTGVTGNTGSTGTTGATGETGPMGSTGATGTTGPTGETGETGETGGTGSTGPTGNTGATGSTGVTGSTGVTGSTGVTGETGPTGSTGATGNTGPTGETGGTGSTGATGSTGVTGNTGPTGSTGVTGNTGATGETGPTGNTGATGNTGPTGETGVTGSTGPTGETGVTGSTGPTGNTGATGETGATGSTGVTGNTGSTGETGPTGSTGPTGSTGATGVTGNTGPTGSTGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26172 - protein, 148 aa, Bacillus anthracis str. A0389; identical to SEQ ID NO: 26098

SEQ ID NO: 26173 - protein, 780 aa, Bacillus anthracis str. A0389; identical to SEQ ID NO: 26094

SEQ ID NO: 26174 - protein, 431 aa, Bacillus anthracis str. A0389; identical to SEQ ID NO: 26106

SEQ ID NO: 26175 - protein, 965 aa, Bacillus anthracis str. A0389; identical to SEQ ID NO: 26108

SEQ ID NO: 26176 - protein, 503 aa, Bacillus anthracis str. A0389; identical to SEQ ID NO: 26104

SEQ ID NO: 26177 - protein, 971 aa, Bacillus anthracis str. A0389; identical to SEQ ID NO: 26107

SEQ ID NO: 26178 - protein, 333 aa, Bacillus anthracis str. A0389; identical to SEQ ID NO: 26112

SEQ ID NO: 26179 - protein, 800 aa, Bacillus anthracis str. A0389; identical to SEQ ID NO: 26082

SEQ ID NO: 26180 - protein, 764 aa, Bacillus anthracis str. A0389; identical to SEQ ID NO: 26080

SEQ ID NO: 26181 - protein, 809 aa, Bacillus anthracis str. A0389; identical to SEQ ID NO: 26081

SEQ ID NO: 26182 - protein, 455 aa, Bacillus anthracis str. A0442; identical to SEQ ID NO: 26103

SEQ ID NO: 26183 - protein, 960 aa, Bacillus anthracis str. A0442; identical to SEQ ID NO: 26101

SEQ ID NO: 26184 - protein, 971 aa, Bacillus anthracis str. A0442
MKGYSKKVLVGVSFASLMLGSFQGGALAEGTKGEQASYRNVLKMEPVGVQLPVQELAHSSKVLENKSFEKRLQFADLSQRPPELKKESKQLATAKTYTIAELNQLSNQQLVDLLVTIDWEQITGLFQFNKDSLAFYQNDSRIQAIIDKLKQQGQDYTKDDSKGIETLVEVLRSGFYLGFYHTELSKLNERSYHDKCLPALKTIANNANFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGMNTEEGAVNKAPVAVINGPYSGNVNEAISFKSDGSKDEDGKIVAYKWEFGDGTVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYLGKYYLHVYQYGGGFGNYTVEVK

SEQ ID NO: 26185 - protein, 503 aa, Bacillus anthracis str. A0442; identical to SEQ ID NO: 26104

SEQ ID NO: 26186 - protein, 780 aa, Bacillus anthracis str. A0442; identical to SEQ ID NO: 26094

SEQ ID NO: 26187 - protein, 553 aa, Bacillus anthracis str. A0442
MEGNGGKSKIKSPLNSNFKILSDLVGPTFPPVPTGMTGITGSTGATGNTGPTGETGETGETGETGGTGSTGPTGNTGATGSTGVTGSTGVTGSTGVTGETGPTGSTGATGNTGPTGETGGTGSTGATGSTGVTGNTGPTGSTGVTGNTGPTGSTGATGNTGPIGETGGTGSTGPTGETGGTGSTGVTGSTGVTGNTGPIGSTGATGETGPTGSTGATGNTGPTGSTGVTGNTGPIGSTGATGETGPTGSMGATGNTGATGETGPTGSTGVTGNTGATGETGPTGNTGATGNTGPTGETGVTGSTGPTGETGVTGSTGPTGNTGATGSTGPTGETGATGSTGVTGNTGSTGETGPTGSTGPTGSTGATGVTGNTGPTGSTGATGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26188 - protein, 148 aa, Bacillus anthracis str. A0442; identical to SEQ ID NO: 26098

SEQ ID NO: 26189 - protein, 1763 aa, Bacillus anthracis str. A0442
MKKSLKCFNVVTIIALLLSITLPSPSAFAEIHKKSWDELQGNDVRIKAEQVNAEIYRGEVAEREHVFQYTIENTGDTPIQELVLKQNNENEITFLSQSMKVNGEKLPENKVADFYVEEKDKGGKLLSSNLKIRDLKSHEKMTVLIKASRTQHFNKEYKQKISVQKDQVQIGSMSFNVEGIPSEDKVEANADDEADSSKEEVGPSPDSTPKKITEKLKVSVEDTNNPTSNTELVKQPVTEAEKQPEKEAAKQSNAEVQAASENASKVQIQVGDKQGFGDPLYSTITAGDLVQTGNVTLGLTDNHYTRQSVGGKTNKKAVDVDNDDTTFNSSTGAFPNIPAGSKVKKAYLFWTAAMGAPSDARIDYRVSDEDVRQPIKMKMGNKQYAEVSADSIRKADYLPYIANHYSSGAGYVAYADVTNVIEKQGISQTVTVANVPQIKFEKGSGYYWGNWNLILVYENYKETVKDMKIWEGLVSQKSTAWANISVNKINTPKEGAFKAKFSYFSSQGDPAENDIYAYDYGEYDFGLGYQKLKNINSKENDVNDSSMTEVQVDGTNEFVTKKYPGYNPDWTNSFSTDIHTYHLEGPNQVKNDLKEAKMRFRANGATGDIYVLNNATFVTEHNAPNLQVDKKALDSAGKEIKEVKAGEEITYKIEVKNDTKNNQAPVSNVKGFDKLDDRLEYVPGSIQYVTGSNAGQKTDDASDDEAEFVNNQIDFRIGEGADAKDGGVLKPGESAVLTFKVKVKESIKSNTTVKNVVAVKGQDSAEIKYESEDDANVTVTIPKEVPGEIEARKIASNKSPKLGDEVEYRITFKNKVKDGRLDVLTIEDQLPSSLEFVKDSLKAEGVQPEPVELKMENGKIIAKYPEITDMEKRSIVFKVKVKDSAKVGEAIVNKAIAKDPKNEPVESDVVITPQSKKGEIAATKVVNNKKPKLGEEIEYRISFHNMVENGKLAEVRVEDTIPKGLEYVENSIKAEGEAPSPVELTVEAGVIKAKYIDITDTKERSIVFKVKVKEEVEVGKEIVNKAIVDDTKHQPIEPEERITPQHKDGIINAAKIVDNPSPKLGEEVEYRISFKNTVENGKLEKVKIEDTIPNGLEYVKGSEKAEGDKPAPVKLHVKDGKVIAEYENITDTKERSIVFKVKVKEEAEIGKEIVNQAIVDDTKDSKKPEAKITPLHKDGKIKAKKSVNNETPKLGEEVEYRISFKNTVENGKLAEVKIEDTLPEGVEYVENSLKAEGAGPNPVELKMENGKVLAKYPEITDIEERSITFKVKVKEEVKAGEKIVNKAIVDDTKHDPINPKAEITPQYKDGKIEAEKVVNNPSPKLEEEVEYRISFKNTVEHGKLAEVIIEDDLPNGLEYVKGSLQAEGSKPNPVELKFENGKVLAKYPEITDTKERSITFKVKVKGNVSDTKHPPETPKAEIIPQHKDGKLEAKKVVNNLLPKLGEEVEYRISFKNTVENGKVAEVKVEDEIPAGLEYVQDSLRFEGAEPNPVELKVEFGKVIAKYLDISDRKERSIIFKAKVKETVETGEKIVNKAIVGDTINQPEEPVVSITPQYKDGMLKAEKEVSNKEPKLGEVVEYRISFKNTVENGKLAEVKIEDQLPDGLEYVKDSVKAKGAIEVKVENGKLTAKYENIIDTKERNITFKVKVKEKAGEEIVNRAIVDDGINQPLEPTVSIKPKEPEVKPEDPKEPEVKPEDPKEPEVKLEKPEVRLEKLIKEPQVKVERELPKTGAASPWMVSVGAGISFLVGGVLFVLGRRRKQ

SEQ ID NO: 26190 - protein, 333 aa, Bacillus anthracis str. A0442; identical to SEQ ID NO: 26112

SEQ ID NO: 26191 - protein, 431 aa, Bacillus anthracis str. A0442; identical to SEQ ID NO: 26106

SEQ ID NO: 26192 - protein, 312 aa, Bacillus anthracis str. A0442
MSSWRNNINGYCSCNNQNGVHVDSCCFSCDGTVPKLGPTGPTGATGATGATGVTGVTGVTGATGITGATGITGATGITGVTGPTGATGITGATGATGPTGATGPTGATGITGATGATGATGATGVTGVTGATGITGATGITGVTGPTGATGITGATGPTGATGITGATGPTGVTGTSITATYAFANNTSGTAISVLLGGTNVPLPNNQNIGPGITVSGGNTVFTVANAGNYYISYTINITASLLVSSRITINGAPLAGTINSPAVATTSFSATIITTLAAGSAISLQLFGLLAVATLSTTTPGAVLTIIRLS

SEQ ID NO: 26193 - protein, 965 aa, Bacillus anthracis str. A0442; identical to SEQ ID NO: 26108

SEQ ID NO: 26194 - protein, 305 aa, Bacillus anthracis str. A0442
MNIKQSFKLLAMFLSVLFVLFPLQKAFAEVMDHTKYQMDWSYSKSKKKPIRTELIKTADGKIAFCLNVDLKSPSGQDLPEMGKVDINVYRVLLNGYPQKSPQELGVSDWREAHYATQLAVWNALKQIDINDLDFRNKNVEKVTKDIVAKASASDELQEITMSVTPTEEQEAVLKNDFFETGLYTVETNAKSGTYKVQATGAPTGAKFVNEKGEAKTEFNVGEKFRILVPKQTPAGGFSFKVIGKLTKLQGIAHKGTPTIQNAVVLLERSEEETSPELSVSWKKGNGHDNNKPHTPNEPHKPNQKR

SEQ ID NO: 26195 - protein, 800 aa, Bacillus anthracis str. A0442
MTRNKFIPNKFSIISFSVLLFAISSSQAIEVNAMNEHYTESDIKRNHKTEKNKTEKEKFKDSINNLVKTEFTNETLDKIQQTQDLLKKIPKDVLEIYSELGGEIYFTDIDLVEHKELQDLSEEEKNSMNSRGEKVPFASRFVFEKKRETPKLIINIKDYAINSEQSKEVYYEIGKGISLGIISKDKSLDPEFLNLIKSLSDDSDSSDLLFSQKFKEKLELNNKSIDINFIKENLTEFQHAFSLAFSYYFAPDHRTVLELYAPDMFEYMNKLEKGGFEKISESLKKEGVEKDRIDVLKGEKALKASGLVPEHADAFKKTARELNTYILFRPVNKLATNLIKSGVATKGLNVHGKSSDWGPVAGYIPFDQDLSKKHGQQLAVEKGNLENKKSITEHEGEIGKIPLKLDHLRIEELKENGIILKGKKEIDNGKKYYLLESNNQVYEFRISDENNEVQYKTKEGKITVLGEKFNWRNIEVMAKNVEGVLKPLTADYDLFALAPSLTEIKKQIPQKEWDKVVNTPNSLEKQKGVTNLLIKYGIERKPDSTKGTLSNWQKQMLDRLNEAVKYTGYTGGDVVNHGTEQDNEEFPEKDNEIFIINPEGEFILTKNWEMTGRFIEKNITGKDYLYYFNRSYNKIAPGNKAYIEWTDPITKAKINTIPTSAEFIKNLSSIRRSSNVGVYKDSGDKDEFAKKESVKKIAGYLSDYYNSANHIFSQEKKRKISIFRGIQAYNEIENVLKSKQIAPEYKNYFQYLKERITNQVQLLLTHQKSNIEFKLLYKQLNFTENETDNFEVFQKIIDEK

SEQ ID NO: 26196 - protein, 764 aa, Bacillus anthracis str. A0442
MKKRKVLIPLMALSTILVSSTGNLEVIQAEVKQENRLLNESESSSQGLLGYYFSDLNFQAPMVVTSSTTGDLSIPSSELENIPSENQYFQSAIWSGFIKVKKSDEYTFATSADNHVTMWVDDQEVINKASNSNKIRLEKGRLYQIKIQYQRENPTEKGLDFKLYWTDSQNKKEVISSDNLQLPELKQKSSNSRKKRSTSAGPTVPDRDNDGIPDSLEVEGYTVDVKNKRTFLSPWISNIHEKKGLTKYKSSPEKWSTASDPYSDFEKVTGRIDKNVSPEARHPLVAAYPIVHVDMENIILSKNEDQSTQNTDSQTRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNEPNGNLQYQGKDITEFDFNFDQQTSKNIKNQLAELNATNIYTVLDKIKLNAKMNILIRDKRFHYDRNNIAVGADESVVKEAHREVINSSTEGLLLNIDKDIRKILSGYIVEIEDTEGLKEVINDRYDMLNISSLRQDGKTFIDFKKYNDKLPLYISNPNYKVNVYAVTKENTIINPSENGDTSTNGIKKILIFSKKGYEIG

SEQ ID NO: 26197 - protein, 809 aa, Bacillus anthracis str. A0442
MNIKKEFIKVISMSCLVTAITLSGPVFIPLVQGAGGHGDVGMHVKEKEKNKDENKRKDEERNKTQEEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEVQEVFAKAFAYYIEPQHRDVLQLYAPEAFNYMDKFNEQEINLSLEELKDQRMLTRYEKWEKIKQHYQHWSDSLSEEGRGLLKKLQIPIEPKKDDIIHSLSQEEKELLKRIQIDSSDFLSTEEKEFLKKLQIDIRDSLSEEEKELLNRIQVDSSNPLSEKEKEFLKKLKLDIQPYDINQRLQDTGGLIDSPSINLDVRKQYKRDIQNIDALLHQSIGSTLYNKIYLYENMNINNLTATLGADLVDSTDNTKINRGIFNEFKKNFKYSISSNYMIVDINERPALDNERLKWRIQLSPDTRAGYLENGKLILQRNIGLEIKDVQIIKQSEKEYIRIDAKVVPKSKIDTKIQEAQLNINQEWNKALGLPKYTKLITFNVHNRYASNIVESAYLILNEWKNNIQSDLIKKVTNYLVDGNGRFVFTDITLPNIAEQYTHQDEIYEQVHSKGLYVPESRSILLHGPSKGVGLRNDSEGFIHEFGHAVDDYAGYLLDKNQSDLVTNSKKFIDIFKEEGSNLTSYGRTNEAEFFAEAFRLMHSTDHAERLKVQKNAPKTFQFINDQIKFIINS

SEQ ID NO: 26198 - protein, 960 aa, Bacillus anthracis str. A0465; identical to SEQ ID NO: 26101

SEQ ID NO: 26199 - protein, 455 aa, Bacillus anthracis str. A0465; identical to SEQ ID NO: 26103

SEQ ID NO: 26200 - protein, 577 aa, Bacillus anthracis str. A0465
MEGNGGKSKIKSPLNSNFKILSDLVGPTFPPVPTGMTGITGSTGATGNTGPTGETGATGETGPMGSTGATGTTGPTGETGETGETGETGGTGSTGPTGNTGATGSTGVTGSTGVTGSTGVTGETGPTGSTGATGNTGPTGETGGTGSTGATGSTGVTGNTGPTGSTGVTGNTGPTGSTGATGNTGPIGETGGTGSTGPTGETGGTGSTGVTGSTGVTGNTGPIGSTGATGETGPTGSTGATGNTGPTGSTGVTGNTGPIGSTGATGETGPTGSMGATGNTGATGETGPTGSTGVTGNTGATGETGPTGNTGATGNTGPTGETGVTGSTGPTGETGVTGSTGPTGNTGATGSTGPTGETGATGSTGVTGNTGSTGETGPTGSTGPTGSTGATGVTGNTGPTGSTGATGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26201 - protein, 148 aa, Bacillus anthracis str. A0465; identical to SEQ ID NO: 26098

SEQ ID NO: 26202 - protein, 503 aa, Bacillus anthracis str. A0465; identical to SEQ ID NO: 26104

SEQ ID NO: 26203 - protein, 780 aa, Bacillus anthracis str. A0465; identical to SEQ ID NO: 26094

SEQ ID NO: 26204 - protein, 431 aa, Bacillus anthracis str. A0465; identical to SEQ ID NO: 26106

SEQ ID NO: 26205 - protein, 303 aa, Bacillus anthracis str. A0465
MSSWRNNINGYCSCNNQNGVHVDSCCFSCDGTVPKLGPTGPTGATGATGATGVTGVTGVTGATGITGATGITGATGITGVTGPTGATGITGATGATGPTGATGPTGATGITGATGATGATGATGATGVTGVTGATGITGATGITGVTGPTGATGITGATGPTGVTGTSITATYAFANNTSGTAISVLLGGTNVPLPNNQNIGPGITVSGGNTVFTVANAGNYYISYTINITASLLVSSRITINGAPLAGTINSPAVATTSFSATIITTLAAGSAISLQLFGLLAVATLSTTTPGAVLTIIRLS

SEQ ID NO: 26206 - protein, 965 aa, Bacillus anthracis str. A0465; identical to SEQ ID NO: 26108

SEQ ID NO: 26207 - protein, 971 aa, Bacillus anthracis str. A0465; identical to SEQ ID NO: 26107

SEQ ID NO: 26208 - protein, 305 aa, Bacillus anthracis str. A0465; identical to SEQ ID NO: 26194

SEQ ID NO: 26209 - protein, 333 aa, Bacillus anthracis str. A0465; identical to SEQ ID NO: 26112

SEQ ID NO: 26210 - protein, 809 aa, Bacillus anthracis str. A0465; identical to SEQ ID NO: 26197

SEQ ID NO: 26211 - protein, 764 aa, Bacillus anthracis str. A0465; identical to SEQ ID NO: 26154

SEQ ID NO: 26212 - protein, 800 aa, Bacillus anthracis str. A0465; identical to SEQ ID NO: 26195

SEQ ID NO: 26213 - protein, 455 aa, Bacillus anthracis str. A0488; identical to SEQ ID NO: 26103

SEQ ID NO: 26214 - protein, 960 aa, Bacillus anthracis str. A0488; identical to SEQ ID NO: 26101

SEQ ID NO: 26215 - protein, 763 aa, Bacillus anthracis str. A0488; identical to SEQ ID NO: 26125

SEQ ID NO: 26216 - protein, 148 aa, Bacillus anthracis str. A0488; identical to SEQ ID NO: 26098

SEQ ID NO: 26217 - protein, 431 aa, Bacillus anthracis str. A0488; identical to SEQ ID NO: 26106

SEQ ID NO: 26218 - protein, 780 aa, Bacillus anthracis str. A0488; identical to SEQ ID NO: 26094

SEQ ID NO: 26219 - protein, 309 aa, Bacillus anthracis str. A0488; identical to SEQ ID NO: 26124

SEQ ID NO: 26220 - protein, 965 aa, Bacillus anthracis str. A0488; identical to SEQ ID NO: 26108

SEQ ID NO: 26221 - protein, 503 aa, Bacillus anthracis str. A0488; identical to SEQ ID NO: 26104

SEQ ID NO: 26222 - protein, 971 aa, Bacillus anthracis str. A0488; identical to SEQ ID NO: 26107

SEQ ID NO: 26223 - protein, 333 aa, Bacillus anthracis str. A0488; identical to SEQ ID NO: 26112

SEQ ID NO: 26224 - protein, 809 aa, Bacillus anthracis str. A0488; identical to SEQ ID NO: 26081

SEQ ID NO: 26225 - protein, 764 aa, Bacillus anthracis str. A0488; identical to SEQ ID NO: 26140

SEQ ID NO: 26226 - protein, 800 aa, Bacillus anthracis str. A0488; identical to SEQ ID NO: 26082

SEQ ID NO: 26227 - protein, 431 aa, Bacillus anthracis str. BF1; identical to SEQ ID NO: 26106

SEQ ID NO: 26228 - protein, 965 aa, Bacillus anthracis str. BF1; identical to SEQ ID NO: 26108

SEQ ID NO: 26229 - protein, 503 aa, Bacillus anthracis str. BF1; identical to SEQ ID NO: 26104

SEQ ID NO: 26230 - protein, 240 aa, Bacillus anthracis str. BF1; identical to SEQ ID NO: 26095

SEQ ID NO: 26231 - protein, 229 aa, Bacillus anthracis str. BF1
TGPQGVQGPTGATGIGVTGPTGPSGGPPGPTGPQGPQGNTGATGPQGIQGPAGATGATGPQGAQGPAGATGATGPQGVQGPTGATGIGVTGPTGPSGPSFPVATIVVTNNIQQTVLQFNNFIFNTAINVNNIIFNGTDTVTVINAGIYVISVSISTTAPGCAPLGVGISINGAVATDNFSSNLIGDSLSFTTIETLTAGANISVQSTLNEITIPATGNTNIRLTVFRIA

SEQ ID NO: 26232 - protein, 372 aa, Bacillus anthracis str. BF1
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKNQVDEKLAELKKAKQTAEDKLAELKENKPNTGNTLEELKKIKSNLDSLSANLELAKQDVKNKLAALQEARQDLINKINEIKQSKQTVSDDLSKKKQDLDIKINDFKHTEKKIDDKLAEIHTTKQNIDNKINEVSQSKQTETKTGTTNANNNARELPNAGSEQSNNMALGMLSVLGGILLVTRNKIKTLFSK

SEQ ID NO: 26233 - protein, 971 aa, Bacillus anthracis str. BF1; identical to SEQ ID NO: 26107

SEQ ID NO: 26234 - protein, 880 aa, Bacillus anthracis str. BF1
MVKLSLLAYALAIINLSKYYDKNTSPIKFTITESQTTSATVTAKNSLTKGGIELTKVNAADEKETLEGAVFKIVNRDTNEDARTNLVTNSEGKLVVDDLRPGNYKLIETKAPTYYDVNVEPIEFTIEKGQQTLLPLTFKNSLTKGKVKLIKEDDVESSIALAGAVFTLQDANGTEIAKDLKTDEHGVLVIPDLAPGDYQFIETAAPEHYKLDQTPIKFTIERSQTKHVFVTATNSLTKGSVELIKVDDVEENTTLEGAVFKIVNKDGHDVRTDLTTDKNGRLVVDELPPGDYEFIETKAPTHYDLNETPIKFTVKKGQEKIASVTATNSLTKGAVELSKVDDIDGSTLKDAVFKIVDMNGNDVRTDLTTNKDGKISVSDLRPGDYQFVETKAPTHYDLNQTPINFTVEKSQTATASVTAKNSLTKGAVELTKVDDIDGTTLEGAIFKIVDQNGNDVRTDLTTDKDGKISVSDLRPGDYQFVETKAPTHYDLNQTPINFTVEKSQTATASVTATNSLTKGAVELTKVDDIDGATLEGAVFKIVDMNGNDVRTDLTTDKDGKISVSDLRPGDYQFIETKAPKHYDLNQNPINFTVEKSQTATASVTATNSLTKGAVELMKVDDIDGTTLEGAIFKIVDSNGHDVRADLTTDKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPKTQTNKQQDDRNTGKELPNTGHKNDSTQTVGIILLLAGLLSVLATKRKKYY

SEQ ID NO: 26235 - protein, 148 aa, Bacillus anthracis str. BF1; identical to SEQ ID NO: 26098

SEQ ID NO: 26236 - protein, 333 aa, Bacillus anthracis str. BF1; identical to SEQ ID NO: 26112

SEQ ID NO: 26237 - protein, 231 aa, Bacillus anthracis str. BF1
MSSWRNNINGYCSCNNQNGVHVDSCCFSCDGTVPKLGPTGPTGATGATGATGVTGVTGVTGATGITGATGITGVTGPTGATGITGATGPTGVTGTSITATYAFANNTSGTAISVLLGGTNVPLPNNQNIGPGITVSGGNTVFTVANAGNYYISYTINITASLLVSSRITINGAPLAGTINSPAVATTSFSATIITTLAAGSAISLQLFGLLAVATLSTTTPGAVLTIIRLS

SEQ ID NO: 26238 - protein, 242 aa, Bacillus anthracis str. BF1
MTGSTGPTGNTGATGSTGPTGETGATGSTGVTGNTGSTGETGPTGSTGPTGSTGATGVTGNTGPTGSTGATGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26239 - protein, 780 aa, Bacillus anthracis str. BF1; identical to SEQ ID NO: 26094

SEQ ID NO: 26240 - protein, 960 aa, Bacillus anthracis str. BF1; identical to SEQ ID NO: 26101

SEQ ID NO: 26241 - protein, 204 aa, Bacillus anthracis str. BF1
MSRYDDSQNKFSKPCFPSSAGRIPNTPSIPVTKAQLRTFRAIIIDLTKIIPKLFANPSPQNIEDLIDTLNLLSKFICSLDAASSLKAQGLAIIKNLITILKNPTFVASAVFIELQNLINYLLSITKLFRIDPCTLQELLKLIAALQTALVNSASFIQGPTGPTGPTGPAGATGATGPQGVQGPAGATGATGPQGVQGPAGATGA

SEQ ID NO: 26242 - protein, 87 aa, Bacillus anthracis str. BF1; identical to SEQ ID NO: 26096

SEQ ID NO: 26243 - protein, 455 aa, Bacillus anthracis str. BF1; identical to SEQ ID NO: 26103

SEQ ID NO: 26244 - protein, 494 aa, Bacillus anthracis str. BF1
MNIKKEFIKVISMSCLVTAITLSGPVFIPLVQGAGGHGDVGMHVKEKEKNKDENKRKDEERNKTQEEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEVQEVFAKAFAYYIEPQHRDVLQLYAPEAFNYMDKFNEQEINLSLEELKDQRMLTRYEKWEKIKQHYQHWSDSLSEEGRGLLKKLQIPIEPKKDDIIHSLSQEEKELLKRIQIDSSDFLSTEEKEFLKKLQIDIRDSLSEEEKELLNRIQVDSSNPLSEKEKEFLKKLKLDIQPYDINQRLQDTGGLIDSPSINLDVRKQYKRDIQNIDALLHQSIGSTLYNKIYLYENMNINNLTATLGADLVDSTDNT

SEQ ID NO: 26245 - protein, 51 aa, Bacillus anthracis str. BF1
MRNEKTREEYLKKIIEHVVRVEVKKDEIEKLLKKVPSDVLELYKAIEEQVL

SEQ ID NO: 26246 - protein, 301 aa, Bacillus anthracis str. BF1
KYSISSNYMIVDINERPALDNERLKWRIQLSPDTRAGYLENGKLILQRNIGLEIKDVQIIKQSEKEYIRIDAKVVPKSKIDTKIQEAQLNINQEWNKALGLPKYTKLITFNVHNRYASNIVESAYLILNEWKNNIQSDLIKKVTNYLVDGNGRFVFTDITLPNIAEQYTHQDEIYEQVHSKGLYVPESRSILLHGPSKGVGLRNDSEGFIHEFGHAVDDYAGYLLDKNQSDLVTNSKKFIDIFKEEGSNLTSYGRTNEAEFFAEAFRLMHSTDHAERLKVQKNAPKTFQFINDQIKFIINS

SEQ ID NO: 26247 - protein, 800 aa, Bacillus anthracis str. BF1; identical to SEQ ID NO: 26195

SEQ ID NO: 26248 - protein, 956 aa, Bacillus anthracis str. H9401
MMLSISTMALSLGAIQTHVSAEEKVPYNVLHSKPVGIEKPVDEIGHVSKAEETLSFQERLKVGDFSQRPASITNKVTVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTTEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQHLIDNQDKYNVPEVADDYLAEHTPKSLTAVEKEITETLPMKDAKMTKHSSQFFNTFTLEGTYTGSVTKGDSEDWNAMSKKVNEALEQLAQKEWSGYKTVTAYFVNYGVNSSNQFEYDVVFHGIAKDDEENKAPTVNINGPYNGLVKEGIQFKSDGSKDEDGKIVSYLWDFGDGSTSAEVNPVHVYESEGSYKVALIVKDDKGKESKSEITVTVKGGSLTESEPNNRPEEANRIGLNTTIKGSLIGGDHTDVYTFNVASAKNIDISVLNEYGIGMTWVLHHESDMQNYAAYGQANGNHIEANFNAKPGKYYLYVYKYDNGDGTYELSVK

SEQ ID NO: 26249 - protein, 338 aa, Bacillus anthracis str. H9401; identical to SEQ ID NO: 26105

SEQ ID NO: 26250 - protein, 503 aa, Bacillus anthracis str. H9401; identical to SEQ ID NO: 26104

SEQ ID NO: 26251 - protein, 70 aa, Bacillus anthracis str. H9401
MSGSLGLQATSAFADSKGTVENLQNGGKVYNSFKTTYDMKQNIKNSIKVSFIEDPYADKKLQLLPLMVVI

SEQ ID NO: 26252 - protein, 240 aa, Bacillus anthracis str. H9401; identical to SEQ ID NO: 26095

SEQ ID NO: 26253 - protein, 455 aa, Bacillus anthracis str. H9401; identical to SEQ ID NO: 26103

SEQ ID NO: 26254 - protein, 372 aa, Bacillus anthracis str. H9401; identical to SEQ ID NO: 26129

SEQ ID NO: 26255 - protein, 969 aa, Bacillus anthracis str. H9401
MEYISGGNVMNKNLKFTQMMIGISTMALSFGSIQTHVSAEETASYNILQMKPIGTETSKDEIVHATKADETLTFEERLKVGDFSQRPTLVMERDEIQLKQSYTLAELNKMPNSELIDTLSKISWNQITDLFQFNQDTKAFYQNKERMNVIINELGQRGRTFTKENSKGIETFVEVLRSAFYVGYYNNELSYLKERSFHEKCLPALKAIAKNPNFTLGTAEQDRVVAAYGKLIGNASSDTETVQYAVNVLKQYNDYLTTYVSDYAKGQAVYEIVKGIDYDIQSYLQDTNKQPNETMWYGKIDNFINEVNRIALVGNITNENSWLINNGIYYAGRLGKFHSNPYKGLEVITQAMSLYPRLSGPYFVAVEQIKTNYGGKDYSGKAVDLQKIREEGKRQYLPKTYTFDDGSIVFKTGDKVTEEKIKRLYWAAKEVKAQYHRVIGNDKALEPGNADDVLTIVIYNNPDEYQLNRQLYGYETNNGGIYIEEKRTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFDTFDKLQDLIRVNDVKNYDSYRESLSNNTQLNAEYQAYMQQLIDNQDKYNVPQVTNDYLIQHAPKPLAEVKNEIVDVANIKDAKITKYESQFFNTFTVEGKYTGGTSKGESEDWKTMSKQVNRTLEQLSQKGWSGYKTVTAYFVNYRVNAANQFEYDIVFHGVATEEKEKTNTIVNMNGPYSGIVNEEIQFHSDGTKSENGKVTSYLWNFGDGTTSTEANPTHVYEEKGTYTVELTVKDRRGKESKEQTKVTVKQDPQTGEFHEEEKVLLFNTLVKGNLVTPDQTDVYTFDVTDTKEVDISVVNEQNIGMTWVLYHESDMQNYVACGEDEGNVIKGKFEAKPGKYYLNVYKFDDKNGEYSLLVK

SEQ ID NO: 26256 - protein, 971 aa, Bacillus anthracis str. H9401; identical to SEQ ID NO: 26107

SEQ ID NO: 26257 - protein, 774 aa, Bacillus anthracis str. H9401; identical to SEQ ID NO: 26100

SEQ ID NO: 26258 - protein, 312 aa, Bacillus anthracis str. H9401; identical to SEQ ID NO: 26192

SEQ ID NO: 26259 - protein, 728 aa, Bacillus anthracis str. H9401
MTGITGSTGATGNTGPTGETGATGSAGITGSTGPTGNTGGTGSTGPTGNTGATGSTGVTGSTGVTGSTGVTGSTGVTGSTGPTGETGGTGSTGVTGSTGATGSTGVTGNTGPTGSTGATGNTGSIGETGGTGSMGPTGETGVTGSTGGTGSTGVTGNTGPTGSTGVTGSTGVTGSTGPTGSTGVTGSTGPTGSTGVTGSTGVTGNMGPTGSTGVTGNTGSTGTTGATGETGPMGSTGATGTTGPTGETGETGETGGTGSTGPTGNTGATGSTGVTGSTGVTGSTGVTGETGPTGSTGATGNTGPTGETGGTGSTGATGSTGVTGNTGPTGSTGVTGNTGPTGSTGATGNTGPIGETGGTGSTGPTGETGGTGSTGVTGSTGVTGNTGATGETGPTGSTGATGNTGPTGSTGVTGNTGPIGSTGATGETGPTGSMGATGNTGATGETGPTGSTGVTGNTGATGETGPTGNTGATGNTGPTGETGVTGSTGPTGETGVTGSTGPTGNTGATGETGATGSTGVTGNTGSTGETGPTGSTGPTGSTGATGVTGNTGPTGSTGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26260 - protein, 148 aa, Bacillus anthracis str. H9401; identical to SEQ ID NO: 26098

SEQ ID NO: 26261 - protein, 431 aa, Bacillus anthracis str. H9401; identical to SEQ ID NO: 26106

SEQ ID NO: 26262 - protein, 824 aa, Bacillus anthracis str. H9401
MNAADEKETLEGAVFKIVNRDTNEDARTNLVTNSEGKLVVDDLRPGNYKLIETKAPTYYDVNVEPIEFTIEKGQQTLLPLTFKNSLTKGKVKLIKEDDVESSIALAGAVFTLQDANGTEIAKDLKTDEHGVLVIPDLAPGDYQFIETAAPEHYKLDQTPIKFTIERSQTKHVFVTATNSLTKGSVELIKVDDVEENTTLEGAVFKIVNKDGHDVRTDLTTDKNGRLVFDELPPGDYEFIETKAPTHYDLNETPIKFTVKKGQEKIASVTATNSLTKGAVELSKVDDIDGSTLKDAVFKIVDMNGNDVRTDLTTNKDGKISVSDLRPGDYQFVETKAPTHYDLNQTPINFTVEKSQTATASVTAKNSLTKGAVELTKVDDIDGTTLEGAIFKIVDQNGNDVRTDLTTDKDGKISVSDLRPGDYQFVETKAPTHYDLNQTPINFTVEKSQTATASVTATNSLTKGAVELTKVDDIDGATLEGAVFKIVDMNGNDVRTDLTTDKDGKISVSDLRPGDYQFIETKAPKHYDLNQNPINFTVEKSQTATASVTATNSLTKGAVELMKVDDIDGTTLEGAIFKIVDSNGHDVRADLTTDKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPKTQTNKQQDDRNTGKELPNTGHKNDSTQTVGIILLLAGLLSVLATKRKKYY

SEQ ID NO: 26263 - protein, 767 aa, Bacillus anthracis str. H9401
MNEHYTESDIKRNHKTEKNKTEKEKFKDSINNLVKTEFTNETLDKIQQTQDLLKKIPKDVLEIYSELGGEIYFTDIDLVEHKELQDLSEEEKNSMNSRGEKVPFASRFVFEKKRETPKLIINIKDYAINSEQSKEVYYEIGKGISLDIISKDKSLDPEFLNLIKSLSDDSDSSDLLFSQKFKEKLELNNKSIDINFIKENLTEFQHAFSLAFSYYFAPDHRTVLELYAPDMFEYMNKLEKGGFEKISESLKKEGVEKDRIDVLKGEKALKASGLVPEHADAFKKIARELNTYILFRPVNKLATNLIKSGVATKGLNVHGKSSDWGPVAGYIPFDQDLSKKHGQQLAVEKGNLENKKSITEHEGEIGKIPLKLDHLRIEELKENGIILKGKKEIDNGKKYYLLESNNQVYEFRISDENNEVQYKTKEGKITVLGEKFNWRNIEVMAKNVEGVLKPLTADYDLFALAPSLTEIKKQIPQKEWDKVVNTPNSLEKQKGVTNLLIKYGIERKPDSTKGTLSNWQKQMLDRLNEAVKYTGYTGGDVVNHGTEQDNEEFPEKDNEIFIINPEGEFILTKNWEMTGRFIEKNITGKDYLYYFNRSYNKIAPGNKAYIEWTDPITKAKINTIPTSAEFIKNLSSIRRSSNVGVYKDSGDKDEFAKKESVKKIAGYLSDYYNSANHIFSQEKKRKISIFRGIQAYNEIENVLKSKQIAPEYKNYFQYLKERITNQVQLLLTHQKSNIEFKLLYKQLNFTENETDNFEVFQKIIDEK

SEQ ID NO: 26264 - protein, 764 aa, Bacillus anthracis str. H9401; identical to SEQ ID NO: 26154

SEQ ID NO: 26265 - protein, 809 aa, Bacillus anthracis str. H9401
MNIKKEFIKVISMSCLVTAITLSGPVFIPLVQGAGGHGDVGMHVKEKEKNKDENKRKDEERNKTQEEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEVQEVFAKAFAYYIEPQHRDVLQLYAPEAFNYMDKFNEQEINLSLEELKDQRMLARYEKWEKIKQHYQHWSDSLSEEGRGLLKKLQIPIEPKKDDIIHSLSEEEKELLKRIQIDSSDFLSTEEKEFLKKLQIDIRDSLSEEEKELLNRIQVDSSNPLSEKEKEFLKKLKLDIQPYDINQRLQDTGGLIDSPSINLDVRKQYKRDIQNIDALLHQSIGSTLYNKIYLYENMNINNLTATLGADLVDSTDNTKINRGIFNEFKKNFKYSISSNYMIVDINERPALDNERLKWRIQLSPDTRAGYLENGKLILQRNIGLEIKDVQIIKQSEKEYIRIDAKVVPKSKIDTKIQEAQLNINQEWNKALGLPKYTKLITFNVHNRYASNIVESAYLILNEWKNNIQSDLIKKVTNYLVDGNGRFVFTDITLPNIAEQYTHQDEIYEQVHSKGLYVPESRSILLHGPSKGVELRNDSEGFIHEFGHAVDDYAGYLLDKNQSDLVTNSKKFIDIFKEEGSNLTSYGRTNEAEFFAEAFRLMHSTDHAERLKVQKNAPKTFQFINDQIKFIINS

SEQ ID NO: 26266 - protein, 971 aa, Bacillus anthracis str. Tsiankovskii-I; identical to SEQ ID NO: 26107

SEQ ID NO: 26267 - protein, 960 aa, Bacillus anthracis str. Tsiankovskii-I; identical to SEQ ID NO: 26101

SEQ ID NO: 26268 - protein, 455 aa, Bacillus anthracis str. Tsiankovskii-I; identical to SEQ ID NO: 26103

SEQ ID NO: 26269 - protein, 780 aa, Bacillus anthracis str. Tsiankovskii-I; identical to SEQ ID NO: 26094

SEQ ID NO: 26270 - protein, 312 aa, Bacillus anthracis str. Tsiankovskii-I; identical to SEQ ID NO: 26192

SEQ ID NO: 26271 - protein, 148 aa, Bacillus anthracis str. Tsiankovskii-I; identical to SEQ ID NO: 26098

SEQ ID NO: 26272 - protein, 431 aa, Bacillus anthracis str. Tsiankovskii-I; identical to SEQ ID NO: 26106

SEQ ID NO: 26273 - protein, 503 aa, Bacillus anthracis str. Tsiankovskii-I; identical to SEQ ID NO: 26104

SEQ ID NO: 26274 - protein, 965 aa, Bacillus anthracis str. Tsiankovskii-I; identical to SEQ ID NO: 26108

SEQ ID NO: 26275 - protein, 763 aa, Bacillus anthracis str. Tsiankovskii-I; identical to SEQ ID NO: 26125

SEQ ID NO: 26276 - protein, 333 aa, Bacillus anthracis str. Tsiankovskii-I; identical to SEQ ID NO: 26112

SEQ ID NO: 26277 - protein, 800 aa, Bacillus anthracis str. Tsiankovskii-I; identical to SEQ ID NO: 26082

SEQ ID NO: 26278 - protein, 764 aa, Bacillus anthracis str. Tsiankovskii-I; identical to SEQ ID NO: 26154

SEQ ID NO: 26279 - protein, 809 aa, Bacillus anthracis str. Tsiankovskii-I
MNIKKEFIKVISMSCLVTAITLSGPVFIPLVQGAGGHGDVGMHVKEKEKNKDENKRKDEERNKTQEEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEVQEVFAKAFAYYIEPQHRDVLQLYAPEAFNYMDKFNEQEINLSLEELKDQRMLARYEKWEKIKQHYQHWSDSLSEEGRGLLKKLQIPIEPKKDDIIHSLSQEEKELLKRIQIDSSDFLSTEEKEFLKKLQIDIRDSLSEEEKELLNRIQVDSSNPLSEKEKEFLKKLKLDIQPYDINQRLQDTGGLIDSPSINLDVRKQYKRDIQNIDALLHQSIGSTLYNKIYLYENMNINNLTATLGADLVDSTDNTKINRGIFNEFKKNFKYSISSNYMIVDINERPALDNERLKWRIQLSPDTRAGYLENGKLILQRNIGLEIKDVQIIKQSEKEYIRIDAKVVPKSKIDTKIQEAQLNINQEWNKALGLPKYTKLITFNVHNRYASNIVESAYLILNEWKNNIQSDLIKKVTNYLVDGNGRFVFTDITLPNIAEQYTHQDEIYEQVHSKGLYVPESRSILLHGPSKGVGLRNDSEGFIHEFGHAVDDYAGYLLDKNQSDLVTNSKKFIDIFKEEGSNLTSYGRTNEAEFFAEAFRLMHSTDHAERLKVQKNAPKTFQFINDQIKFIINS

SEQ ID NO: 26280 - protein, 800 aa, Bacillus anthracis str. UR-1; identical to SEQ ID NO: 26082

SEQ ID NO: 26281 - protein, 87 aa, Bacillus anthracis str. UR-1; identical to SEQ ID NO: 26096

SEQ ID NO: 26282 - protein, 371 aa, Bacillus anthracis str. UR-1
MAYVGEASEQNLWAPTEKEFGYIIEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAAAYSSSDPTCLRRLDTNKVYPKDMKNQVHADGEIWSQGQYEMAQAFGRDVATKIILQSHWSLTPNSKFSDGAKAIKQADALLYGGQHAADIDRIWAARGISTN

SEQ ID NO: 26283 - protein, 225 aa, Bacillus anthracis str. UR-1
  MOD_RES (53)..(53): Any amino acid
MSSWRNNINGYCSCNNQNGVHVDSCCFSCDGTVPKLGPTGPTGATGATGATGXTGVTGVTGATGITGATGITGATGITGATGPTGVTGTSITATYAFANNTSGTAISVLLGGTNVPLPNNQNIGPGITVSGGNTVFTVANAGNYYISYTINITASLLVSSRITINGAPLAGTINSPAVATTSFSATIITTLAAGSAISLQLFGLLAVATLSTTTPGAVLTIIRLS

SEQ ID NO: 26284 - protein, 431 aa, Bacillus anthracis str. UR-1; identical to SEQ ID NO: 26106

SEQ ID NO: 26285 - protein, 333 aa, Bacillus anthracis str. UR-1; identical to SEQ ID NO: 26112

SEQ ID NO: 26286 - protein, 780 aa, Bacillus anthracis str. UR-1; identical to SEQ ID NO: 26094

SEQ ID NO: 26287 - protein, 223 aa, Bacillus anthracis str. UR-1
MSRYDDSQNKFSKPCFPSSAGRIPNTPSIPVTKAQLRTFRAIIIDLTKIIPKLFANPSPQNIEDLIDTLNLLSKFICSLDAASSLKAQGLAIIKNLITILKNPTFVASAVFIELQNLINYLLSITKLFRIDPCTLQELLKLIAALQTALVNSASFIQGPTGPTGPTGPAGATGATGPQGVQGPAGATGATGPQGVQGPAGATGATGPQGAQGPAGATGALDLK

SEQ ID NO: 26288 - protein, 673 aa, Bacillus anthracis str. UR-1
MKGYSKKVLVGVSFASLMLGSFQGGALAEGTKGEQASYRNVLKMEPVGVQLPVQELAHSSKVLENKSFEKRLQFADLSQRPPELKKESKQLATAKTYTIAELNQLSNQQLVDLLVTIDWEQITGLFQFNKDSLAFYQNDSRIQAIIDKLKQQGQDYTKDDSKGIETLVEVLRSGFYLGFYHTELSKLNERSYHDKCLPALKTIANNANFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHDTETSLQILWQ

SEQ ID NO: 26289 - protein, 965 aa, Bacillus anthracis str. UR-1; identical to SEQ ID NO: 26108

SEQ ID NO: 26290 - protein, 240 aa, Bacillus anthracis str. UR-1; identical to SEQ ID NO: 26095

SEQ ID NO: 26291 - protein, 72 aa, Bacillus anthracis str. UR-1
MEGNGGKSKIKSPLNSNFKILSDLVGPTFPPVPTGMTGITGSTGATGNTGPTGETGATGSAGITGSTGPTGN

SEQ ID NO: 26292 - protein, 209 aa, Bacillus anthracis str. UR-1
GTGNTGSTGETGPTGSTGPTGSTGATGVTGNTGPTGSTGATGATGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26293 - protein, 809 aa, Bacillus anthracis str. UR-1; identical to SEQ ID NO: 26081

SEQ ID NO: 26294 - protein, 455 aa, Bacillus anthracis str. UR-1; identical to SEQ ID NO: 26103

SEQ ID NO: 26295 - protein, 372 aa, Bacillus anthracis str. UR-1; identical to SEQ ID NO: 26129

SEQ ID NO: 26296 - protein, 880 aa, Bacillus anthracis str. UR-1; identical to SEQ ID NO: 26234

SEQ ID NO: 26297 - protein, 596 aa, Bacillus atrophaeus
MKKVFSNKKFLVFSFIFAMILSLSFFNGESAKASSDKSYKIIGYYPSWGAYGRDFQVWDMDASKVSHINYAFADICWEGRHGNPDPTGPNPQTWSCQDENGVIDVPNGSIVMGDPWIDVQKSNAGDTWDEPIRGNFKQLLKLKKNHPHLKTFISVGGWSWSNRFSDVAADPAARENFAASAVNFLRKYGFDGVDLDWEYPVSGGLPGNSTRPEDKRNYTLLLQDVREKLDAAEAKDGKKYLLTIASGASPEYVSNTELDKIAETVDWINIMTYDFNGGWQSINAHNAPLFYDPKAKEAGVPNAETFNIESTVKRYKEAGVKADKLVLGTPFYGRGWSNCEPADNGEYQKCGPAKEGTWEKGVFDFSDLEKNYINKNGYKRYWNDRAKVPFLYNAENGNFITYDDEESYGYKTDLIQSNGLSGAMFWDFSGDSNQTLLNKLAADLGFAPGGGNPEPPSSAPDNLRVTEKTATSISLAWDAPSDGANIAEYVLSYEGGAVSVKDTSATIGQLKPNTTYSFTVSAKDADGKLHTGPTIEAATNSDQTCGYNEWKDTAVYTGGDRVVFNGKVYEAKWWTKGEQPDQAGESGVWKLIGDCK

SEQ ID NO: 26298 - protein, 201 aa, Bacillus atrophaeus
  strain 1942
MFKKLGTLLLITSLILLAACKNSEESSTSSVDTNNTTDTNTSESQDISTNGPEKVGDVYEIESGTAKVMAISNKEATAKTGPMQVTVKKVIAAVANEQTPFIEVQLEAENTSDKVVYFGLDDAKLATSNGVQIDEASTSENEKFLGEYVGKVNDSGSVFYIFENEEDIKDLDSIRLRFNLPVDEDAHALDDDLDLKINLEH

SEQ ID NO: 26299 - protein, 1190 aa, Bacillus atrophaeus
  strain 1942
MGRKGTARAIYCVLITLLVITNMPLYALPAAKAAEAMSVEEALQQKEGKAVTEGFVVGQAISNQNYKLSSPFSNDYNAAIADSKDETSPEKLLPIQIPSSYRNQFGLKTNPQLLGEKITVQGELEAYFQTTGLKKVQSMSLNGRIEEPPADSLISIHHARSKLNEQVKIKGVVTADQAAIGGGKLSTFIQDGTAGINIYSGTPEEFPELKEGMEVTVTGKIAKYQGLTEIIPGSSGIEITAAKQPLPEPESFTINELINSDRGAAYEGRLVTVKAYIASKPSSQAGGGYNVTMIDADHHSLTLRVMEETGIINELSAGKWYECTGILSRYQSLQLMPRKPDDIKLLKDQPAPPSQEGEYEGVVDRVVDGDTINIKTPILGSTKIRFVHVDTPETYHTPKSELDENQLTFGQKASNYLKTILSPGDKITVKVGQEAKDSYGRLLGQVFTEDGLNANLDLVKNGYAPTYFIWPVDHEGDYLKFQKAAAEAQKEQKGIWNQADPLKEMPFEFRAREQGKGLTRYVGDSSDKTYVPPEEWKEIAVEHRIFFSSPEEAESAGYKKRESGNKANMPLRILSMNDLHGKIDQQYELDLNQDGKTDGTFGRMDFAAAYLKERKAEKENTLLVHAGDMIGGSSPVSSLLQDEPTVELMEEVGFDVGTVGNHEFDEGTDELMRMLKGGEHPEEKGTSGYDGQNFPLVCANCKMKSSGKPFLPPYEIINVDGVPVAFIGVVTQSAAGMVMPEGIKQIEFTDEVQAVNAAAAELKKKGVRSIAVLAHMTAEQNGNSITGESADLAKKTDSEIDIIFAGHNHKVVNGEVNGKLIVQAFEYGKAIGVVDLEIDRKTKDIVKKSADIEYVDQSKIKPDPAAAGILSKYQTVVDPIISEVVGEAAVDMNGGYSNEGDTPLGNLIADGMKTAMNSDFALMNGGGIRQNLKKGPITWGDLFNIQPFGNVLTKLEIKGKDLTDIINAQISPDYGPDYSISGFTYTWDPETAKVIDIKMADGTAIQPETGYTLTVNNFMATAAGTKYKPISSLGKNPVTGPEDIEATVAFVKSFKDPISYKADGRIKKAEAKEGEGQDPDDGAPEDTKPGTNQPPLNQPENTPADKENHHQSIPAVTEGVTGITESQTAPIGMTDGISALPIQNKTEKQPAAHKLPDTSAGHYNFIVIGTAMTLSGIYVYVRRKRSASSK

SEQ ID NO: 26300 - protein, 355 aa, Bacillus atrophaeus
  strain 1942
MFKKKTYAVFLILILTLFTAACSGSKANGEKKNSDSEKKSDTAEVKIDSTEYTLPPQYDNSASNDQLVLKVNVSVKNTGKDILYVNSNDFTLYQGDTKSSESTPDDYNERLQSSSLNPDKAIKGSLFYVVDKGKKYELVYNPPSSGSDKKEKSLTFKIDGSSKKILATADQLQNPAKALSAYVDILLFGKDNKDFEKITGDNKNKIVNEFNKAAKESYVSASGLSSQYADDKTLDKILGAITSTLSEKSAVQTKTKSITGDEAIVEATIKPVDASSLSDRIKDRVEDYYSKNSGSSYEDAVKYALNVYPDEFKKLGPASTEETVEVKMKKNDIDQWQLDQKDYRASEFASAFIKE

SEQ ID NO: 26301 - protein, 430 aa, Bacillus atrophaeus
  strain 1942
MPYIVDVYAREVLDSRGNPTVEVEVYTESGAFGRALVPSGASTGEYEAVELRDGDKDRYLGKGVLTAVNNVNEIISPELLGFDVTEQNAIDQLLIELDGTENKGKLGANAILGVSMAVARAAADFLQIPLYQYLGGFNSKTLPVPMMNIVNGGEHADNNVDIQEFMIMPVGAENFREALRMGAQIFHSLKSVLAAKGMNTAVGDEGGFAPNLGSNEEALQTIVEAIEKAGFKPGEEVKLAMDAASSEFYNKEDGKYHLSGEGVVKTSAEMVDWYEEMASKYPIISIEDGLDENDWEGHKLLTERLGKKVQLVGDDLFVTNTKKLAEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINTFYNLNK

SEQ ID NO: 26302 - protein, 197 aa, Bacillus atrophaeus
  strain 1942
MKKVLLLLFMLTIGLALTACSQSNDASAEQKEEKKASEKKEETTKDKTENKTDEEVHKIGETFKAMNTNFSVNKIYTAQKGEYKVKLSEEKERSLQKNEEFLIAEVTIENKGEKSIDYSILGFELKDGKDKTILPNIVSTPDIDTYIQAGNLASDKKVTGTISFVVPKGEKDLTLVYKPSFFDLTKEENIHYLITLR

SEQ ID NO: 26303 - protein, 221 aa, Bacillus atrophaeus
  strain 1942
MKKIASILLMLGLFIGLCQFQPSTVFAADEVVQQTIVVPKNTTYDGKGKRFIAGSALGDGSQKEGQKPVFKVEDGATLKNVVLGAPAADGVHTYGNVNITNVVWEDVGEDALTVKKEGKVTIDGGSAQKASDKIFQINKASTFTVKNFKADNGGKFIRQLGGSTFHTDVIIDRCTITNMKEAIFRTDSKTSTVTMTNTRYSNVGQKWIGVQHVTEKNNTSF

SEQ ID NO: 26304 - protein, 593 aa, Bacillus atrophaeus
  strain 1942
MFSNKKFLVFSFIFAMILSLSFFNGESAKASSDKSYKIIGYYPSWGAYGRDFQVWDMDASKVSHINYAFADICWEGRHGNPDPTGPNPQTWSCQDENGVIDVPNGSIVMGDPWIDVQKSNAGDTWDEPIRGNFKQLLKLKKNHPHLKTFISVGGWSWSNRFSDVAADPAARENFASSAVDFLRKYGFDGVDLDWEYPVSGGLPGNSTRPEDKRNYTLLLQDVREKLDAAEAKDGKKYLLTIASGASPEYVSNTELDKIAETVDWINIMTYDFNGGWQSISAHNAPLFYDPKAKEAGVPNAETFNIESTVKRYKEAGVKADKLVLGTPFYGRGWSNCEPADNGEYQKCGPAKEGTWEKGVFDFSDLEKNYINKNGYKRYWNDRAKVPFLYNAENGNFITYDDEESYGYKTDLIKSNGLSGAMFWDFSGDSNQTLLNKLAADLGFAPGGGNPEPPSSAPGNLHVTEKTATSISLAWDAPSDGANIAEYVLSYEGGAVSVKDTSATIGQLKPNTTYSFTISAKDADGKLHTGPTIEAATNSDQTCGYNEWKDTAVYTGGDRVVFNGKVYEAKWWTKGEQPDQAGESGVWKLIGDCK

SEQ ID NO: 26305 - protein, 310 aa, Bacillus atrophaeus
  strain 1942
MSRKLLHCKACGQETAKGVKKCPNCGKDQRNFFMRHKIITFILAIVVIIIIIANIGDSGDSQASTTTTGTASEKSTKTVQKADMEKLYTNADQFKNYKVDLYVKVFDVEQDDDGTYLQGYNNPEKLSKNTLIMSDDSDLDIKDDDIIHVVGTVKDKYDGENALGGSVSAPRIIADSIEKSDYATAFAPAKKTINVNKTQNQHGFVLTLQKVELAEKETRLYVKIENKSQDEISFYDFNAKITADNKQLEPDSDLSEYPEIQSEILPGVKTEGVIAFPKINSKTANIILEGSSENYDITINPFTFEVNLDQ

SEQ ID NO: 26306 - protein, 511 aa, Bacillus atrophaeus
  strain 1942
MCCCCVRGVRGPQGPRGLRGIPGSIGATGTTGPPGPPGPPGLPGATGATGDAGPAGATGATGATGDVGPAGATGATGATGATGDAGATGATGATGDAGPAGATGATGTTGDAGPAGATGATGDVGPAGATGATGATGATGDVGPAGATGATGATGATGDAGLAGATGATGATGATGDVGPAGATGATGATGATGDVGPAGATGATGATGDVGPAGATGPAGATGATGATGATGDAGPAGATGATGATGATGDAGPAGATGATGATGDAGPAGATGATGDVGPAGATGATGATGDAGPAGATGATGATGATGDIGPAGATGATGATGDAGPAGATGATGATGDVGPVGATGATGATGDAGPAGATGATGATGTGAAGLSEYGYIYNLSAQTVAIEADVIFDSTGITTPGITHAPGTSQIAITTPGDYEVTFSVSGVEPNQFTLFLNGAPITNTVYGSGAGTQQNNGQAIIAIAAGDVLTLRNHTSAAAVTLQTLAGGTQTNVNASIVIKKLD

SEQ ID NO: 26307 - protein, 235 aa, Bacillus atrophaeus
  strain 1942
MKQALSILLLIMMLVGCSSNANSEKNTENENTVEAKQKKASAQTDSKMNEYQPNSQVTDDRSLQKIDQTFADDKGEAVLKDIKNINKTYDIGSIELTVREIKLIHLRPDYSMIDYFHVLTHDEEFDFVKVFVEIQNKSSEKVNFAPIALLKTNTGETFDWKKDIYLEELNGEMEGGATKSGNLGFIVNAAGGHRHNEQTNHKNEKDIKWIEMTTSDVFDKNHKKISDSQKIKIEF

SEQ ID NO: 26308 - protein, 274 aa, Bacillus atrophaeus
  strain 1942
MKAKVDSWKKTAVSILIFTMFFTLMMNDTVFAAGLNKDQKRRAEQLTSIFENGMTEIQYGYVEHLPDGRGYTCGRAGFTTATGDALEVVEVYTKAVPNNKLKKYLPELRRLAKEESDDISNLKGFDSAWRSLGNDKDFRAAQDAVNDRLYYQPAMKRSENAGLKTALAKAVMYDTVIQHGDGDDPDSFYSLIKRTNKKAGGSPKDGIDEKKWLNKFLDVRYDDLMNPSDPDTRDEWRESVARVDVLRSIAKANNYNLNGPINVYSEEYGDFVIK

SEQ ID NO: 26309 - protein, 1335 aa, Bacillus atrophaeus
  strain 1942
MSNLIVNGGFETGDLTGWSSAYTEINSQFVHTGRYSAQFANTIPFAFLAQMIPVTAGQSLAFQVSLGTLGIEPSPQVSMQILFVNDIGEQIGTGLDVVIVPDNLPNLVFNAWNEIYQTTHQIPSDGAFAIIIISKTSFGPVLIDDVSIVEFVNGIGVTGPTGVTGVTGATGPTGVTGATGVTGATGATGETGPTGVTGVTGATGVTGPTGPTGETGVTGVTGETGPTGVTGVTGVTGPTGPTGEMGATGVTGVTGVTGSTGETGPTGEMGATGVTGATGATGETGSTGVTGVTGETGPTGVTGVTGVTGVTGVTGSTGVTGATGETGPTGVTGSTGATGVTGSTGVTGVTGSTGSTGATGVTGVTGATGSTGVTGPTGPTGETGSTGVTGVMGVTGSTGETGVTGPTGSTGSTGVTGVTGSTGATGVTGVTGSTGETGPTGEMGATGVTGVTGETGPTGVTGVTGATGATGVTGPTGVTGPTGATGVTGPTGATGVTGSTGVTGSTGATGATGVTGVTGATGSTGVTGVTGETGSTGVTGSTGATGETGPTGVTGSTGVTGETGVTGATGETGPTGSTGSTGETGPTGEMGATGVTGVTGETGPTGVTGVTGATGATGATGATGATGATGATGATGVTGPTGPTGETGATGVTGVTGVTGSTGETGVTGPTGSTGSTGVTGVTGATGATGVTGVTGSTGETGATGVTGVTGSTGETGPTGEMGATGVTGVTGETGPTGVTGVTGATGATGVTGPTGVTGPTGSTGVTGSTGATGATGVTGVTGATGVTGVTGATGSTGVTGVTGETGSTGVTGSTGATGETGVTGSTGVTGETGVTGATGETGPTGSTGSTGSTGVTGVTGATGVTGSTGSTGVTGATGETGSTGATGSTGVTGATGETGSTGVTGATGETGPTGEMGATGVTGVTGETGPTGVTGSTGVTGETGETGPTGSTGATGPTGVTGATGETGSTGVTGATGETGPTGVTGATGETGSTGVTGATGETGPTGVTGETGATGPTGPTGVTGETGPTGEMGAKGVTGVTGATGSTGSTGVTGVTGVTGSTGATGVTGSTGVTGATGSTGSTGVTGATGATGSTGSTGVTGATGVTGSTGPTGVTGVTGSTGPTGVTGSTGVTGATGSTGATGVTGVTGATGSTGSTGSTGSTGSMGSTGVTGVTGETGSTGPTGPTGVTGATGVTGPTSESPQLFFTEVAGPVTVAVNSTETTIGSLNVPTTIGQNIKVDFAISVDVVTTANSNFTFQVRTYRNGTLLDTRTVQRNVNVAITSRFPIASTNVNTAATTGTTTYEVRIIFTSVSNVSSASALNLDINAIRFS

SEQ ID NO: 26310 - protein, 235 aa, Bacillus atrophaeus C89; identical to SEQ ID NO: 26307

SEQ ID NO: 26311 - protein, 111 aa, Bacillus atrophaeus C89
STGITTPGITHAPGTSQIAITTPGDYEVTFSVSGVEPNQFTLFLNGAPITNTVYGSGAGTQQNNGQAIIAIAAGDVLTLRNHTSAAAVTLQTLAGGTQTNVNASIVIKKLD

SEQ ID NO: 26312 - protein, 274 aa, Bacillus atrophaeus C89; identical to SEQ ID NO: 26308

SEQ ID NO: 26313 - protein, 279 aa, Bacillus atrophaeus C89
VTGSTGATGVTGSTGVTGATGSTGSTGVTGATGSTGSTGSTGSMGSTGVTGVTGATGPTGVTGVTGSTGPTGVTGSTGVTGATGSTGATGVTGVTGATGSTGSTGSTGSTGSMGSTGVTGVTGETGSTGPTGPTGVTGATGVTGPTSESPQLFFTEVAGPVTVAVNSTETTIGSLNVPTTIGQNIKVDFAISVDVVTTANSNFTFQVRTYRNGTLLDTRTVQRNVNVAITSRFPIASTNVNTAATTGTTTYEVRIIFTSVSNVSSASALNLDINAIRFS

SEQ ID NO: 26314 - protein, 231 aa, Bacillus atrophaeus C89
MSNLIVNGGFETGDLTGWSSAYTEINSQFVHTGRYSAQFANTIPFAFLAQMIPVTAGQSLAFQVSLGTLGIEPSPQVSMQILFVNDIGEQIGTGLDVVIVPDNLPNLVFNAWNEIYQTTHQIPSDGAFAIIIISKTSFGPVLIDDVSIVEFVNGIGVTGPTGVTGVTGATGPTGVTGATGVTGATGATGETGPTGVTGVTGATGVTGPTGPTGETGVTGVTGETGPTGVTG

SEQ ID NO: 26315 - protein, 355 aa, Bacillus atrophaeus C89; identical to SEQ ID NO: 26300

SEQ ID NO: 26316 - protein, 305 aa, Bacillus atrophaeus C89
GEAAVDMNGGDSNEGDTPLGNLIADGMKTAMNSDFALMNGGGIRQNLKKGPITWGDLFNIQPFGNVLTKLEIKGKDLTDIINAQISPDYGPDYSISGFTYTWDPETAKVIDIKMADGTAIQPETGYTLTVNNFMATAAGKKYKPISSLGKNPVTGPEDIEATVAFVKSFKDPISYKADGRIKKAEAKEGEGQDPDDGAPEDTKPGTNQPPLNQPENTPADKENHHQSIPAVTEGVTGITESQTAPIGMTDGISALPIQNKTEKQPAAHKLPDTSAGHYNFIVIGTAMTLSGIYVYVRRKRSASSK

SEQ ID NO: 26317 - protein, 197 aa, Bacillus atrophaeus C89; identical to SEQ ID NO: 26302

SEQ ID NO: 26318 - protein, 430 aa, Bacillus atrophaeus C89
MPYIVDVYAREVLDSRGNPTVEVEVYTESGAFGRALVPSGASTGEYEAVELRDGDKDRYLGKGVLTAVNNVNEIISPELLGFDVTEQNAIDQLLIELDGTENKGKLGANAILGVSMAVARAAADFLQIPLYQYLGGFTSKTLPVPMMNIVNGGEHADNNVDIQEFMIMPVGAENFREALRMGAQIFHSLKSVLAAKGMNTAVGDEGGFAPNLGSNEEALQTIVEAIEKAGFKPGEEVKLAMDAASSEFYNKEDGKYHLSGEGVVKTSAEMVDWYEEMASKYPIISIEDGLDENDWEGHKLLTERLGKKVQLVGDDLFVTNTKKLAEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINTFYNLNK

SEQ ID NO: 26319 - protein, 221 aa, Bacillus atrophaeus C89; identical to SEQ ID NO: 26303

SEQ ID NO: 26320 - protein, 310 aa, Bacillus atrophaeus C89; identical to SEQ ID NO: 26305

SEQ ID NO: 26321 - protein, 201 aa, Bacillus atrophaeus C89; identical to SEQ ID NO: 26298

SEQ ID NO: 26322 - protein, 593 aa, Bacillus atrophaeus C89
MFSNKKFLVFSFIFAMILSLSFFNGESAKASSDKSYKIIGYYPSWGAYGRDFQVWDMDASKVSHINYAFADICWEGRHGNPDPTGPNPQTWSCQDENGVIDVPNGSIVMGDPWIDVQKSNAGDTWDEPIRGNFKQLLKLKKNHPHLKTFISVGGWSWSNRFSDVAADPAARENFASSAVDFLRKYGFDGVDLDWEYPVSGGLPGNSTRPEDKRNYTLLLQDVREKLDAAEAKDGKKYLLTIASGASPEYVSNTELDKIAETVDWINIMTYDFNGGWQRISAHNAPIFYDPKAKEAGVPNAETFNIESTVKRYKEAGVKADKLVLGTPFYGRGWSNCEPADNGEYQKCGPAKEGTWEKGVFDFSDLEKNYINKNGYKRYWNDRAKVPFLYNAENGNFITYDDEESYGYKTDLIKSNGLSGAMFWDFSGDSNQTLLNKLAADLGFAPGGGNPEPPSSAPGNLHVTEKTATSISLAWDAPSDGANIAEYVLSYEGGAVSVKDTSATIGQLKPNTTYSFTISAKDADGKLHTGPTIEAATNSDQTCGYNEWKDTAVYTGGDRVVFNGKVYEAKWWTKGEQPDQAGESGVWKLIGDCK

SEQ ID NO: 26323 - protein, 196 aa, Bacillus azotoformans LMG 9581
MKKFLKLGCGGLIGVIVLIIVIGALFGDDSKKTTNVEKEAVEATATKSNEGKKEESTTEEAKKASIGEELTIGKAVFKVNSMEETNKITAGNGMFKYTPDSEGAVFLIVNVTVKNNGTEMIQTDSSFFKLKATSGATYSPSSIIVADGKFFTFEGINPGLALTGNVVFEVPASLTGLDLQVQTGFWGTETGIINLN

SEQ ID NO: 26324 - protein, 430 aa, Bacillus azotoformans LMG 9581
MPIIVDVYAREVLDSRGNPTVEVEVYTESGAMGRALVPSGASTGEYEAVELRDGDKDRYLGKGVLKAVENVNEKIASEIIGFDVTDQVAIDNYLIELDGTENKGNLGANAILGVSMAVARAAADFLEIPLYAYLGGFNAKTLPVPMMNIINGGAHADNNVDIQEFMIMPVGAENFREALRMGAEIFHSLKAVLKAKGLNTAVGDEGGFAPNLGSNEEALQTIIEAIEKAGYKPGEQVRLAMDAASSEFYSKEDGKYHLSGEGVVKTSAEMVDFYENLVNKYPIISIEDGLDENDWEGHKMLTERLGDRVQLVGDDLFVTNTKKLSQGIEKGVGNSILVKVNQIGTLTETFDAIEMAKRAGYTAVISHRSGETEDSTIADIAVATNAGQIKTGAPSRTDRVAKYNQLLRIEDQLGDMSKYGGLSAFYNLKK

SEQ ID NO: 26325 - protein, 236 aa, Bacillus azotoformans LMG 9581
MKKIFILFISITLILSIQDYAEGKTLGVSLVDENLKIETNDKYVGVLLGELILLPDDNNYDKPSALEMINTLSQINPTILNFLTENNLKVKLFNGKLTDEPSFQNLKGTVPRGWNNGLTWDDVPGGCGPTLALAKIGASQTGMGHSSVNLELHEVGHLFERNYQKLRDNMEYIQIWKEEAPKLMPGRDYFSDYQDEFFAEAFAMYYYGSNTREVVKQVAPNTYSLISDIENSPVLI

SEQ ID NO: 26326 - protein, 14 aa, Bacillus badius
SCTTCVCTCSCCTT

SEQ ID NO: 26327 - protein, 185 aa, Bacillus bataviensis LMG 21833
MGMVMEELLLQAQENGVMEFLVNNPVEFKLGKKGKKGSKGSKGSKGSKGGSKGSKGSKGSHGSKGSEGSKGSKGSHGSKGSEGSKGSKGSKGSKGPLHGPLAKKKKHGPKGSHGSKGSKGSKGSKGSKGSTGSKGSKGSKGSEGSKGSKGSKGSHGSKGSKGSKGSKGSKGSHGSKGSHGSKGDK

SEQ ID NO: 26328 - protein, 288 aa, Bacillus bataviensis LMG 21833
GDVYDEKDVTSDVYQDWANLYQTNESGDFELDYSNISEDLALGAFISSSEKEKILKENPNAKVIVKKGNLVVSFPLNMLPIDQDFALNILKDSKDYANSLSPVYDFIIVKDDNTFVKEFKDHPVQLKFIIDPSKVTNWDDVKVKYIDDKGVMQDEVIKIISINKTTGEVVAEVTHFSKYGVFQIASSTNTGSTDNDTSNTGYTDKGSSNNGTSNTGSTNGTASGSTSTSQTSTTTNTNSGSTNSVSTAGNTLPDTATNSFDLLALGLLLISLGGIVLFVRRKNSLKVN

SEQ ID NO: 26329 - protein, 144 aa, Bacillus bataviensis LMG 21833
MGIIIPCDCLSELAYIYNLAAQTVAIEADVNFDTNGFLTAGITHAPGSPSILITDAGIYEVTFSVSGTEPNQFALFLNGNLVPGTIYASGAGTQQNNGQAIFTIGAGDVLTLRNHSSAAAVGLATPIGGTQANVNASIVIKKLD

SEQ ID NO: 26330 - protein, 204 aa, Bacillus bataviensis LMG 21833
MKTKFLLLFLFTSICIAFIFPIKNVDAEGNIKEIDISTSPHKVFFEIINSKPGDVFTKTLIVQNEGTKDFSYLFSNRLLTGSEKIYKELVLTVTDKSGELYKGKLKDYEKLVSRNLKSNTHEELTFSIYFPSELGNDFQRLSCEFQFKFYVEGTLGGILPADGPKLPETGTNMFNILVAGAVLVLTGTIFQFIIKRRRRIERRV

SEQ ID NO: 26331 - protein, 272 aa, Bacillus bataviensis LMG 21833
DNNGGDGGTKPGDNNGGNGGTKPGDNNGGDSGTKPDKDKSKRVEIVNPKMKNGKATIDKKDFEAVIDKISGNNGELSIDLGKEHNIELKLTKEQVELLKANDIPLTVQNDEVTLKIPTSIFTKGTVDVVLKPVANISNAKGSVYDFTIIIDGKVIHQFADPVTLVFDVNMNKIKNTNNLKVFYFNEQTMKWELVPGAIYKNGKVTVNTNHFSTFTVFEVEGDQTSLEVKAPISQNGNGLPNTATNSFNLLAAGLLLLLLGSILFFIKWRKQA

SEQ ID NO: 26332 - protein, 213 aa, Bacillus bataviensis LMG 21833
MAKLKNCKTCGKEVAKSARKCPHCGQKLKMGFFTKALIGIAALIVISIIASQGGGDDSTPANTTAKTGDNKQEAKKEDKPLSNEGVSSDVTIKVGAVENKQEVGNEYTKKQAQGVFKVLEVSITNNQKDAITVDANSFKLVDDHGREFTYSSDAQIAYDIGENEGNTDFFLKSLNPGLTLTGKVVFDVPADAKGFLLKARGGMTGKEINLKVE

SEQ ID NO: 26333 - protein, 1426 aa, Bacillus bataviensis LMG 21833
MKKRTYFGKISKIATAALMFTTIAAPFNTYKVSAEAASNTATLRILETTDLHSNVLAYDYYLDSGKDIKFGLSKTATLIQQARSEAKNSMLFDAGDLIQGNPLADYVAKVNPLKADETHPIIKAMNYLDYDAGIVGNHEFNYGLDYLNQVTKKADFPIVNANIYKDDGDKNPDNDQNYFTPYEILDKEIIDANGNKSTIKVGVVGFAPPQILNWDRDNLFGKVIVKDIVDTANKYVKEMKDNGADVIVAIAHSGCDVTNDGQMEAENAVYSLSKVAGIDALLFGHAHVNFPGDASFDGKTGVDNKTGHLNSTPAVEAGFWGNNLGVLDLALVQKDGKWTADKAASKSVNRAVAADTAQDQKIIDDVKVEHEGTLEYVRGTIGKTSAPLYSYFAQVQDDPTIQIVNNAQTAYVKKWIAEKNPELIDIPVLSAGAPFKAGGRSGPGYYTNIATGDLSIKSANDLYLYPNTLKAVEVTGSTVREWLEMSAGQFKTVNPNDAHPQNIIDESFPSYNFDVIDGVNYQVDITKPARYTAKGVLADADSHRIISLTMPDGTPVKDDQKFIVATNNYRAGGGGDFPGLKGGIAKVVVNSPDESRQVLVNYIQEQGTVNPSADNNWSIAPVNKTVQLTFRSAPEAKVYADKSDTIKTIGTEKDSAGTWGIYSIGKDVHVQLLGINDFHGQLDYTSKVNGEVVGGIEYLAAYLKQREAINPANTLMVQAGDAVGASRPVSALLQDEPTIRFLNEIGFDIGTIGNHEFDEGVTEMLRLINGGPHTATAEKYGSFEGAQFPYVAANVVYEKTGKNILKPYEILEVDGQKIGFIGVVTTETPSIVTASGVAGVKFTDEVEAINKYTAELKSKGVKAIVVLAHDPGTSATDGSNPTGKVVDMAKKVDDEVDVIFGAHDHKYLNSTVNGKLLVQSYSYGTAFSDVDLTIDPVTHDIVSKKAEIVSTFQKGITPDAKIKAELDAYKADIAPITGQVVGEAAVEITRTANAAGETALGNLIADGMRDVTKTDFAFMNVGGIRDNLKKGQITWGDLFAIQPFGNDLVTLKITGEQVRTLLNQQWSTNGAKIMQISGLKYTWSEKLPIGEKVLDIFLPNGKKIDPKAIYSVAVNNFMADGGDGFVVLKQGKERTVWMTDLDASINYVKAQKGSITAQIEGRIALADSVTDPEVPTPEVPTPEVPTPEVPVNGTVVMVKPVINAGQATVNTNELTVALEKAAKEKGSLSFDLGKEKSIILKLTKEQVAQLIEKGIPLSVNNDNVKLSIPLSILSEGKDFAVKLNRMSDMSNAKSPVYEFTIIIDGKEIHQFVEPITLTFNVDPSKVKNTNNLKVYYYNETAKVWELVPGATYSNGKVEVKTNHFSIFTVFEVAGNQTQLSASTPTPVKGKDLPNTATNMYNFLILGILFVAAGLTVVIRRRRKLQA

SEQ ID NO: 26334 - protein, 432 aa, Bacillus bataviensis LMG 21833
MPFIADVYAREVLDSRGNPTVEVEVFTESGAFGRALVPSGASTGEYEAVELRDGDKERYLGKGVLKAVDNVNEIIAPHLVGEEYSVLDQVAVDQALIELDGTENKGKLGANAILGVSMAVAHAAANYLDIPLYQYLGGFNSKQLPVPMMNIVNGGEHADNNVDIQEFMIMPVGAPSFKEALRMGAEIFHTLKTVLKGKGLNTAVGDEGGFAPNLGSNEEALQTIVEAIEKAGYKPGEEVMLAMDAASSEFYNKEDGKYHLAGEGVVKTSAEMVDWYEQLANKYPIISIEDGLDENDWEGHKLLTERLGKKVQLVGDDLFVTNTKKLAEGIKKGIGNSILIKVNQIGTLTETFDAIEMAKRAGYTAVISHRSGETEDNTIADIAVATNAGQIKTGAPSRTDRVAKYNQLLRIEDQLGETSQYNGLKSFYNLSK

SEQ ID NO: 26335 - protein, 544 aa, Bacillus caldolyticus
MNKRAMLGAIGLAFGLMAWPFGASAKGKSMVWNEQWKTPSFVSGSLLGRCSQELVYRYLDQEKNTFQLGGQARERLSLIGNKLDELGHTVMRFEQAIAASLCMGAVLVAHVNDGELSSLSGTLIPNLDKRTLKTEAAISIQQAEMIAKQDVADRVTKERPAAEEGKPTRLVIYPDEETPRLAYEVNVRFLTPVPGNWIYMIDAADGKVLNKWNQMDEAKPGGAQPVAGTSTVGVGRGVLGDQKYINTTYSSYYGYYYLQDNTRGSGIFTYDGRNRTVLPGSLWADGDNQFFASYDAAAVDAHYYAGVVYDYYKNVHGRLSYDGSNAAIRSTVHYGRGYNNAFWNGSQMVYGDGDGQTFLPFSGGIDVVGHELTHAVTDYTAGLVYQNESGAINEAMSDIFGTLVEFYANRNPDWEIGEDIYTPGVAGDALRSMSDPAKYGDPDHYSKRYTGTQDNGGVHTNSGIINKAAYLLSQGGVHYGVSVTGIGRDKMGKIFYRALVYYLTPTSNFSQLRAACVQAAADLYGSTSQEVNSVKQAFNAVGVY

SEQ ID NO: 26336 - protein, 546 aa, Bacillus caldolyticus
MDKRAMLGAIGLAFGLMAWPFGASAKEKSMVWNEQWKTPSFVSGSLLKGEDAPEELVYRYLDQEKNTFQLGGQARERLSLIGKQTDELGHTVMRFEQRYRGIPVYGAVLVAHVNDGELSSLSGTLIPNLDKRTLKTEAAISIQQAEMIAKQDVADAVTKERPAAEEGKPTRLVIYPDGETPRLAYEVNVRFLTPVPGNWIYMIDAADGKVLNKWNQMDEAKPGGGQPVAGTSTVGVGRGVLGDQKYINTTYSSYYGYYYLQDNTRGSGIFTYDGRNRTVLPGSLWADGDNQFFASYDAAAVDAHYYAGVVYDYYKNVHGRLSYDGSNAAIRSTVHYGRGYNNAFWNGSQMVYGDGDGQTFLPFSGGIDVVGHELTHAVTDYTAGLVYQNESGAINEAMSDIFGTLVEFYANRNPDWEIGEDIYTPGIAGDALRSMSDPAKYGDPDHYSKRYTGTQDNGGVHTNSGIINKAAYLLSQGGVHYGVSVTGIGRDKMGKIFYRALVYYLTPTSNFSQLRAACVQAAADLYGSTSQEVNSVKQAFNAVGVY

SEQ ID NO: 26337 - protein, 428 aa, Bacillus cellulosilyticus
  strain ATCC 21833 / DSM 2522 / FERM P-1141 / JCM 9156 / N-4
MTIISDVYARQVLDSRGNPTVEVEVYLEDGGFGRALVPSGASTGEYEAVELRDGGDAWMGKGVTQAVANVNDVIAPELVGFDALDQVGIDELMIDLDGTENKGKLGANAILGVSMAVAHAAADSLGVPLYVYLGGFNAKTLPTPMMNIINGGEHADNNVDIQEFMVMPVGAETFQQALQMGAEIFHNLKSVLKGKGYNTAVGDEGGFAPNLGSNEEALSTIIEAIEKAGYKPGEEVLLAMDVAASEIYEDGKYNLKGEGVVKTSAEMVDFYEDLCSKYPIVSIEDGLDENDWEGFKLLTERLGGKVQLVGDDLFVTNTNKLSQGIEQGIGNSILIKVNQIGTLTETFDAIEMAKRAGYTAVISHRSGETEDATIADIAVATNAGQIKTGAPSRTDRVAKYNQLLRIEDELQFIGRYAGKSAFYNLKNL

SEQ ID NO: 26338 - protein, 189 aa, Bacillus cellulosilyticus
  strain ATCC 21833 / DSM 2522 / FERM P-1141 / JCM 9156 / N-4
MRKLCLLIITGLIVFTVACSDSNENDADHNDESTVDEETENIEQDNIDSYESKDEVLSIGDTGRMIDTLGEYEITIKEVEITDDIAENTPNMDRFIEIDLEIENVGDTLLDGIDLINTNLFDEEDRMQENRFYREYINNVEGEIQPGEILTGQILFEHHDSSFYRLVFGWGLSSVSNELTWHFTADEAN

SEQ ID NO: 26339 - protein, 188 aa, Bacillus cellulosilyticus
  strain ATCC 21833 / DSM 2522 / FERM P-1141 / JCM 9156 / N-4
MRKLCLLIITGLIVFTVACGDSNVNYVELNDESTLDEETENIEQDDSYESKDEVLSIGDTGRMIDTLGEYEITVHSAKAFKEIEGNTPTMDVYVVVDVSFKNIGDEELFANDVKRTHLFSDNELPQENLFFIEFIDDIDGEINPGETVTGQLIFEQNDSDFYELIFGWGLSTVSNELTWHFTREEVNE

SEQ ID NO: 26340 - protein, 188 aa, Bacillus cellulosilyticus
  strain ATCC 21833 / DSM 2522 / FERM P-1141 / JCM 9156 / N-4
MRKLCLLIITSLIVFTVACGDSNVNDVELNDESTVDEETENIEQDDSYESKDEVLSIGDTGRMIDTLGEYEVTIHSVEITEEIQGNTPMEDVYVIVDLSIKNIGDEILEVQDIIGTHLFSDDDLPSGNMFYVDFIDEIDGEISYGETVSGQILFDQIYSEYYNLVFGWGLSTVSNELTWHFTRDEVNE

SEQ ID NO: 26341 - protein, 749 aa, Bacillus cellulosilyticus
  strain ATCC 21833 / DSM 2522 / FERM P-1141 / JCM 9156 / N-4
MFKQLVWGKKKLLVTLVLLLLLGTIAPSIIGAGGQAQNSGPTVIMNAGDLYDVQYNLDGDYILGADINLSVYPNWVPLGGDFNGSPFTGTFDGNGYKITGLTISRWNENNLGLFGEVVHGEIKNVTVEAGLFRGNDNIGGLVGNMVGGVIENSHVTNGYFVAENYVGGLVGRYNGTTIVDSSANVSIEGFGNYVGGLMGGGQFGTIDNSFATGDVEGVSFVGGLLGGNANGEVTNSYATGDVLGDSSVGGLIGIFMGGGGSFYYVKQSYASGNVEGDLNVGGLVGTVDGPTRLENTYAIGDVHGNERAGGLVGLNRGGITHSFSVGRVSGDPGGLVGTNTGTVTASYYDTETSGQSDDDKGQPKTTAEMHDQNTFTDWDFTTIWDINPGNYPHLRLSGETEPVPLTVSAIPSLNNINVALGTELDTIFFPQEVEVSLNDGSKKTIPVQWDKENTSFDKNSPGEYVFNGELDLPENISNPNNLMASITIVLEDEVSPLEVIQVSDLNDIVVDLGTSVGELPLPSTVEVLLSDESVNTVPVEWDNGTPSYDGENEGEYIFTGELLISDVALNPQNLASRVKVTVMETEQDLIVESVEEIETIVLKYGTELATHIFPSEVEVALNNGMSRKVHVTWNEGSPVFDPYSSTEYTFLGELHLTEGITNPNQIMAMITVVVLPEEHTETEKPSKPVDEEPTNENTVDVPPTETKEESTDGKLPSTATTTYNILLIGLILLIIGGVFLKRRLLKVED

SEQ ID NO: 26342 - protein, 492 aa, Bacillus cellulosilyticus
  strain ATCC 21833 / DSM 2522 / FERM P-1141 / JCM 9156 / N-4
MKVVRTKTVSLMMAGALVISPLLSTLLIPTKISAEDIIVNNEEVISEEYLESDIEESESLEEEHQTSEANDEEVAEEEPIEEEPQENEYQAGDSTDGENDSSTDSENGEDGDGENYEDAPPSTEEDDLIEEEDSDIEENGNDEETIEEEEEASDEEEFEYFSPSKIELNESTISFAHPLSLDKRTMVAVYLDNHLMNDEDFKVYESLFISADDMSNMIETGSYLVLMLEEELDSWFHNSLVIPSSIFSGNEDVLITKKILNSGVSEIEKTEGAFQLTITEGNETIDTFEEPILIETVVISEEEIPTLQHHYYQDGYWFNQDQNGMSYNGVYWQGDYYDLQYEYEYDNDGQVIVYGLLVYGSIYHTGIFGLAEEGALTLGSWTEPEDPEENDPTEEDPSNNQPDEDPIVDEEEGSETGETETNEESGSTDEDKVATPVSSSSDNNDNGNTTLPNTATNVYNQLLLGAILILGGGVVLFGSRKIKRRQRPYVIS

SEQ ID NO: 26343 - protein, 1622 aa, Bacillus cellulosilyticus
  strain ATCC 21833 / DSM 2522 / FERM P-1141 / JCM 9156 / N-4
MGKAKKHIKRPSIIGMVLLILFYTVLPASTVTADACSYSGARAVYGGEHGTELFLGGNYIELGISNWGDFGTLGEKPSNFRGTLNGETTPHLGSNMIGMSADHDGFCNGRDLPVDYYLPGTPEERFAVGYQIGSTKNANSNSAQMGTRNMPTTVTNESNVEQGILKARTVSIWAGTMEITQVISFRVDDKFYRNDVTIKNITAHAWDGARYMRTFDPDNSQYRGGPFVTANTVTHTIAEDGKSVIKAETFQNHDPLYTAFNSRIPIFFYSNDPAARASVFGFTNTNPYEPAAYDNPSAKGQTIQADQAITMTWDSGPLHAGESKTFTYYTSLDERDFDDVQKEIFIDDVKKDIENLDDMDDVKKVKDKIDNEDSLEEEKKKELKSDVLDILIDGEKDILIRDARDIFVVRDLINESDKDDEEKDDIRKKYVKKILDDLEELSPEEEEATRAIIDDIVDPTKKAEAEDTLNSLADLIAAAEEALEEAEKTQDRYKDTGGDASDELYEEVAAAKEALNEALLADPADKDAIESATEALHDATKKLEEAAEQKELANAKAAGEEALEEAEKTQERYKNAGGDASDDIFEQLETAKEALNEALLADPADKDAIESATEALNDATKKLEEAAEQKELENAKAAGEEALEEAEKAQDRYKNAGGDATDEIYEALEAAKEVLEAAKLADPANKEAIEAATEEVTDLTTVLEKAIDAKELENAKFAGEKALEEAEKAQDRYENAGGETSDDLYEAVEAAKEALKEVLLADPAEKDAIEAATEALIDETKKLEEAVEAKELANAKAAGEEALEKTEKAQDRYYNAGGEESDELYEAVEAAKEVLNNALQATPAEKEAIEAATEALNDATKKLEEAAEAKELANAKAAGEEALQEATKAKDRYYNAGGEESDELYEVVEAAKEVLNNALQATPVEKDAIEAATEALNDATKKLEEAAEQKELENAKAAGEDALDEAEKAHDRYKKSGGEASDELYEAVEEAKNTLQEALHQDPLNKETIEEATALLEAAILELNMETTTKDLETDITNVDSIDQLLEVKQKIDSSDISEDRKAHLYTNLVNKWLETKTSFSFVDEDQVQQLVDAVEQSDKEETEKQQAYIALIENAIDDVAKHDKPVNAETKFQQPENKVIELAIQNVTSDEEKQRLTTLLELTVDARALSMQTAFTFAEGDTWESITSKFIMLAEGNYGSNITWESSKNDIITVSGENAEVQRQTRDESVILTATLTNGVAQLEKTFLLVVKSNRVGDKLFEEVKREVTVEVGSNLNKPPAIQRINLLDSSNTTIVNKIDKLIIDNAIISQVTSGPITIYLPDDTSNLADEIAVEISLDVLEKIQDSLTIKTDQGSIILSKETIEKMQQDGKDLFFRIVPVRQTDERNDVIERTKNHELVIAELEAGQEIVVLGTPREIETNYKGYETTVILPLDDVEYTNIDNLRIFIEHTDGDRRVVNGEVVVDENGTPVGLQFVIDKFSTFTIFEIVQSEEVDTPGEGTPPVEDNESPGSETTPGSGSETPGLEPTPGSGSESPVTDTTPGIGSDATVENDSAGSEGKGGENKTGEKAAGADALTDAVAADTDNLPSTATNNYNMLLLGTVLTIMGVISLYYRKKRTA

SEQ ID NO: 26344 - protein, 409 aa, Bacillus cellulosilyticus
  strain ATCC 21833 / DSM 2522 / FERM P-1141 / JCM 9156 / N-4
MKKITTIFVVLLMTLALFIIGNTTAADDYSVVEEHGQLSISNGELVNDRGEPVQLKGMSSHGLQWYGQFVNYESMKWLRDDWGITVFRAAMYTSSGGYIEDPSVKEKVKEAVEAAIDLGIYVIIDWHILSDNDPNIYKEEAKDFFDEMSELYGDYPNVIYEIANEPNGSDVTWDNQIKPYAEEVIPVIRNNDPNNIIIVGTGTWSQDVHHAADNQLTDPNVMYAFHFYAGTHGQNLRDQVDYALDQGAAIFVSEWGTSAATGDGGVFLDEAQVWIDFMDERNLSWANWSLTHKDESSAALMPGASPTGGWTEAELSPSGTFVREKIRESATTPPSDPTPPSDPDPGEPEPDPGEPDPTPPSDPGDYPAWDPNTIYTDEIVYHNGQLWQAKWWTQNQEPGDPYGPWEPLN

SEQ ID NO: 26345 - protein, 488 aa, Bacillus cellulosilyticus
  strain ATCC 21833 / DSM 2522 / FERM P-1141 / JCM 9156 / N-4
MKKLTTIFIVFTLALLFVGNSTSANNGSVVEQNGQLSIQNGQLVNEHGDPVQLKGMSSHGLQWYGQFVNYDSIKWLRDDWGITVFRAAMYTSSGGYIEDPSVKEKVKEAVEAAIDLGIYVIIDWHILSDNDPNIYKEEAKEFFDEMSALYGDYPNVIYEIANEPNGHNVRWDSHIKPYAEEVIPVIRANDPNNIVIVGTATWSQDVHEAADNQLDDPNVMYAFHFYAGTHGQQLRNQVDYALSRGAAIFVSEWGTSAATGDGGVFLDEAQVWIDFMDERNLSWANWSLTHKDESSAALMPGANPTGGWTAAELSPSGAFVREKIRESASIPPSDPTPPSDPDPGEPDPTPPSDPGEYPAWDPNQIYTNEIVYHNGQLWQAKWWTQNQEPGANQYGPWEPLGDAPPSEPSDPPPPSEPEPDPGEPDPGEPDPGEPDPTPPSDPGEYPAWDPTQIYTNEIVYHNGQLWQAKWWTQNQEPGYPYGPWEPLN

SEQ ID NO: 26346 - protein, 164 aa, Bacillus cellulosilyticus
  strain ATCC 21833 / DSM 2522 / FERM P-1141 / JCM 9156 / N-4
MKKSLLVLIVVLLSSFLLACSGETLGKGKAKEVEVNESINYHDEFEYTVLSIVRTDSYEYESSFGAPATLEAEEGKEIVILNIEVTNISDEEQGAFQSLHLLDGNQVNYQKVLFSKDSLSTTTPLLPGGKTSGPVIYEVTKGNELEFRIATLGGDPVEQTIILP

SEQ ID NO: 26347 - protein, 630 aa, Bacillus cellulosilyticus
  strain ATCC 21833 / DSM 2522 / FERM P-1141 / JCM 9156 / N-4
MKKLMVLGLATFLLFSMFVNTAFSNEHHDNDDFKSVVYYISWAAQEYDNEGNEARDFFVHDMDATNVTHINYAFAKIVGDDRPESDLVNGNCLPPEEIAEYDGDDRVDHLNCDDVHRVTFGDPDVDIGENVSAEDAWEGNFEGNFRDLIAFKEDNPHVQTLISIGGWTMSNYFSDMALTEESREIFIDSVIEFIRVFEFDGVDLDWEYPGYGGEWHNDPYPEDKENFTHLLRELREALDEAGEEDDTYYPLTIAVAANVGNYAANTEMPEIMEYLDWINLMTYDMSGPWDRHDFDGEGLPWGEQPFISGFNAPLYQDPLDPWGSWLTVEGTVDAYLEVGIDPKDMVLGLAFYGRTWASCEAERNNGMFDKCFEDEDGIVAGPGTWERGVLDYWDIKENYVDQNGFVRYWSEDALVPWLYNEETGEVITYDDEESIGYKMQFVLERGLGGSMVWEITQDRDGAMMETIGSYLFAGDPGEGEGPGEGEGPGEGEGPGEGEGPGEGEGPGEGEGPGEGEGPGEGEGPGEGEGPGEGEGPGEGEGPGEGEGPGEGEGPGEGEGPGEGEGPGEGEGPGEGEDPGEDEESAGDKEGDKLPETATTMYNWLLIGAMLLIVGFTFLFISRKRKLQTTD

SEQ ID NO: 26348 - protein, 1150 aa, Bacillus cellulosilyticus
  strain ATCC 21833 / DSM 2522 / FERM P-1141 / JCM 9156 / N-4
MVRNKVIVLFSVFTLLFSVFAPGLSPQNVKAVGTEEVEDVVETKGDRSPNPEDDGWELTFADEFDGDEINMDNWSFDEPTNGRWNGEIQSYTENNAKVEDGNLIIWADKEDITEPDGQVYNYSSSKLWTKDKQTLTYGRVDVKAKLPEGQGMWPAIWMMPNDEPFYGTWPVSGEIDIMELLGHEPDTVHGAIHFGRPHQERQGTFILEDGTTFADDYHVFSIEWEPGEIRWYVNDIHFHTANDWFTKHPDNADAYTYPAPFDQPFMLILNISVGGGWPGNPDETTVFPQQMKVDYVRFYEKDEYPVHEKPESAEEREGRAPLEDGNYVYNGSFDSNDPEVEGIEGVPYTDYWTFLKAGGGNASLQVNDGALDIQIDSGGDVEHGIQVLQAPIHLIEGATYRASFSAKAENERPLKVKIGGDGDAGWADYAGKDPITLSTSWEDYEFEFKMENLTDVKARYEFNMGLNNSNVSLKDVRLEKIADPDPADMIRGPLPTGNYIFNGTFDQGEGRMGFWEFNTDETAEATHYIGSAINERRFDALISNGGNNVDSVQLSQSGFTLENGREYELTFDASAEAERDIQVALTNLNSEVVYEETISLTTSTEKHTIEFSVDSETDNNSELQFNLGGNNNNVYIDNVFLKKLPLDIEVGNLLKNGIFDGLASWRAEAFNPGQATFSVEDGMAKAAITNIGTADWNIQLFQEGVNIEQDVTYEVSFDAKSTVDRPLHVQIQRNGEHHGDDDWTVYFEETASLTDTLQTFTYSFTMNEDSDPVSKFGFPLGKDAEGLIPSEAHDVFIDNVSVRKVDGEVEDPGTEDPGTEDPGTEDPDAPEERPMGEEFFEDFASHDEDRWSMAGVWTNGDMFNTTWYPEQVTFNDGKMQLTLDHDENASETGIPYKSGELRTNDFYHFGLYEVSMKPVASEGTVSSFFTYTGEWDWDGDPWDEIDIEFLGKDTTRIQFNYFTDGVGGNEYYHDLGFDASESFNTYAFEWREDSITWFVNGEAVYTATENIPQTPQKIMMNLWPGIGVDGWTGVFDDADIPLVAEYDWVRFTPLEELSHDPIIVEPETPETPETPETPETPETPETPESDDDSKDESDEDGDSEETSKEGSKDGDALPSTATNAYNYLLVGMLLLVIGGVSFFIRRKQLG

SEQ ID NO: 26349 - protein, 1166 aa, Bacillus cellulosilyticus
  strain ATCC 21833 / DSM 2522 / FERM P-1141 / JCM 9156 / N-4
MKRRHVKLFFIQLLVILLVLPPGIMTAQSSVEAIGSFEREIIAEYHFDDGTTQGWFGREANLEVVDNEAHSGEYSLFVDGRTEGWNSPALDLQGMLEIGATYEIAGYMKRAEATSEEKLVMAMIDQSVGEDAQYNWINSRETSQTDWVELRGEYTITDEKEDLVLYFEIENNTENFYIDSISITKISPADDSFVPEIVAEFDFEDGTTQGWFGRGITPKVVQGNGQSGEHSIFVEGRTENWHSPALNVRELFEIGATYEITGHMKRATTTEEDGNLVMAMIDQSIGGDANYNWIDNKRVTHDNWVALSGEYSITEEKGELTLYFEIEGNTEDFYINTITITMISPPTETGDDDIIDVPVEERVAAFTDFEDGTTQGWEPREGPEELTVTTDTAKNGERSLLISNRQGSFHSAKLDFLDHMYAGHTYDISVWVKLAPGETPTSLQISRAETISGSTNYYPPVINPTEVTADEWVLLQGTYTLTGNVSDLYFYVEEPYDENQETGVSFYIDDFKAEVRVPDELEDIAPLKDVFADHFDIGAAVEPRHTAGQHGKMLEKHYNMLVAENIMKPESIQPTEGEFNWVNADAMFDYAEENGLKVRFHTLVWHSQSPSWMFLDANGDPMVVDGVVADPDNLEANKALLLQRIEDHVHAVVGRYGDRVDSWDVVNEVIVPTEEDGFRKSEYYLITGTEFIHKAFEATAEALAALGDDVHPNAKLYYNDYNTHNPQKREFIYEMVKEMQNEGIPIDGIGHQTHLNINSSIELVIASIERFTELGLDNQITELDISIYTGNNEAFFSYADIPASKHEEVAMAYGELFKQLRGVSDQVSSVVFWGIADDHTWLHGRGVANRVDAPFVFDQDLKAKEAYYTVIDDNYVAPERPSIPEPKSEIAYYGTPTINGELDDIWQIATVFETDTWVEGESGSTASVRALWDDEYLYVFAEVTDSQLSNVSNNEWEQDSVEIFVDQNNEKTNYYQLDDGQFRVNFENEVSINGFGSDTFRSATAITEEGYIVEAAIKLEAIEPVEGTVIGFDIQVNNDENGDGVRNSVVTWNDPTGESYQSTSQFGELQFVLEPETDQEKPVDDPLKPGDQERKPSTPGEEDSLVIGGEGGSERQHETEEGSKGDELPRTATNNYNMIALGSLLLLLGTTILIVFRRKNKVTIRE

SEQ ID NO: 26350 - protein, 414 aa, Bacillus cellulosilyticus
  strain ATCC 21833 / DSM 2522 / FERM P-1141 / JCM 9156 / N-4
MIAESMQVRLQSLGKMMITALVTTLLAIAFFAFTAESASAHGYVENSRAHLCAEGVNTDCGRVIYEPFSVEGRGDFPHEGVPDGQLASAGLFLELDEQSYDRWEKVDMQGGPFTFEWHIHANHSTNTWDYYITREGWNPNEPLARADLELFCTYRDYGALPPDHVTNDCVIPNDRDGYHVILAVWDIDDTMNAFYQAIDVNLSINPSEPSTPEPGFPGDPDRFGEYDYWNTIKAYTEGDIVIHNGQLWEARWYSRNDEPGTNPNGPWLLLGDYEPSDPGEPSDPGEPSDPGEPSDPGEPSDPGEPSDPGEPSDPGEPSDPGEPSDPGEPSDPGEPSDPGEPSDPGEPSDPGEPSDPGEPSDPGEPSDPGEYPAWDPDTIYTNEIVYHNGQLWQAKWWTRNQEPGDPYGPWEPLN

SEQ ID NO: 26351 - protein, 953 aa, Bacillus cellulosilyticus
  strain ATCC 21833 / DSM 2522 / FERM P-1141 / JCM 9156 / N-4
MRNKLRRLLAIMMAVLLITSLFAPMVSAEEGDNGDDDDLVTPIEIEERPHESNYEKYPALLDGGLDERRPSEAGALQLVEVDGQVTLADQDGVPIQLRGMSTHGLQWFGEIVNENAFAALANDWGSNVIRLALYIGENGYAYNPDLIEKVYAGIELAKENDMYVIIDWHVHAPGDPNADIYQGGVNEDGEEYLGAKDFFLHIAEKYPNDPHLIYELANEPSSNSSGGPGITNDEDGWEAVREYAQPIVDALRDSGNAEDNIIIVGSPNWSQRMDLAADNPIDDHHTMYTLHFYTGTHEGTNESYPEGISSEDRSNVMANAKYALDKGKAIFATEWGVSEADGNNGPYLNEADVWLNFLNENNISWTNWSLTNKNETSGAFTPFILNESDATDLDPGEDQVWSMEELSVSGEYVRSRILGEEYQPIDRTPREEFSEVIWDFNDGTTQGFVQNSDSPVDVTIENVNDALQITGLDESNAIAGEEEDYWSNVRISADEWEETFDILGAEELSMDVVVDDPTTVAIAAIPQSSAHEWANASNSVLITEDDFEEQEDGTYKALLTITGEDAPNLTNIAEDPEGSELNNIILFVGTENADVISLDNITVTGDRESVPEPVEHDTKGDSALPSDFEDGTRQGWEWDSESAVRTALTIEEANGSNALSWEYAYPEVKPSDDWATAPRLTLYKDDLVRGDYEFVAFDFYIDPIEDRATEGAIDINLIFQPPAAGYWAQASETFEIDLEELDSATVTDDGLYHYEVEINIEDIENDIELRNLMLIFADDESDFAGRVFLDNVRMDMSLETKVEVLERNINELQEQLVEVEASNEEQIAQLETQIADLEAQLSDLADESVVADLLEVIASLEAQLNDLEAQVNELKSETGESTQSDSSAEESAEDEGSEASEADEEKQAAEEEKEGDRLPDTATNTFNFLIIGALLLMSGVAFFVIQRRKVATN

SEQ ID NO: 26352 - protein, 456 aa, Bacillus cereus
MNKKILGQFRKMATNKKGLSAAAVAVGIMSTTLIPQNTYAHGFVEKPGSRAALCSQNYGALNSNCGNIMYEPQSLEAPKGFPQGGPADGKIASAGGLFGGILDQQTADRWFKNTIKGGENTFTWKYTAPHSTSQWHYYITKKGWNPNKPLTRADFEPIGTVKHDGSKASNNLSHKINVPTDRSGYHVILAVWDVADTVNAFYNVIDVNLINDEKPDTEAPAQPSGLQVVKTTSNSVELNWKPATDNVGVKEYQVLRNGELINTVVGTSVIDKKLNPNTEYTYTVRAVDAAGNISEKSEALVIKTTEEKPDTEAPTQPKGLHSMGTTTSSIDLMWSPSEDNVDVSHYIVYREVGGAMKEIGTANTTSFMDKDLQANTVYKYVVSAVDTSGNESMKSDAITVTTKGQENSYEQWDARKAYKAGDRVVHENKVYEAVQSYQGNGDPNWIFALSLWKEVN

SEQ ID NO: 26353 - protein, 175 aa, Bacillus cereus
MKKLLASATAFTLLTVGYSSAAFAEKNPNDKNCSHFKNKQEVMEFWHSNGYSATNDPHDLDRDNDGLPCEVKKGDYDQFLASKQPTKKDENKPQEQVKQENTKQEPVKQENTQQNNQATTNKQEQTKQTAVKAETKKQGEKLPNTASNGVTMMLASAGLVLAGSILIFRRKKTNA

SEQ ID NO: 26354 - protein, 639 aa, Bacillus cereus
MSDENEKKYSNELAQADFISAAAFDPSLVGPTLPPTPPFTLPTGPTGATGPTGATGPTGATGSTGVTGPTGVTGPTGATGPTGATGSTGVTGPTGATGPSGATGSTGTTGPTGDTGPTGITGPTGVTGPTGATGPTGATGPTGATGSTGVTGPTGVTGPTGATGPTGATGSTGVTGPTGITGPTGATGTTGSTGPTGVTGPTGATGPTGATGPTGATGSTGVTGPTGITGPTGATGTTGSTGPTGVTGPTGATGPTGATGPTGATGSTGVTGPTGVTGPTGATGPTGATGSTGVTGPTGATGPTGATGSTGVTGPTGVTGPTGATGSTGATGPTGATGSTGVTGPTGATGPTGATGPTGATGSTGVTGPTGITGPTGATGTTGSTGPTGVTGPTGVTGPTGVTGPTGATGPTGATGSTGVTGPTGITGPTGATGTTGSTGPTGVTGPTGVTGPTGATGPTGVTGPTGATGPTGATGATATTSTKAILFGGTNAGFQRIAGSPGADSQTLPYVTAGAGSVVAFSASINVNNLGTGVYLLRVCDNVPTNLASPGAGQIVSTITLTLTANITGTIVFSIKPTDIGAQPVKVFNPNPVVAPATVTWTSTIPGNPVARTDAISLFITPGITQSAVYSVFISTAV

SEQ ID NO: 26355 - protein, 238 aa, Bacillus cereus
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDHFVHVIGTHLQAEDSMCGKTSPASVRTDQLKEIQDFIKNKNIPNNEYVLIGGDMNVNKINAENKSDSEY

SEQ ID NO: 26356 - protein, 243 aa, Bacillus cereus
  MOD_RES (213)..(213): Any amino acid
MKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPXDEYVLFGGDMNVKKVNAENNSDSEYASMFK

SEQ ID NO: 26357 - protein, 769 aa, Bacillus cereus
MKNMKKKLASVVTCTLLAPMFFNGNVNTAYADNKINQDSSKQEYQQKEMDRKGLLGYYFKDKDFSNLTMFSPTRYNTLIYDQQTANKLLDKKQQEYQSIRWIGLIQSNKTGDFTFELSDDECAIIEMDGKVISNKGKEKQVVHLEKGKLVPIKIEYQLDEPLNIDDEKFKGFKLLKVDNQKQLHQVQQDELRNPEFNKKESQEFLAKASKINLFTKKIKRDIDEGTDTDGDSIPDMWEENGYTIQNRIAVKWNDSLASKGYTKFVSNPLDSHTVGDPYTDYEKASRDLDLSNAKETFNPLVAAFPSVNVSMEKVILSPNKNLSNSVESHSSTNWSYTNTEGASVEAGIGPKGFSFGVSANYQHSETVAQEWGASIGDTTQLNTASAGYLNANVRYNNVGTGAIYDVKPTTSFVLEKNTIATITAKSNSTALSISPGESYPKKGQNGIAITSMDDFNSHPITLNKKQLDQVLTNNPIMLETDQTDGIYKIKDTHGNIVTGGTWNGVTQQIKAKTASIIVDDGKQVAEKRVAAKDYAYPEDKTPSLTLKDALKLSFPEEIKETDGLLYYNNKPIYESSVMTYLDGNTAKEVKKQINDKTGEFKDVQHLYAVKLTPKMNFTIKVPVAYDTAKQAVNLGGDNPWGAKGLLGTWVNAMVVDNSGDKAYKRVEPGYLLSPTLEFSEGSLDNLKKNYSFYVSMYVKSDKPFTLRINAGPYSTKRTIEASNDFKRVDIPAFYIEGFPIDTIRLEGSDYPSAIWWKDVSITEVSAVKK

SEQ ID NO: 26358 - protein, 462 aa, Bacillus cereus
MKRMEGKLFMVSKKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTNPTKAGVILDGNEHKMLIDNGYVLHVDKVSKVVKKGLECLQVEGTLKKSLDFKNDISAKAHSWGMKNYEEWAANLTDSQRKALDGYARQDYKKINDYLRNQGGSGNEQLDAQIKNISETLNNKPIPENITVYRWCGMPEFGYQISEPLPALKDFEWEFLNTIKEDKGYISTSLSSERLAAFGSRKIILRLQIPKGSKGAYLSAIGGFANEKEILLDKDSKYHINKITEVVIKGIKRYVVDATLLTN

SEQ ID NO: 26359 - protein, 75 aa, Bacillus cereus
MKRSKTYLKCLALSAVFASSAVTLSTPAAYAQTTSQVVTDIGQNAKTHTSYNTFNNDQTDNMTMSLKVTFIDDPS

SEQ ID NO: 26360 - protein, 75 aa, Bacillus cereus
MKRSKTYLKCLALSAVFASSALVLSTPAAYAQTTSQVVTDIGQNAKTHTSYNTFNNDQTDNMTMSLKVTFIDDPS

SEQ ID NO: 26361 - protein, 75 aa, Bacillus cereus
MKRSKTYLKCLALSAVFASSAVTLSTPAAYAQTTSQVVTDIGQNAKTHTSYNTFNNDQADNMTMSLKVTFIDDPS

SEQ ID NO: 26362 - protein, 412 aa, Bacillus cereus
MKKAKGIAKSVAVASVIMSGSLGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKAPEEQMIGINNVNNQLNKGKGKLSFSMNGNQLKATSSNAGYGISYEDKNWGIFVNGEKVYTFNEKTTVGNISNDINKLNIKGPYIEIKKI

SEQ ID NO: 26363 - protein, 143 aa, Bacillus cereus
SFASFMLGSFQGGALAEGTKGEQVSYRNVLKMEPVGVQLPVQELAHSSKVLENKSFEKRLQFADLSQRPPEVKKKSKQLTAAKTYTIAELNQLSNQQLVDLLVTIDWEQITGLFQFNKDSLAFYQNDSRMQAIIDKLKQQGQA

SEQ ID NO: 26364 - protein, 566 aa, Bacillus cereus
MKKKSLALVLATGMAVTTFGGTGSAFADSKNVLSTKKYNETVQSPEFISGDLTEATGKKAESVVFDYLNAAKGDYKLGEKSAQDSFKVKQVKKDAVTDSTVVRMQQVYEGVPVWGSTQVAHVSKDGSLKVLSGTVAPDLDKKEKLKNKNKIEGAKAIEIAQQDLGVTPKYEVEPKADLYVYQNGEETTYAYVVNLNFLDPSPGNYYYFIEADSGKVLNKFNTIDHVTNDDKSPVKQEAPKQDAKAVVKPVTGTNKVGTGKGVLGDTKSLNTTLSGSSYYLQDNTRGATIFTYDAKNRSTLPGTLWADADNVFNAAYDAAAVDAHYYAGKTYDYYKATFNRNSINDAGAPLKSTVHYGSNYNNAFWNGSQMVYGDGDGVTFTSLSGGIDVIGHELTHAVTENSSNLIYQNESGALNEAISDIFGTLVEFYDNRNPDWEIGEDIYTPGKAGDALRSMSDPTKYGDPDHYSKRYTGSSDNGGVHTNSGIINKQAYLLANGGTHYGVTVTGIGKDKLGAIYYRANTQYFTQSTTFSQARAGAVQAAADLYGANSAEVAAVKQSFSAVGVN

SEQ ID NO: 26365 - protein, 333 aa, Bacillus cereus
MKGKLLKGVLSFGIGLGVLYGGSSVQADTSTDQNNTLKVMTHNVYMLSTNLYPNWGQSQRADLIGAADYIKNQDVVILNEVFDNSASDRLLGNLKKEYPNQTAVLGRSNGNEWDKTLGSYSSSTPEDGGVAIVSKWPIVEKIQYVFAKGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYDDYSDHYPVAATISMK

SEQ ID NO: 26366 - protein, 14 aa, Bacillus cereus
SCTTCVCTCSCCTT

SEQ ID NO: 26367 - protein, 306 aa, Bacillus cereus
MKNKKMLKIGMCVGILGLSITSLVTFTGGALQVEAKEKTGQVKHKNQATHKEFSQLEKKFDARLGVYAIDTGTNQTIAYRPNERFAFASTYKALAAGVLLQQNSTKKLDEVITYTKEDLVDYSPVTEKHVDTGMTLGEIAEAAVRYSDNTAGNILFHKIGGPKGYEKALRKMGDRVTMSDRFETELNEAIPGDIRDTSTAKAIARNLKDFTVGNALPHQKRNILTEWMKGNATGDKLIRAGVPTDWVDADKSGAGSYGTRNDIAIVWPPNRSPIIIAILSSKDEKEATYDNQLIKEAAEVVIDAIK

SEQ ID NO: 26368 - protein, 333 aa, Bacillus cereus
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTNQLKEIQDFIKNKNIPNNEYVLIGGDMNVNKINAENNNDSEYASMFKTLNASVPSYTGHTATWDATTNSIAKYNFPDSPAEYLDYIIASKDHANPSYIENKVLQPKSPQWTVTSWFQKYTYNDYSDDYPVEATISMK

SEQ ID NO: 26369 - protein, 329 aa, Bacillus cereus
MSNKKLILKLFICSTIFITFVFALHDKRVVAASSVNELENWSKWMQPIPDSIPLARISIPGTHDSGTFKLQNPIKQVWGMTQEYDFRYQMDHGARIFDIRGRLTDDNTIVLHHGPLYLYVTLHEFINEAKQFLKDNPSETIIMSLKKEYEDMKGAEDSFSSTFEKKYFVDPIFLKTEGNIKLGDARGKIVLLKRYSGSNEPGGYNNFYWPDNETFTTTVNQNANVTVQDKYKVSYDEKVKSIKDTMDETMNNSEDLNHLYINFTSLSSGGTAWNSPYYYASYINPEIANYIKQKNPARVGWVIQDYINEKWSPLLYQEVIRANKSLIKE

SEQ ID NO: 26370 - protein, 333 aa, Bacillus cereus
MKGKLLKGVLSLGVGLGALYSGTSAQAEASTNQNDTLKVMTHNVYMLSTNLYPNWGQTERADLFGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTNQLKEIQDFIKNKNIPNNEYVLIGGDMNVNKINAENNNDSEYASMFKTLNASVPSYTGHTATWDATTNSIAKYNFPDSLAEYLDYIIASKDHANPSYIENKVLQPKSPQWTVTSWFKNIRIMITLIIIQVEATISMK

SEQ ID NO: 26371 - protein, 375 aa, Bacillus cereus
MIKKIPYKLLAVSTLLTITTANVVSPVATFASEIEQTNNGDTALSANEAKMKETLQKAGLFAKSMNAYSYMLIKNPDVNFEGITINGYVDLPGRIVQDQKNARAHAVTWDTKVKKQLLDTLTGIVEYDTTFDNYYETMVEAINTGDGETLKEGITDLRGEIQQNQKYAQQLIEELTKLRDSIGHDVRAFGSNKELLQSILKNQGADVDADQKRLEEVLGSVNYYKQLESDGFNVMKGAILGLPIIGGIIVGVARDNLGKLEPLLAELRQTVDYKVTLNRVVGVAYSNINEIDKALDDAINALTYMSTQWHDLDSQYSGVLGHIENAAQKADQNKFKFLKPNLNAAKDSWKTLRTDAVTLKEGIKELKVETVTPQK

SEQ ID NO: 26372 - protein, 91 aa, Bacillus cereus
EEKVPYNVLKTKPVGIEKSVDEVGHISKVDETLSFQERLKGDFSQRPASITKKTAVKQVKESYSMADLNKMNDRELVETLGSIKWHQYTDL

SEQ ID NO: 26373 - protein, 10 aa, Bacillus cereus
MRINTNINSM

SEQ ID NO: 26374 - protein, 336 aa, Bacillus cereus
MKRSKTYVKCLALSAVLASSALAMHTPVVAAQTTSQVVTDIGQNAKTHTSYNTFNNEQADNMTMSLKVTFIDDPSADKQIAVINTTGSFMKANPTLSDAPVDGYPIPGASVTLRYPSQYDIAMNLQDNTSRFFHVAPTNAVEETTVTSSVSYQLGGSIKASVTPSGPSGESGATGQVTWSDSVSYKQTSYKTNLIDQTNKHVKWNVFFNGYNNQNWGIYTRDSYHALYGNQLFMYSRTYPHETDARGNLVPMNDLPTLTNSGFSPGMIAVVISEKDTEQSSIQVAYTKHADDYTLRPGFTFGTGNWVGNNIKDVDQKTFNKSFVLDWKNKKLVEKK

SEQ ID NO: 26375 - protein, 336 aa, Bacillus cereus
MKRSKTYLKCLALSAVFASSAVTLSTPATYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKLFTLDWKNKKLVEKK

SEQ ID NO: 26376 - protein, 485 aa, Bacillus cereus
MKNFKGRKFLTCVLVSLCTLNYSSISFAETQAGHANDITKNASSIDTGIGNLTYNNQEVLAVNGDKVESFVPKESINSNGKFVVVDVRKNHLQRHQSIFRLLDSVANRTYPGAVQLANKAFADNQPSLLVAKRKPLNISIDLPGMRKENTITVQNPTYGNVAGAVDDLVSTWNEKYSATHTLPARMQYTESMVYSKAQIASALNVNAKYLDNSLNIDFNAVANGEKKVMVAAYKQIFYTVSAELPNNPSDLFDNSVTFGELTRKGVSNSAPPVMVSNVAYGRTVYVKLETTSKSKDVQAAFKALLKNNSVETSGQYKDIFEESTFTAVVLGGDAKEHNKVVTKDFNEIRNIIKDNAELSFKNPAYPISYTSTFLKDNATAAVHNNTDYIETTTTEYSSAKMTLDHYGAYVAQFDVSWDGFTFDQNGKEILTHKTWEGSGKDKTAHYSTVIPLPPNSKNIKIVARECTGLAWEWWRTIIKMNKMFH

SEQ ID NO: 26377 - protein, 476 aa, Bacillus cereus
MKEIIRNLVRLDVRSDVDENSKKTQELVEKLPHEVLELYKNVGGEIYITDKRLTQHEELSDSSHKDMFIVSSEGKSFPLREHFVFAKGGKEPSLIIHAEDYASHLSSVEVYYELGKAIIRDTFPLNQKELGNPKFINAINEVNQQKEGKGVNAKADEDGRDLLFGKELKKNLEHGQLVDLDLISGNLSEFQHVFAKSFALYYEPHYKEALKSYAPALFNYMLELDQMRFKEISDDVKEKNKNVLDFKWYTRKAESWGVQTFKNWKENLTISEKDIITGYTGSKYDPINEYLRKYDGEIIPNIGGDLDKKSKKALEKIENQIKNLDAALQKSKITENLIVYRRVSELQFGKKYEDYNLRQNGIINEEKVMELESNFKGQTFIQHNYMSTSLVQDPHQSYSNDRYPILLEITIPEGVHGAYIADMSEYPGQYEMLINRGYTFKYDKFSIVKPTREEDKGKEYLKVNLSIYLGNLNREK

SEQ ID NO: 26378 - protein, 252 aa, Bacillus cereus
MKSKSLKGVLSFGIGLGALYSGSSVQAETSTNQNNTLKVMTHNVYMLSTSLYPNWGQNERADLIGAADYMKNQDVVILNEVFDNNASNRLLGNLKKEYPNQTAVLGRSNGNEWDKTLGNYSSSTPEDGGVAIVSKWPIIEKIQYVFEKGCGPDNLSNKGFVYTKVKKNDRFVHVIGTHIQAEDNMCGQTSPASVRTKQLQEIQEFIKNKNISNNEYVLIGGDMNVNKINAENNSDSEYASMFKTLHASIPSY

SEQ ID NO: 26379 - protein, 252 aa, Bacillus cereus
MKSKLLKSILSVGIGLGVLYGGSSVQAEMSTNQNNTLKVMTHNVYMLSTNLYPNWGQSERADLIGAADYIKNQDVVILNEVFDNSTSNRLLGNLKKEYPNQTAVLGRSNGNEWDKTLGSYSSSTPEDGGVAIVSKWPIVEKIQYVFAKGCGPDNLSNKGFVYTKIKKNDRFVHVIGTHLQAEDSMCGNTSPASVRTNQLKEIQDFIKNKNIPNDEYVLFGGDMNVNKINAENNSDSEYTSMFKTLHASVPSY

SEQ ID NO: 26380 - protein, 252 aa, Bacillus cereus
MKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVKKINAENNSDSEYASMFKTLHASIPSY

SEQ ID NO: 26381 - protein, 252 aa, Bacillus cereus; identical to SEQ ID NO: 26090

SEQ ID NO: 26382 - protein, 252 aa, Bacillus cereus
MKGKLLKGVLSLGIGLGVLYGGSSAQADTSTDQNNILKVMTHNVYMLSTNLYPNWGQSQRADLIGAADYIKNQDVVILNEVLDNSASDRLLGNLKKEYPNQTAVLGRSNGNEWDKTLGSYSSSTPEDGGVAIVSKWPIVEKVQYVFANGCGPDNLSNKGFVYAKIKKNDRFVHVIGTHLQAEDSMCGKTSPASVRTNQLKEIQDFIKNKNIPNDEYVLFGGDMNVNKINAENNSDSEYASMFKTLHASIPSY

SEQ ID NO: 26383 - protein, 252 aa, Bacillus cereus
MKGKLLKGVLSFGIGLGVLYGGSSAQADTSTDQNNTLKVMTHNVYMLSTNLYPNWGQSERPDLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSY

SEQ ID NO: 26384 - protein, 252 aa, Bacillus cereus
MKGKLLKGVLSFGIGLGVLCGGSSVQADTSTDQNNTLKVMTHNVYMLSTNLYPNWGQSQRADLIGAADYIKNQDVVILNEVFDNSASDRLLGNLKKEYPNQTAVLGRSNGNEWDKTLGSYSSSTPEDGGVAIVSKWPIVEKIQYVFAKGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSY

SEQ ID NO: 26385 - protein, 252 aa, Bacillus cereus
MKCKLLKGVLSLGVGLGALYSGTSAQAEVSTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKENDRFVHVIGTHLQAEDSMCGKTSPASVRTDQLKEIQDFIKNKNIPNNEYVLIGGDMNVNKINAENKNDSEYASMFKTLNASVPSY

SEQ ID NO: 26386 - protein, 252 aa, Bacillus cereus
MKGKLLKGVLSLGVGLGALYSGTSAQAEVSTNQNDTLKVMTHNVYMLSTNLYPNWGQTERADLIGAADYIKNQDVVILNEVFDNSASDRLLGNLKKEYPNQTAVLGRSSGSEWDKTLGNYSSSPPEDGGVAIVSKWPIAEKIQYVFAKGCGPDNLSNKGFVYTKIKKNDRFVHVIGTHLQAEDSMCGKTSPASVRTNQLKEIQDFIKNKNIPNNEYVLIGGDMNVNKINAENNNDSEYASMFKTLNASVPSY

SEQ ID NO: 26387 - protein, 252 aa, Bacillus cereus
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTSEDGGVAIVSKWPIAEKIQYVFAKGCGPDNLSNKGFVYTKIKKNDRFIHVIGTHLQAEDSMCGKTSPASVRTDQLKEIQDFIKNKNIPNNEYVLIGGDMNVNKINAENKNDSEYASMFKTLNASVPSY

SEQ ID NO: 26388 - protein, 252 aa, Bacillus cereus
MKGKLLKGVLSLGVGLGALYSGTSAQAEASTNQNDTLKVMTHNVYMLSTNLYPNWGQTERADLIGAADYIKNQDVVILNEVFDNSAPDRLLGNLKKEYPNQTAVLGRSSGSEWDKTLGNYSSSTPEDGGVAIVSKWPIAEKIQYVFAKGCGPDNLSNKGFVYTKIKKNDHFVHVIGTHLQAEDSMCGKTSPASVRTDQLKEIQDFIKNKNIPNNEYVLIGGDMNVNKINAENKNDSEYASMFKTLNASVPSY

SEQ ID NO: 26389 - protein, 338 aa, Bacillus cereus
MEVWNVKCKLLKGVLSLGVGLGALYSGTSAQAEVSTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTDQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 26390 - protein, 333 aa, Bacillus cereus
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTDQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPKSPQWTVTSWFKNIRIMITLIIIQVEATISMK

SEQ ID NO: 26391 - protein, 219 aa, Bacillus cereus
GNIPTKPKDCNNVDKYKLCTNKEEADAWGKKQFNKWSKEEKSAIRDYTKNARPYNEFLRMHAGKLDSDPTMKKKIESLDKALNRKEAKVNDNIKVYRGDDAWIFGKEYDNSIIKNGKVDREKFKEIQKKFQGKTTTEFGYISTSILIDAGYAKTRPVMTEFKVGSGTHGAYMNSDDLTAYPGQYELLLPRNTVYKIEKIYIAIDNNTQKEQIKVEATIK

SEQ ID NO: 26392 - protein, 382 aa, Bacillus cereus
ADSKGTVENLQNGGKVYNSFKTTYDMKQNIKNSIKVSFIEDPYADKKIAIVTTDGSNIDAKYTINSGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTETTSDLKITNRRISDQYNIEWVSSKWWGTNNKDTYNEFFTNHYKLDWKNHQVTLDNQKALEEQMNSINSVNDKLNKGKGKLSLSMNGNQLKATSSNAGYGISYEDKNWGIFVNGEKVYTFNEKSTVGNISNDINKLNIKGPYIEIKKI

SEQ ID NO: 26393 - protein, 336 aa, Bacillus cereus
MKRSKTYLKCLALSAVFASSALVLSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKSFTLDWKNKKLVEKK

SEQ ID NO: 26394 - protein, 336 aa, Bacillus cereus
MKRSKTYLKCLALSAVFASSAVTLSTPATYAQTTSQVVTDIGKNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKLTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKLFTLDWKNKKLVEKK

SEQ ID NO: 26395 - protein, 337 aa, Bacillus cereus
MKRSKTYLKCLALSAVFASSALALSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGLSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKSFTLDWKNKKLVEKNR

SEQ ID NO: 26396 - protein, 336 aa, Bacillus cereus
MKRSKTYVKCLALSAVLASSALAMHTPVVAAQTTSQVVTDIGQNAKTHTSYNTFNNEQADNMTMSLKVTFIDDPSADKQIAVINTTGSFMKANPTLSDAPVDGYPIPGASVTLRYPSQYDIAMNLQDNTSRFFHVAPTNAVEETTVTSSVSYQLGGSIKASVTPSGPSGESGATGQVTWSDSVSYKQTSYKTNLIDQTNKHVKWNVFFNGYNNQNWGIYTRDSYHALYGNQLFMYSRTYPHETDARGNLVPMNDLPALTNSGFSPGMIAVVISEKDTEQSSIQVAYTKHADDYTLRPGFTFGTGNWVGNNIKDVDQKTFNKSFVLDWKNKKLVEKK

SEQ ID NO: 26397 - protein, 800 aa, Bacillus cereus
  strain 03BB102
MTRNKFIPNKFSIISFSVLLFAISSSQAIEVNAMNEHYTESDIKRNHKTEKNKTEKEKFKDSINNLVKTEFTNETLDKIQQTQDLLKKIPKDVLEIYSELGGEIYFTDIDLVEHKELQDLSEEEKNSMNSRGEKVPFASRFVFEKKRETPKLIINIKDYAINSEQSKEVYYEIGKGISLDIISKDKSLDPEFLNLIKSLSDDSDSSDLLFSQKFKEKLELNNKSIDINFIKENLTEFQHAFSLAFSYYFAPDHRTVLELYAPDMFEYMNKLEKGGFEEISESLKKEGVEKDRIDVLKGEKALKASGLVPEHADAFKKTARELNTYILFRPVNKLATNLIKSGVATKGLNVHGKSSDWGPVAGYIPFDQDLSKKHGQQLAVEKGNLENKKSITEHEGEIGKIPLKLDHLRIEELKENGIILKGKKEIDNGKKYYLLESNNQVYEFRISDENNEVQYKTKEGKITVLGEKFNWRNIEVMAKNVEGVLKPLTADYDLFALAPSLTEIKKQIPQKEWDKVVNTPNSLEKQKGVTNLLIKYGIERKPDSTKGTLSNWQKQMLDRLNEAVKYTGYTGGDVVNHGTEQDNEEFPEKDNEIFIINPEGEFILTKNWEMTGRFIEKNITGKDYLYYFNRSYNKIAPGNKAYIEWTDPITKAKINTIPTSAEFIKNLSSIRRSSNVGVYKDSGDKDEFAKKESAKKIAGYLSDYYNSANHIFSQEKKRKISIFRGIQAYNEIENVLKSKQIAPEYKNYFQYLKEMITNQVQLLLTHQKSNIEFKLLYKQLNFTENETDKFEVFQKIIDEK

SEQ ID NO: 26398 - protein, 764 aa, Bacillus cereus
  strain 03BB102
MKKRKALIPLMALSTILVSNTGNLDTIQAEVKQENQLLNESESSSQGLLGYYFSDLNFQAPMVITPSTTGDLSIPSSELENIPSEKQYFQSAIWSGFIKVEKSDEYTFATSNDSHVTMWVDNQEVINKSSNYNKIRLEEGQLYPIKIQYQRENPTEKGLDFQLYRTDSQNKKEVISSDNLQLPELKQKSSNSRKKRSTSAESTVPDRDNDGIPDSLEVEGYTVDVKNKRTFLSPWISNIHEKKGLTKYKSSPEKWSTASDPYSDFEKVTGRIDKNVSPEARHPLVAAYPSVHVDMENIIVSKNTDSSIQQGASQGQTISKSTSTSRTHTSEVHGDVEVHASLFDIGGSISAGFSNSNSSTVAIDHSQSIAGETTWAETIGLNTADTARLNANIRYVNTGTAPIYNVLPTTSLVLGKNQTLATIKAKENQLSQMLAPNNYYPSKNLAPIALNAQDDFSSTPITVNYNQFLELEETKQLRLDTDQVYGNIATYNSINGSVTVDTGSNWSDVLPQIQETTARIIFNGKDLNLVERRIAAVNPSDALEMTKPDMTLKEALKIAFGFNEQNGDLRYQGKNITEFDFNFDQQTSQNIKNQLAELNATNIYSVLDKIQLNAKMNILIRDKRFHYDRNNIAVGADESVIKEAHREVINSSREGLSLNIDKDIRKVISGYIVEIEYDKGDKGILNDRYDMLNIYNVQQDGKTFIDFKKYNDKLPLYLSNPNDKVNVYAVTKENHIINPREDADIGISEIKKTLIFSKKAYEIG

SEQ ID NO: 26399 - protein, 700 aa, Bacillus cereus
  strain 03BB102
MKIKKSFVKVLSMSFLITVIATNTPIFTTFAHGAMENGDVIRKKESENGKKKKEDEKREKIQEERKKEITKHIVKAELKNEDVLKKDAVESLLRKLPVNVLELYHRIDGKIIIVDEVNKKNELPETKQVENIDGETVELNQHYVYGEEGDSPRLVIKASEDYEYNQKQVLNVYYEIGKLLSKIILNKIIQPDNGFVDALNMIKKSPDTDGQDLLFSSAAKEYSGGITTESLKQDNFEAQKIFAKSFAYYNEPHNREILQTYAEPMFNYMKNLNEDIITPILEEKRLLSQRNLGDKLKELKANITKNINYSSGDINKINDPKVQKGIEEINEMIKRPENKLEKPKTIYLYFRAQDLGYRETNNIVQINNGTINSDKIDRKKVSNVLDHFKDMKFTDFKVGHLTNSGREGQERFLVKLQLPEGTYLGDLGDGRVVLPLDYGMSIVHSKNLLNSDRPKINTDNQQEIISVVANLVKKEVIEKKITDLEASLNNEVNLKFGEVNQQSNLIKFDLDGLSISYAMKNAKKAILDLIGNRYIPRGILKDILLTLKQEGGIVITDNPINGDPSVGGNTDQINNVVKIKMAPRFLAKHSKDYDLSRTLIHELGHVLDKKILGNGEYISNDLAFREIFKEEKDKISQLNTEGGYATHNTHEFFAEVFKSMYSTDSEQHSADKYHKSIKEEAPKAVAYIKEKINQYLRSKE

SEQ ID NO: 26400 - protein, 764 aa, Bacillus cereus
  strain 03BB102
MKKRKALIPLMALSTILVSNTGNLEVIQAEVTQENRLLNESESSSQGLLGYYFSDLNFQAPMVVTPSTTGDLSIPSSELENIPSENQYFQSAIWSGFIKVKKSDEYTFATSADNHVTMWVDDQEVINKASNSNKIRLEKGRLYQIKIQYQRENPTEKGLDFKLYWTDSQNKKEVISSDNLQLPELKQKSSNSRKKRSTSAGPTVPDRDNDGIPDSLEVEGYTVDVKNKRTFLSPWISNIHEKKGLTKYKSSPEKWSTASDPYSDFEKVTGRIDKNVSPEARHPLVAAYPSVHVDMENIILSKNEDQSTQNTDSQTRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNEPNGNLQYQGKDITEFDFNFDQQTSQNIKNQLAELNVTNIYTVLDKIKLNAKMNILIRDKRFHYDRNNIAVGADESVVKEAHREVINSSTEGLLLNIDKDIRKILSGYIVEIEDTEGLKEVINDRYDMLNISSLRQDGKTFIDFKKYNDKLPLYISNPNYKVNVYAVTKENTIINPSENGDTSTNGIKKILIFSKKGYEIG

SEQ ID NO: 26401 - protein, 809 aa, Bacillus cereus
  strain 03BB102
MNIKKEFIKVISMSCLVTAITLSGPVFIPLVQGAGGHGDVGMHVKEKEKNKDENKRKDEERNKTQEEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEVQEVFAKAFAYYIEPQHRDVLQLYAPEAFNYMDKFNEQEINLSLEELKDQRMMARYEKWEKIKQHYQHWSDSLSEEGRGLLKKLQIPIEPKKDDIIHSLSQEETELLKRIQIDSSDFLSTEEKEFLKKLQIDIRDSLSEEEKELLNRIQVDSSNPLSEKEEEFLKKLKLDIQPYDINQRLQDTGGLIDSPSINLDVRKQYKRDIQNIDALLHQSIGSTLYNKIYLYENMNINNLTATLGADLVDSTDNTKINRGIFNEFKKNFKYSISSNYMIVDINERPALDNERLKWRIQLSPDTQAGYLENGKLILQRNIGLEIKDVQIIKQSEKEYIRIDAKVVPKSKIDTKIQEAQLNINQEWNKALGLPKYTKLITFNVHNRYASNIVESAYLILNEWKNNIQSDLIKKVTNYLVDGNGRFVFTDITLPNIAEQYTHQDKIYEQVHSKGLYVPESRSILLHGPSKGVELRNDSEGFIHEFGHAVDDYAGYLLDKNQSDLVTNSKKFIDIFKEEGSNLTSYGRTNEAEFFAEAFRLMHSTDHAERLKVQKNAPKTFQFINDQIKFIINS

SEQ ID NO: 26402 - protein, 372 aa, Bacillus cereus
  strain 03BB102
MKTKQTIAASTLALAMIAGANSAHAEVTDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDELSKKKQDLDIKINDFKHTEKKIDDKLTEIHTTKQNVDNKINEVSQSKQTETKTGTTNANNNARALPNAGNEQSNNMALGMLSVLGGILLVTRNKIKTLFSK

SEQ ID NO: 26403 - protein, 84 aa, Bacillus cereus
  strain 03BB102
MYSVSFSIVFVIQAISSSILNLTINDSIQFAIETRVGGGPGVSATSARTDLLPLTQGDVLRVRIREATGDIIYSNASLVILKVD

SEQ ID NO: 26404 - protein, 971 aa, Bacillus cereus
  strain 03BB102
MKGYSKKVLVGVSFASLMLGSFQGSALAEGTKGEQASYRNVLKMEPVGLQLPVQELAHSSKVLENKSFEKRLQFADLSQRPPELKKESKQLATAKIYTIAELNQLSNQQLVDLLVTIDWEQITGLFQFNKDSLAFYQNDSRIQAIIDKLKQQGQDYTKDDSKGIETLVEVLRSGFYLGFYHTELSKLNERSYHDKCLPALKTIANNPNFKLGTLEQNRVVSSYGKLIGNASSDVETITAAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGMNTEEGAVNKAPVAVINGPYSGNVNEAISFKSDGSKDEDGKITSYKWEFGDGAVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 26405 - protein, 1191 aa, Bacillus cereus
  strain 03BB102
MSRYDDSQNKFSKPCFPSSAGRIPNTPSIPVTKAQLRTFRAIIIDLTKIIPKLFANPSPQNIEDLIDTLNLLSKFICSLDAASSLKAQGLAIIKNLITILKNPTFVASAVFIELQNLINYLLSITKLFRIDPCTLQELLKLIAALQTALVNSASFIQGPTGPTGPTGPAGATGPQGVQGNTGATGATGPQGAQGNTGATGATGPQGAQGNTGATGPQGAQGPAGATGATGPQGAQGNTGATGPQGAQGPAGATGATGPQGAQGNTGATGPQGIQGNTGATGATGIGVTGPTGPPGPTGPQGNTGATGATGPQGVQGNTGATGATGPQGAQGPAGATGATGPQGVQGPAGATGATGPQGVQGNTGATGPQGVQGNTGATGATGPQGVQGNTGATGPQGVQGNTGATGATGPQGVQGNTGATGATGPQGVQGPAGATGATGPQGIQGPAGATGATGPQGVQGNTGATGATGPQGAQGPAGATGATGPQGVQGPAGATGATGPQGVQGPAGATGATGPQGVQGNTGATGPQGVQGNTGATGATGPQGVQGNTGATGATGPQGVQGPAGATGATGPQGIQGPAGATGATGPQGVQGNTGATGATGPQGAQGPAGATGATGPQGVQGNTGATGATGPQGAQGPAGATGATGPQGVQGNTGATGATGPQGAQGPAGATGATGPQGVQGPAGATGATGPQGVQGPAGATGATGPQGVQGPAGATGATGPQGVQGPAGATGATGPQGVQGNTGATGATGPQGAQGNTGATGPQGVQGPAGATGATGPQGAQGPAGATGATGPQGAQGNTGATGPQGAQGPAGATGATGPQGAQGNTGATGPQGVQGPAGATGATGPQGAQGPAGATGATGPQGVQGPAGATGATGPQGAQGNTGATGPQGAQGPAGATGATGPQGVQGPAGATGATGPQGAQGPAGATGATGPQGAQGPAGATGATGPQGIQGPAGATGATGPQGVQGPTGATGIGVTGPTGPSGGPPGPTGPQGPQGNTGATGPQGIQGPAGATGATGPQGAQGPAGATGATGPQGVQGPTGATGIGVTGPTGPSGPSFPVATIVVTNNIQQTVLQFNNFIFNTAINVNNIIFNGTDTVTVINAGIYVISVSISTTAPGCAPLGVGISINGAVATDNFSSNLIGDSLSFTTIETLTAGANISVQSTLNEITIPATGNTNIRLTVFRIA

SEQ ID NO: 26406 - protein, 808 aa, Bacillus cereus
  strain 03BB102
MKKSKKMLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTTPPTGEGDNGENPTTPPTGEGDNGENPTTPPTGEGDNGENPTTPPTGEGDNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 26407 - protein, 503 aa, Bacillus cereus
  strain 03BB102
MFNKKMVAMAMTVPLVMGTLSTVSAVETKKQVKVEAYSPQKKAIEYLKGNANQYGLKPDLSDLQYISTTETPVASYVRFQQVVNGAPVFSNQITVTLNGEGKGVLAVSDYQPIKAVKQVTEKISEKDAIQKSMAYVGEASEQNLWAPTEKEFGYIIEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAAAYSSSDPTCLRRLDTNKVYPKDIKNQVHADGEIWSQGQYEMAQAFGRDVATKIILQSHWSLTPNSKFSDGAKAIKQADALLYGGQHAADIDRIWAARGISTN

SEQ ID NO: 26408 - protein, 315 aa, Bacillus cereus
  strain 03BB102
MSSWRNNINGYCSCNNQNGVHVDSCCFSCDGTVPKLGPTGPTGATGATGPTGVTGATGVTGATGVTGATGATGATGATGITGATGPTGATGITGATGITGATGITGTTGATGATGATGATGATGATGATGATGATGATGATGATGATGATGATGATGATGPTGATGPTGEIGPTGVTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 26409 - protein, 412 aa, Bacillus cereus
  strain 03BB102
MKKANGIAKSVAVASVIMSGSLGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNYPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKALEEQISSIKNVNNQLNKGKGKLSFSMNGNQLKATSSNAGYGISYEDKNWGIFVNGEKIYTFNEKTTVGNISNDINKLNIKGPYIEIKKI

SEQ ID NO: 26410 - protein, 883 aa, Bacillus cereus
  strain 03BB102
MEGNGGKSKIKSSLNSNFKILSDLVGPTFPPVPTGMTGITGSTGATGNTGPTGSTGPTGETGVTGNTGPTGETGGTGSTGATGNTGPTGETGGTGSTGVTGSTGATGSTGVTGSTGATGNTGATGSMGVTGNTGPTGSTGGTGSTGVTGNTGSTGSTGVTGSTGPTGSTGVTGSTGPTGETGVTGSTGGTGNTGSTGETGPTGSTGPTGETGATGSTGATGSTGATGNTGATGSMGPTGSTGVTGNTGSTGSTGVTGSTGPTGETGVTGSTGPTGETGVTGSTGPTGETGVTGSTGPTGETGATGSTGPTGETGATGSTGVTGSTGATGETGPTGSTGATGATGNTGPTGETGSTGTTGPTGETGATGSTGATGSTGPTGSTGETGATGSTGVTGNTGPTGSTGETGATGSTGVTGNTGPTGSTGETGATGSTGVTGNTGPTGSTGATGSTGVTGSTGATGNTGATGETGPTGSTGATGNTGATGETGATGSTGVTGSTGPTGETGPTGSTGVTGNTGLTGSTGVTGSTGPTGSTGPTGETGSTGSTGAPGNTGATGSTGVTGNTGSTGSTGVTGSTGPTGSTGPTGNTGPTGETGATGSTGVTGSTGVTGNTGVTGETGPTGSTGVTGSTGATGSTGVTGNTGATGNTGATGSTGVTGNTGATGETGPTGSTGATGNTGATGETGPTGSIGATGNTGATGNTGETGVTGPTGSTGVTGSTGPTGSTGTTGNTGVTGDTGPTGATGVSTTATYAFANNTSGSVISVLLGGTNISLPNNQNIGPGITVSGGSTVFTVANAGNYYIAYTINLTAGLLVSSRITVNGSPLAGTINSPTVATGSFSATIIASLPAGAAVSLQLFGVVALATLSTVTPGATLTIIRLS

SEQ ID NO: 26411 - protein, 965 aa, Bacillus cereus
  strain 03BB102
MNKKSKINKVMLSISTMALSLGALQAPVLAEEKVPYNVLKTKPVGIEKPVDEIGHVSKAEETLSFQERLKVGDFSQRPASITNKAAVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLAQKEWSGYKTVTAYFVNYRVNSSNQFEYDVVFHGIAKDDEENKAPTVHINGPYNGLVKEGIQFKSDGSKDEDGKIVSYLWDFGDGSTSAEVNPLHVYEREGSYKVALIVKDDKGKESKSETTVTVKDGSLTESEPNNRPEEANRIGLNTTIKGSLIGGDHTDVYTFNVASAKNINISVLNEYGIGMTWVLHHESDMQNYAAYGQVNGNHIEANFNAKPGKYYLYVYKYDNGDGTYELSVK

SEQ ID NO: 26412 - protein, 160 aa, Bacillus cereus
  strain 03BB102
MKKKLLPICAMALLTVGYSSVASASTGTVTKEEAAQIQQDIAKKEAAIQAQQKNDTEKKQVAQAQEKNEVAKKQAVQAQEKNEVAKKQAAQVQEKSNMAKEVVAPQVKEKEAIAKKEAAKEAGEKLPNTASNNVAMMALSACLVGIGTLFGLKRRNKVKA

SEQ ID NO: 26413 - protein, 333 aa, Bacillus cereus
  strain 03BB102
MKGKLLKGVLSFGIGLGVLYGGSSAQADTSTDQNNILKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 26414 - protein, 455 aa, Bacillus cereus
  strain 03BB102
MNNRLLKQLQNMKMNKKSLGAVALTAGIIGTTLIPQNTYAHGFVEKPGSRSALCSPTYGALNVNCGSVMYEPQSLEAPKGFPQGGPVDGQIASAGGKFGGILDQQTADRWFKNTITGGENTFTWKYTAPHLTSKWHYYITKKGWDPNKALTRADFEPIGTVQHDGSAASNHLTHKINVPTDRSGYHVILAVWDVADTANAFYNVIDVNLINDVKPDTEAPSIPNRIQAQKVTANSIELAWNASTDNVGVKGYQIFRNGEVIDTVPGTHFIDKKLQPSTEYSYTVKAIDAAGNVSKESATLTVKTTVEAPDTEAPTQPIGLHSMGTTASSVDLMWSPSDDNIGVDHYDIYRETKGSMEKIATSNTTSYMDKYLLSNTTYKYVVKAVDVAGNESVQSDIFIITTKTESVSYEEWDAKKAYEKGDRVLHEGKVYEAVQSYKGNGDPNWIYALSLWKTV

SEQ ID NO: 26415 - protein, 431 aa, Bacillus cereus; identical to SEQ ID NO: 26106
  strain 03BB102

SEQ ID NO: 26416 - protein, 564 aa, Bacillus cereus
  strain 03BB102
MKKLFSMVLAFILMFSTLPSAFAANEAPTKGSLTIHKYAHEKDGQEGEAGTGEPGQKIPEGATPIEGVEYEVIQIASFELITKDGEIVKEGEKEVKNATPIKDKTGKDGTVKFDNLPIGRYLVKEISGPTNVNLNTDPYTIEIPMTDKEGKKLNYDVHIYPKNEIKRGAVELTKTDDVGKPLENVEFTLYHKGTDKVVVDKAGKELKDLKTDKDGKIRVDGLLHGEYYFKESKALPGYVLDPKHREFKIEKSGAFPKDGQAGYGEIVKLDTIINYKKPTIDKKINGNLNGLPINVDEEFTYDIKTTLPGDIHKYKKYVITDNVDPKLTIIGTPVVTIDGEKVSSDVVKVTLGEKTAAGQLVTVTVENFKALEGKKELHLQIKAKVNGDINGGTEIKNIAKIDYETGDEVTPPDDETTTPPVTVIVTDGKISLKKIDGATKDALEGAKFELRKDGKVVKVKGVDVVGVSDKDGMIKWENIPYGEYEIVEIEAPKYTDKGEVKSYQKLREPIKVKIDKDNQTVKLTVENNKSGWILPATGGIGTILFTVVGLVLMGAAFMFLRRKA

SEQ ID NO: 26417 - protein, 293 aa, Bacillus cereus
  strain AH187
MSHYNDSQNKFSKPCFPSSAGRIPNTPSIPVTKAQLRTFRAIIIDLTKIIPKLFANPSPQNIEDLIDTLNLLSKFICSLDATSSLKAQGLAIIKNLITILKNPTFVASAVFIELQNLINYLLSITKLFRIDPCTLQELLKLIAALQTALVNSASFIQGPTGPSFPIATIVVTNNIQQTVLQFNNFIFSTAINVNNIIFNGTDTVTVINGGIYVISVSISTTAPGCAPLGVGISINGAVATDNFSSNLIGDSLSFTTIETLAAGANISVQSTLNEITIPATGNTNIRLTVFRIA

SEQ ID NO: 26418 - protein, 129 aa, Bacillus cereus
  strain AH187
MGVNQTVAANGKVNFSGGGTNLNGITFNGSDTLTIQQNGDYMITLNVSPALGSVTPAAFGVGLNNNPTPSTNMVSNVSGGMISSTTIISLTAGTTLSLFNNSGVAVSLNNGAGGAAGGGVARVTVIRVD

SEQ ID NO: 26419 - protein, 553 aa, Bacillus cereus
  strain AH187
MKKIFSLFLICTLAFSTLSNMIVSAESKSTGTLTIHKFEQSKELKTTTEGNGKEGQTVPEDAKPLEGVTFEIKRIESFEKISNDGTVIKEDAKPVKDAAITKVTNAKGEAVFSNLPLGRYEVKAIEGPKHIALDKTTFIVDIPMTSADGKDLNYDVHIYPKNETKRGSVEFVKKGEAGKVLKDAEFHLFKKNKDGTSTQVKTPSSLVTGEDGKVRVDSLEYGDYYYFIEHKAPTGYLTSKEERPFSIKESGEVVKLDDIKNYKEPTITKSINNGSKVAGINKETDYTYDIKTLLPEDIQSYKKYVVKDILDDRLEIKGLPIVMVDGKKVEDGSVKVVVEGQKVTATIEDFSKINGKELHLQITAKIKSDVESGVKIPNKAVLDFVNKDDVSSEKDGKPSNEVVVTPTAGNIKIEKVDGKDKTLKLEGAKFQLQDKKGNVIKVNGKEMNDITDANGIITWNEIPYGEYQIVETEAPKYKDKDGAVEHYQKLRDPINITLDEKHQKIELQVENNKSGWIIPATGGMGTILFTVVGLILMAVATFIFFRKKPVKNS

SEQ ID NO: 26420 - protein, 794 aa, Bacillus cereus
  strain AH187
MKKSKKMLAGATLAIGVIAPQVLPATAHADEQTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVINANTNRIINMTYEGKPVADNQEFIVATNNYRGSSQTFPGVSKGEVVYQSQDETRQIIVKYMQETPVIDPAADKNWAFKPIVADKLHTTFDSSPNAQKYIKKDGNISYVGPSENEFAKYAIDITKKNDDDKETGGENPTTPPTSEGNNGENPTTPPTSEGNNGENPTTPPTGEGNNGENPTTPPTGEGNNGENPTTPPTGEGNNTGSGQTTTDNQNVKETTTVSEKKEERDLPKTGTSVVSTIGAGLAFVGAGFLLLFRRKKANR

SEQ ID NO: 26421 - protein, 503 aa, Bacillus cereus
  strain AH187
MFNKKMVAMAMTVPLVMGTISTVSALEKQQQVKLEAYSPQKKATEYLKENAAQYGLKADLSDLQYISTTETSVASYVRFQQVVNGAPVFSKQITVTLNGEGKGVLAVSDYQSVKGVKEATTKISEKDAIQKSMAYVGEVSEQNLWAPTEKEFGYIVEEGIARPVYKVVVHSNNPFGAWETFVDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDNNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26422 - protein, 426 aa, Bacillus cereus
  strain AH187
MSSWRNNINGYCECNNQNGVHVDSCCFSCDGTVPKLGPTGPTGATGPTGATGPMGATGPTGATGPTGATGPTGATGPTGVTGSTGATGITGATGATGATGITGATGATGATGITGATGPTGVTGVTGATGSTGATGPTGVTGSTGATGITGATGATGATGPTGVTGITGATGPTGVTGVTGATGATGPTGVTGITGATGATGSTGATGPTGATGITGATGPTGATGITGATGPTGATGPTGATGPTGATGSTGPTGATGITGATGVTGATGPTGATGSTGSTGPTGITGTSITATYAFANNTSGSAISVLLGGTNVPLPNNQNIGPGITVSGGNTVFTVANAGNYYISYTINITASLLVSSRITINGAPLAGTINSPALATTSFSATIITTLAAGDAISLQLFGLLAVATLSTTTPGAVLTIIRLS

SEQ ID NO: 26423 - protein, 1170 aa, Bacillus cereus
  strain AH187
MRERDNKRQQHSLNPNFRISPELIGPTFPPVPTGFTGIGITGPTGPQGPTGPQGPRGFQGPMGEMGPTGPQGVQGIQGPVGPIGATGPEGQQGPQGLRGPQGETGATGPGGVQGLQGPIGPTGATGAQGVQGIQGLQGPIGATGPEGPQGIQGVQGLPGATGSQGIQGVQGIQGPQGPSGNTGATGATGQGITGPTGITGPTGITGPSGGPPGPTGPTGATGNTGATGNTGITGATGSTGPTGSTGAQGLQGIQGIQGPIGPTGPEGPQGIQGIPGPTGVTGEQGIQGVQGIQGITGATGDQGPQGIQGVIGPQGVTGATGDQGPQGIQGVPGPSGATGPQGVQGIQGPMGDIGPTGPEGPEGLQGPQGIQGVPGPVGATGPEGPQGIQGIQGVQGATGPQGPQGIQGIQGVQGITGATGIQGATGIQGIQGEIGATGPEGPQGVQGAQGAIGPTGPMGPQGVQGVQGIQGATGAQGVQGPQGIQGIQGPTGATGDMGATGATGEGATGPTGVTGPTGVTGPSGGPAGPTGPTGPSGPAGVTGPSGGPPGPTGATGATGLTGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGPQGPTGIQGIQGEIGPTGPEGPEGLQGPQGIQGVQGPVGATGPEGPQGIQGIQGVQGATGPQGPQGIQGIQGVQGITGATGAQGATGIQGIQGEIGATGPEGPQGVQGIQGAIGPTGPMGAQGVQGIQGIQGATGAQGVQGPQGVQGIQGPTGATGDTGATGATGEGTTGPTGVTGPTGVTGPSGGPAGPTGPTGPSGPAGVTGPSGGPPGPTGATGATGVTGDTGATGSTGVTGATGETGATGATGVTGLQGPQGIQGVQGEIGPTGPQGIQGPQGIQGVTGATGAQGPQGIQGPQGDIGPTGPQGIQGPQGIQGPQGIQGPTGATGATGSQGPTGDTGPTGAGATGATGATGVSTTATYAFANNTSGSVISVLLGGTNIPLPNNQNIGPGITVSGGNTIFTVANAGNYYIAYTINLTAGLVVSSRITVNGSPLAGTINAPTVATGSFSATIIANLPAGAAISLQLFGVGAVATLSTATPGATLTIIRLS

SEQ ID NO: 26424 - protein, 455 aa, Bacillus cereus
  strain AH187
MKNQFLKQLQNMKMNKKSLGAVALTAGIIGTTLIPQNAYAHGFVEKPSSRSALCSPTYGALNVNCGSVMYEPQSLEAPKGFPQTGPVDGQIASAGGKFGGILDQQTADRWFKNTITGGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNRIQAQKVTANSIELAWNDSTDNVGVKGYQIFRNGEMIDTVPGTHFIDKKLQPSTEYSYTIKAIDAAGNVSKESATLTVKTTVEAPDTEAPTQPKGLHSMGTTASSVDLMWSPSDDNIGVDHYDIYRETKGSMEKIATSNTTSYMDKYLLSNTTYKYVVKAVDVAGNESVQSDIFIITTKTESVSYEEWDAKKAYEKGDKVLHEGKVYEAVQSYKGNGDPNWIYALSLWKTV

SEQ ID NO: 26425 - protein, 524 aa, Bacillus cereus
  strain AH187
MYRRNCFSCDGRRPSGSNGNTGPTGITGPTGITGPSGITGSTGITGPTGITGPTGITGSTGPTGATGATGGTGAGLQSTTAFSLAAAPNYKAGQVVTYTSSGYVVKKDAPQGFPNVSPDYIVLVESGATGSTGPSGNTGSTGSTGPTGITGPSGNTGSTGSTGPSGNTGSTGSTGPTGNTGSTGSTGSTGSTGPTGITGSTGITGSTGSTGPTGITGPTGITGSTGITGPTGVTGSTGSTGPTGITGSTGITGSTGVTGSTGSTGPTGITGSTGSTGPTGITGPSGNTGSTGSTGPTGITGPSGNTGSTGSTGPTGITGPTGITGPTGNTGPTGNTGSTGSTGPTGITGPTGITGSTGPTGSAGSASAKSIVFQGTNAGFQRIAGSPGIDSNVIPYVTAGFGSIVGFTASINVNNLPAAAYTIDICRNVPTNLTAPTSSYILTTITLTTTNKITGTIVFSIKPTDTGSGQIQVFNPTPVVGPATVTWTSITTGNLVSRGDAISLYINPGITASAVYSVFLITDI

SEQ ID NO: 26426 - protein, 965 aa, Bacillus cereus
  strain AH187
MNKKSKINKVMLSISTMALSLGALQAPASAEEKVPYNVLKTKPVGIEKPVDEIGHVSKAEETLSFQERLKVGDFSQRPASIPNKAAVKQVKESYSMADLNKMNDQELVETLGCIKWHQITDLFQFNEDTKAFYKDKGKMQVIIDELAHRGSTFTRDDSKGIQTFTEVLRSAFYLAFYNNELSELNERSFQDKCLPALKSIAKNPNFKLGTAEQDTVVSAYGKLISNASSDVETVQYASNILKQYNDNFNTYVNDRMKGQAIYDIMQGIDYDIQSYLIEARKEANETMWYGKVDGFINEINRIALLNEVTPENKWLVNNGIYFASRFGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPAVADDYLAEHAPKSLTAVEKEMTETLPMKDAKMTKHSSQFFNTFTLEGTYTGSVTKGESEDWNAMSKKVNEVLEQLAQKEWSGYKTVTAYFVNYRVNSSNEFEYDVVFHGIAKDDGENKAPTVNINGPYNGLVKEGIQFKSDGSKDEDGKIVSYLWDFGDGRTSTEVNPVHVYEREGSYKVALIVKDDKGKESKSETTVTVKDGSLTESEPNNRPEEANRIGLNTTIKGSLIGGDHTDVYTFNVASAKDIDISVLNEYGIGMTWVLHHESDMQNYAAYGQANGNHIEANFNAKPGEYYLYVYKYDNGDGTYKLSVK

SEQ ID NO: 26427 - protein, 138 aa, Bacillus cereus
  strain AH187
MILGTIADAPNVPPLFFLFTITSVNDFLVTVTDGTTSFVVNISDVTGVGFLPPGPSITLLPPVDSGCECDCRERPIRELLDTLIGSTVNLLASTGSTAASFNVEQTGLGIVLGTLPISPTTIVRFAISTCKITAVNIL

SEQ ID NO: 26428 - protein, 431 aa, Bacillus cereus
  strain AH187
MSTIIDVYAREVLDSRGNPTVEVEVYTESGAFGRAIVPSGASTGEHEAVELRDGDKSRYLGKGVVNAVNNVNEIIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERLGSKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 26429 - protein, 333 aa, Bacillus cereus
  strain AH187
MKGKLLKGVLSLGIGLGVLYGGSSAQADTSTDQNNILKVMTHNVYMLSTNLYPNWGQSQRADLIGAADYIKNQDVVILNEVFDNSASDRLLGNLKKEYPNQTAVLGRSNGNEWDKTLGSYSSSTPEDGGVAIVSKWPIVEKVQYVFANGCGPDNLSNKGFVYAKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFVENKVLQPKSPQWTVTSWLKKYTYDDYSDHYPVAATISMK

SEQ ID NO: 26430 - protein, 564 aa, Bacillus cereus
  strain AH187
MKKVFSMVLAFILMLSTLPSAFAANEVPTKGSLTIHKYAHEKDGQKGEEGTGEPGQKVPEGATPIKGVKYEVVKVATFKVIERNGEIVKEAVEKVDNATPISDVTGEDGTVTFKDLPIGRYLVKEVSGPDNVNINTEPYTIDIPMTDKEGKKLNYDVHIYPKNEIKRGAVELTKVDDAGKPLKDVEFTLYHKGTDKVVVDKAGKELKDLKTDKDGKIRVDGLLYGEYYFKESKALEGYVLDPKKYEFKVEKSGAFPKDGQAGYGEIVKLDKIINYKKPTIDKKINGNLNGLPINVDEEFTYDIKTKLPGDIHLYKKYVITDNVDPRLTIIGTPVVTIDGEKVSSDVVKVTLGEKTAAGQLVTVTVENFAALKDKKELHLQIKAKVNGDINGGTVIENIAKIDYETGDKVTPPDDETTTPPVKVIVTDGKISLKKIDGATKDALEGAKFELRKDGKVVKVKGVDVVGVSDKDGIINWNNIPYGEYEIVEIEAPKYTDKGEVKSYQKLREPIKVKIDKDNQTVKLTVENNKSGWILPATGGIGTILFTVVGLVLMGAAFMFLRRKA

SEQ ID NO: 26431 - protein, 170 aa, Bacillus cereus
  strain AH187
MSTYLKRISVICFIFTVLIGQIFMPIIGHAQELNTTGFVDSFAFEKTKLNYGEKTTIHVDFSEKPGKKMKSGDTLTLALPPELKGYSGTIPLKDDSGRIFGTCQINANNVVCTFNDTVEKLENIRGNFNFTVQGTNVEAGKTKDVQTNLGTDLEKQMVSITHPKGGATRS

SEQ ID NO: 26432 - protein, 683 aa, Bacillus cereus
  strain AH187
MRWFLNINLKKQYLHDNIVLKDTLQEGQTLNKDSFTITINNKEYLSLKQFQDRGYGYIKLTSDNSFEVVIYRHMANATSFTIFYTSTITDSGKKLKHLQNDYKLDYQILYEKPISESNSVKVENISFGGGAEGVLPAKGTLQIVKHIEGDEKKFIPGVSFKLFTESGQQIGDSYTTNRDGIVEAPNLTPGNYYVQEISAPNYVEFDSQAKIPFTIKTDATNGIKLMVPNKLKTTSVAGTKTWEGDKVNDRPKTIKVDLLQNGKVIATKEVTAENDWKYEFGKLPAVDSEGKAHTYEVKEQPVSGYQSKVNGYDLTNIKIHEVTEVEEQGKEESLEELEAPTNPEEPKVTEEPKELEKPEVTEKPEIHVKPEEEQVEEETTEEIKEEKPEEPKVTEEPKELEKPEVTEKPEIHVKPEEEQVEEETTEEIKEEKPEEPKVTEEPKELEKPEVTEKPEIHVKPEEEQVEEETTEEIKEEKPEEPKVTEEPKELEKPEVTEKPEIHVKPEEEQVEEETTEEIKEEKPEEPKVTEEPKELEKPEVTEKPEIHVKPEEEQVEEETTEEIKEEKPEEPKVTEEPKELEKPEVTEKPEIHVKPEEEKVEEPNKSEVKEQPKVSNKPEIQGKVEAENKQDVQNKNEVSSSKESNKQSKLLPQTGGAAAESTSILAGMFALILGAIMFRRQKN

SEQ ID NO: 26433 - protein, 372 aa, Bacillus cereus
  strain AH187
MKTKQTIAASTLALAMIAGANSAHAEVTDATPQQSTGDRLAEIKQHKQELDAKLQQHKENVDQTLNELNKVKENVDTKVNELHERKQVADEKINEIKQRKEEFDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPHTGNTLEELKKIKGNLDSLSANLELAKQDVKNKLAALQEARQDLINKINEIKQSKQTVSDDLSKKKQDLDIKINDFKHTEKKIEDKLAELHTTKQNVDNKINEVSQSKQTETKTGTTNANNNARELPNAGSEQSNNMALGMLSVLGGVLLIARNKIKTLFSK

SEQ ID NO: 26434 - protein, 187 aa, Bacillus cereus
  strain AH187
MGKIFKFGCLGFIGLIVLGIIGSALGGGDDEKEKSSTEPKQETSAPATKEEPKKELSKEGESSKVKIAVGSVESVDSVGGEYLKEKAQGVFKVVEVTVTNNQKDAITVDANSFKLVDNKDREFTYSTQAQTAFDVGNGGKSDFFLKQLNPGLSQTGKIIFDVPADAQGLVLKARGGMTGKEIKLKVE

SEQ ID NO: 26435 - protein, 971 aa, Bacillus cereus
  strain AH187
MKGYSKKVLVGVSFASFMLGSFQGDALAEGTKGEQVSYRNVLKMEPIGLQLPVQELAHSSKVLENKSFEKRLKFADLSQRPPEVKKESKQLAVAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNSNFKLGTLEQNRVVSSYGKLIGNASSDVETITSAAKIFKQYNDNFSTLVDNLSAGNAIYDIMQGVDYDIQSYLYDTRKAPEDTIWYQKIDSYINELSRFALIGTVTAKNGWLINNGIYYTGRLGTFHSTETKGLQVVTDAMKIYPYLGEQYFVAAEQIATNYGGKDANGKVVDLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLSNVSVKKNKSQFFHTFTLQGTYTGTTAKGEYEDWKTITQNVNDTLKRLSAKEWTGYKTVTAYFVNYRVNAAGQFEYDVVFHGINTEEGAVNKAPVAVINGPYSGNVNAAISFKSDGSKDEDGKIVAYKWEFGDGTVSNKQNPTHVYTKEGTYTAKLTVTDDKGLTNTATTNVTVQKKEDNSVEKEPNNSFQTANKLQFNQVLRASLGNGDTSDYFEINVETAKNLQINVTKENNIGVNWVLYSEADLNNYVTYAQQEGNKLVGSYYTYPGKYYLHVYQYGGGTGNYTVEVK

SEQ ID NO: 26436 - protein, 456 aa, Bacillus cereus; identical to SEQ ID NO: 26352
  strain AH187

SEQ ID NO: 26437 - protein, 175 aa, Bacillus cereus; identical to SEQ ID NO: 26353
  strain AH187

SEQ ID NO: 26438 - protein, 337 aa, Bacillus cereus
  strain AH820
MKRSKTYLKCLALSAVFASSALALSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKLFTLDWKNKKLVEKNR

SEQ ID NO: 26439 - protein, 386 aa, Bacillus cereus
  strain AH820
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDDLSKKKQDLDIKINDFKHTEKKIDDKLAEIHTTKQNVDNKINEVSQSKQTETKTGTTNANNNARELPNAGSEQSNNMALGMLSVLGGILLVTRNKIKTLFSK

SEQ ID NO: 26440 - protein, 431 aa, Bacillus cereus; identical to SEQ ID NO: 26106
  strain AH820

SEQ ID NO: 26441 - protein, 237 aa, Bacillus cereus
  strain AH820
MSEKYIILHGTALEPNLIGPTLPPIPPFTFPNGPTGITGPTGATGFTGIGITGPTGVTGPTGIGITGPTGVTGPTGIGITGPTGVTGPTGIGITGPTGATGLGILPVFGTITTDVGIGFSVIVNTNINFTLPGPVSGTTLNPVDNSIIINTTGVYSVSFSIVFVIQAISSSILNLTINDSIQFAIESRIGGGPGVRATSARTDLLSLNQGDVLRVRIREATGDIIYSNASLVVSKVD

SEQ ID NO: 26442 - protein, 971 aa, Bacillus cereus
  strain AH820
MKGYSKKVLVGVSFASLMLGSFQGGALAEGTKGEQASYRNVLKMEPVGVQLPVQELAHSSKVLENKSFEKRLQFADLSQRPPELKKESKQLATAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNAWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFNTFTLQGTYTGTTAKGEYEDWKSITQNVNDTLKRLSVKEWTGYKTVTAYFVNYRVNASGQFEYDVVFHGINTEEGAVNKAPVAVINGPYSGNVNEAISFKSDGSKDEDGKIVAYKWEFGDGTVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 26443 - protein, 3486 aa, Bacillus cereus
  strain AH820
MKKLFNICLIVFVLFSQFISFPYNQAKAETLQETSLFDTVEMKDATDHIIDEAKNPKNLIKIGSTIQVEYAWSIKDQQVVHANDTAVIQIPLALKVSKDLQGDLVTDQKNIGQYFITAKDNKLKLIFNDQVENSKDAKGKIKIDTVFNPTLKTEEKSVQIAFPLGTLVQPITVPIQVEDSKEDGTKQDTNKQVPDQVAKPATDNPEQNPATKPATDNPEQNPATKPATDNPEQNPATKPATDNPEQNPATKPAADNPEQNLASDPAEITNSGPKQITTNILTGVKLTDKDGKPFTEDNRPSTDSPANIEFTWELLKSMNVKSGDYYIFDLPKHFKIYNTINSPLYDSENNPIGNFTVTKDGKVTMTFNDYVEEHPDVVGNLQLKTEFNKAEIKGTTTQEIPFPIKDKDVSITVDFKPNIQTTTNKKGLPDRPINTNEINWTVEMNKTKDTLKNAVFKDNIPQGTSLNKDSIKVYYLEVDVNGNATRGKEADPADYKIISSDGSKLEIAFKDSIKEAYQIEYVTKITDENVKSFQNNVTITSDNQGQQKASSTVTVSRGTHLNKTSKYDPKTQTIEWTITYNGDQRNIKKTDALLKDIFDDTHELDVNSIVVKNASYDDNGRLITGDTVNNYTVTNKKNGFDLQFNEDINSAYVITYKTKPTDNVIKDGKIKNTVTADNGSSKENEAGFQQQNIIKSNNKAETNYKDKTTTWTITVNNNNYPLNNAIITDTFDHGGLQLKDKKLEIKDGDYTLQAETDYVLDVTDKGFKITLIGTYQSNMTKTLIVKYTTDFDYTKLESGKTSFKNTGNLSWRDAESNPQSNKVEADFDPDTFTKANGYKYGSYNAQTKEITWIIGFNYNNVEIKDPYVIDVIQDKQKLVPGSIEVRHMILNGSPNNARPGDAVPIEQYELEEPTDKNKNTLQVHFKQSINSPYYIIFKTSLDGELIQNTYKNEAELKDGSKIVNTLKGDAQVNKGGSFVTKKAVQDDNYINWSIAINESQSTIADAVVTDDPTDNQVLVEDSFHLYPTTVDYYGNVTKDTANELKQGTDYKLTITTDNNTGKQHFEIAFLKKIDRAYILEYRSLINADDKEKVSNKAKIAGNQLTVKNTETVETIEVRMSSGSGGGSATKGRGNLEIIKVDNDNKKVPLSGAEFTLYDRTGKTVIRKITTDKDGIAKFNNLKRDKYLLKETKAPEGYVISWDLKQGKIVELGSQETTTYKLANKKFVGKVVLTKSDDLNKNVTLQGAVFTLLDKDKKIISEHEKLTTNDHGQITVDNLKPGTYYLQETTAPEHYKLDSTPIQFTIKEDQTTVINRTATNSLIPGSAILTKVDKDGKTLAGAEFSVRDRHNNVIRGYEKLSTNDQGQIEAKDLRPGDYQFVEEKAPKDYDIDKTPIEFTIVKSQKKAVTVTATNHLIKGGVTLTKTDDIDGTALAGAVFKIVDANDEKKVIRENVTTGADGKVTVKDLEPGTYKFIETEAPKDYVLNANPIEFTIDKSQQSFATVTATNSLKTGEVELLKVDEFGDKKPLKGAVFKIVDVNNNDVRTDLTTDADGKTKADKLRPGTYKFIETAAPEHYVLRAEPIEFTIDRSQKETLLVKAENALKPGDVELTKVDDIDGTALEGAVFKIVDANDEKKVIRENIKTGADGKAIATGLRPGDYKFIEVTAPKYYDKNTNPIKFTITESQTTSATVTAKNSLTKGGIELTKVNAADEKETLEGAVFKIVNRDTNEDVHTNLVTNSEGKLVVDDLRPGNYKLIETKAPTYYDVNVEPIEFTIEKGQQKLLPLTFKNSLTKGKVKLIKEDDVESSIALAGAVFTLQDATGKEIAKDLKTDDYGVLVIPDLAPGDYQFIETSAPEHYKLDQTPIKFTIKKGSKDDLPVPVTVTNSLLTGGVTLTKVDDVDGVTLEGAEFIIVDAHDTTKVVRKGLTTDEHGKVSASDLRPGNYQFIEVKAPKDYDLRKDPIPFTIGKSQKENINVTATNSLKKGAVTLTKIDDIDRTMLKDAIFKIVDMNGNEVRTNLGTDKNGKISVSDLRPGDYQFIETKAPEHYVLDETPIPFTIERSQTKEINVTGKNTLKKGSVELIKIDDIDTDTKLANAVFNLLDADGEIVEEGLKTNDEGKIIVENLRPGTYQFVETIAPEHYDLNKKPIEFTIKKSQTETLHITAKNALTKGAVELSKVDDIDGTKLEGAVFNIVDMNGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKKPIVVTVEKSQKNIATVTMKNSLTKGGVELSKVDDVDGTTLEGAVFNIVDMNGTVIRKSLTTNSQGKISVPDLRPGDYQFIETKAPKHYDLNKEPIPFTIEKGQAEPISVTAKNSLTKGAVELSKVDDIDGTALEGAIFKIVDMNGHDVRTGITTDAKGKVSISDLHPGDYQFIETTAPKHYKLDATPIKFTIEKSQAEKLQVTAKNSLIEGAVELIKVDDITPDTKLSDAVFNIIDAKGKVVRTNLTTDKDGKISASNLRPGDYQFVEMKAPKDYDLNETPIPFTIEKSQSTHVSVTAKNGLTKGGVELTKIDSLDTKETLEGAVFKITDLNGNDIRTNLVTNKDGKIIAKDLQPGDYQFIETKAPKHYDLNEDPIKFTIERSQTKHVFVTAINSLTKGSVELIKVDDVEENTTLEGAVFKIVNKDGHDIRTDLTTDKNGRLVVDELPPGDYEFIETKAPTHYKLNETPIKFTVKKGQEKIASVTATNSLTKGAVELSKVDDIDGSALKGAVFKIVDMNGNDVRTDLTTDKDGKISVSDLRPGDYQFIETKAPKHYDLNQNPINFTVEKSQTATASVTAKNSLTKGAVELTKVDDIDGTTLEGAIFKIVDSNGHDVRTDLTTDKDGKISVSDLRPGDYQFIETKAPTHYDLNQTPINFTVEKSQTATASVTAKNSLTKGAVELTKVDDIDGTTLEGAIFKIVDSNGHDVRTDLTTNKDGKISVSDLRPGDYQFIETKAPKHYDLNQNPINFTVEKSQTATASVTATNSLTKGAVELTKVDDIDGATLEGAVFKIVDMNGNDVRTDLTTDKDGKISVSDLRPGDYQFIETKAPKHYDLNQNPINFTVEKSQTATASVTATNSLTKGAVELTKVDDIDGTTLEGAIFKIVDSNGHDVRADLTTDKDGKISVSDLRPGDYQFIETKAPTGYDLNAKPIPFTIPKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKIDSSSGGEEKPVTPPNKEEETGKETSEELEKGNPEAHGKGTSEELEKGNPETQINKQQDDRNTGKELPNTGHKNDSTQTVGIILLLAGLLSVLATKRKKYY

SEQ ID NO: 26444 - protein, 706 aa, Bacillus cereus
  strain AH820
MSRYDDSQNKFSKPCFPSSAGRIPNTPSIPVTKAQLRTFRAIIIDLTKIIPKLFANPSPQNIEDLIDTLNLLSKFICSLDAASSLKAQGLAIIKNLITILKNPTFVASAVFIELQNLINYLLSITKLFRIDPCTLQELLKLIAALQTALVNSASFIQGPTGPTGPAGATGATGPQGAQGNTGATGATGPQGAQGNTGATGATGPQGAQGNTGATGATGPQGAQGNTGATGATGPQGAQGNTGATGPQGAQGNTGATGPQGVQGNTGATGATGPQGAQGNTGATGATGPQGAQGNTGATGPQGAQGPAGATGATGATGATGPQGVQGPAGTTGATGPQGAQGPAGATGATGPQGATGATGPQGAQGPAGATGATGPQGAQGPAGATGATGPQGVQGPAGATGATGPQGAQGPAGATGATGPQGVQGPAGATGATGPQGVQGPAGATGATGPQGVQGPAGATGATGPQGVQGPAGATGATGPQGVQGPTGATGIGVTGPTGPSGGPTGPTGPQGPQGNTGATGPQGIQGPAGATGATGPQGAQGPAGATGATGPQGVQGPTGATGIGVTGPTGPSGPSFPVATIVVTNNIQQTVLQFNNFIFNTAINVNNIIFNGTDTVTVINAGIYVISVSISTTAPGCAPLGVGISINGAVATDNFSSNLIGDSLSFTTIETLTAGANISVQSTLNEITIPATGNTNIRLTVFRIA

SEQ ID NO: 26445 - protein, 503 aa, Bacillus cereus; identical to SEQ ID NO: 26407
  strain AH820

SEQ ID NO: 26446 - protein, 780 aa, Bacillus cereus
  strain AH820
MKKSKKMLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTTPPTGEGDNGENPTTPPTGEGNNGENPTTPPTGEGNNGGNPTTPSTDEGNNAGSGQTTTDNQNSKETTTVSENKEERDLPKTGTSVASTIGAGLAFIGAGFLLLFRRKKANR

SEQ ID NO: 26447 - protein, 1012 aa, Bacillus cereus
  strain AH820
MKQNKRKRINAMVIAAALSLPFAVYSTPALAAVAIEANKTGHVLEDGTYDAVIKAYKDKTNEESMAAVYIKNPKLTIENGKKIVTATLSDSDFFQYLKTEDIHTPGVFHDVKVISEDKKKNGTKVIQFEVGELGKRYNMRMHIYIPTMAYDNKYQVQFEVNTLNLDKDVPEEQKENKEDKLDQQDANVIIDKQLQRHINKYNLNRENLNAPITKEDLLKVKSLIVVEAKSKGIKDVSGLEYMTNLENLTLEEVKLENIKFISNLRQLKSVSITYAELEDIGPLAELEHIESLSLRNNKISDLSPLSQMKKIKLLDLNSNYIKDIKPLFTVKSLRTLTVANNQISNAGLEGVHQLKNLKTFEISNNGLSNVEHINGMNKLIELGLSKNELVDLTPLSKLSGLQKLNLEENFISDITPLSQLTSLYDLKLGSNEIRDVRPVQELGKRMYIDIQRQKIFLDDVEKDKEVKIPIYNLQGEPIDTIQLNSEDGIVNNGSVKWGTTGEKTYEFMLDIKPEENRIKFNGTVIQNVVERLDEIKEDNEQKESVILDKTLQQHINKENLGRENLNAPITKEDLLQIKKLEILKEKGKEIKDITGLEYMTNLEKLTLEGVGLKNLEFISNLEKLNDVNVSHNQIEDITPLSALKNLQWLNLADNHIKDVSVLGSMLDLLSLKLSGNEIRDVRPLIQLGQWFSIDVGRQKIVLSEAKVNEEIQVPVYDLEGESIENIKLISEGGTFNNGVIKWNTPGEKVYKFDLDSDGISIRFNGTVIQSIVEKEEVKEPVKEVEEAKEEVKEPVKEVEEAKEEVKEPVKEVEETKEEVKEPVKEVEEAKEKVKEPVKEVEEAKEEVKEPVKEVEETKEEVKEPVKEVEEAKEEVKEPIKEVEETKEEVKEPVKEVEETKEEIKEPVEEVEGTKEEVKEPIKEVEEAKEPKKEVKESATGLDQEPKGKNQVVENEGRKANTLNKQYTNKPEEGKKSLPSTGGEASTSTLLSGITLVLSALSMFVFRKRLFKK

SEQ ID NO: 26448 - protein, 965 aa, Bacillus cereus
  strain AH820
MNKKSKINKVMLSISTMALSLGAIQTHVSAEEKVPYNVLHSKPVGIEKPVDEIGHVSKAEETLSFQERLKVGDFSQRPASITNKVTVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTTEQDTVVSAYGKLISNASSDVETVQYASNILKQYNDNFTTYVNDRMKGQAIYDIMQGIDYDIQSYLIEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWATKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKAYQEYMQQLIDNQDKYNVPEVADDYLAEHAPKSLTAVEKEISDTLPMKDAKMTKHSSQFFNTFTLEGTYTGSVTKGESEDWNAMSKKINESLEQLAQKEWSGYKTITAYFVNYRVNSSNEFEYDVVFHGIAKDDGENKAPTVNINGPYSGLVKEGIQFKSDGSNDEDGKIVSYLWEFGDGSTSAEVNPVHVYEREGSYKVALIVKDDKGRESKSETTVTIKGGSLTESEPNNRPEEANRIGLNSTIKGSLIGGDHTDVYTFNVASAKDIDISVLNEYGIGMTWVLHHESDMQNYAAYGQANGNHIEANFNAKPGKYYLYVYKYDNGDGTYELSVK

SEQ ID NO: 26449 - protein, 412 aa, Bacillus cereus; identical to SEQ ID NO: 26362
  strain AH820

SEQ ID NO: 26450 - protein, 333 aa, Bacillus cereus
  strain AH820
MKGKLLKGVLSFGIGLGVLYGGSSAQADTSTNQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 26451 - protein, 360 aa, Bacillus cereus
  strain AH820
MSSWRNNINGYCSCNNQNGVHVDSCCFSCDGTVPKLGPTGPTGATGATGATGVTGVTGATGATGVTGATGITGATGITGATGITGVTGATGATGITGATGATGATGATGATGATGATGATGATGATGPTGATGPTGATGITGATGATGATGATGVTGVTGATGITGATGITGATGITGVTGPTGATGITGATGPTGATGITGATGPTGATGPTGEIGPTGVTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 26452 - protein, 455 aa, Bacillus cereus
  strain AH820
MNNRLLKQLQNMKMNKKSLGAVALTAGIIGTTLIPQNTYAHGFVEKPGSRSALCSPTYGALNVNCGSVMYEPQSLEAPKGFPQGGPVDGQIASAGGKFGGILDQQTADRWFKNTITGGENTFTWKYTAPHLTSKWHYYITKKGWDPNKALTRADLEPIGTVQHDGSAASNHLTHKINVPTDRSGYHVILAVWDVADTANAFYNVIDVNLINDVKPDTEAPSIPNRIQAQKVTANSIELAWNASTDNVGVKGYQIFRNGEMIDTVTGPHFIDKKLQPSTEYSYTVKAIDAAGNVSKESATLTVKTTVEAPDTEAPTQPKGLHSMGTTASSVDLMWSPSDDNIGIDHYDIYRETEGSMKKIATSNTTSYMDKYLLSNTTYKYVVKAIDVAGNESIQSDIFTITTKTESASYGEWDAKKAYEKGDRVLHEGKVYEAVQSYKGNGDPNWIYALSLWKTV

SEQ ID NO: 26453 - protein, 1219 aa, Bacillus cereus
  strain AH820
MEGNGGKSKIKSPLNSNFKILSDLVGPTFPPVPTGMTGITGSTGATGTTGATGETGPTGSTGATGTTGATGETGPTGSTGATGTTGATGETGPTGSTGATGSTGVTGNTGSTGSTGATGTTGATGETGPTGSTGATGSTGVTGNTGSTGSTGATGTTGATGETGATGPTGSIGAMGTTGATGETGSTGNTGPTGSTGVTGSTGPTGETGATGETGSTGNTGPTGETGATGSTGVTGNTGPTGETGATGSTGPTGNTGATGNTGPTGETGATGSTGVTGNTGATGATGPTGSTGATGSTGPTGETGVTGNTGPTGETGVTGSTGVTGNTGPTGETGVTGSTGVTGNTGPTGSTGATGNTGPTGETGATGSTGVTGSTGATGNTGATGNTGATGSTGPTGNTGATGNTGPTGNTGATGVTGSTGVTGNTGPTGATGPTGSTGATGSTGPTGETGVTGNTGPTGETGVTGSTGVTGNTGPTGSTGATGNTGPTGETGATGSTGVTGSTGATGSTGVTGSTGATGNTGATGNTGATGSTGPTGNTGATGNTGPTGSTGATGNTGPTGSTGATGVTGSTGATGNTGPTGETGATGSTGVTGSTGATGSTGVTGSTGATGNTGATGSTGPTGNTGATGSTGPTGSTGATGNTGPTGSTGETGATGNTGPTGETGVTGSTGPTGNTGATGETGVTGPTGSTGVTGSTGPTGSTGATGNTGATGETGPTGNTGVTGSTGPTGETGVTGGTGPTGETGVTGSTGPTGSTGVTGNTGATGETGPTGSTGPTGETGVTGNTGPTGETGVTGSTGVTGNTGPTGSTGATGNTGPTGETGATGSTGVTGSTGATGSTGVTGSTGATGNTGATGSTGPTGNTGATGNTGPTGETGATGNTGPTGETGVTGSTGVTGNTGPTGSTGATGNTGPTGETGATGSTGVTGSTGATGSTGVTGSTGATGNTGATGSTGATGNTGATGSTGATGNTGPTGETGPTGSTGVTGNTGATGSTGVTGNTGATGATGSTGPTGSTGVTGSTGATGSIGATGATGSTGPTGSTGAMGVTGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26454 - protein, 230 aa, Bacillus cereus
  strain AH820
MYPRNCFSCDGRRNSGSTGNTGPTGNIGPTGSTGPTGNTGPSGNTGPTGNTGPSGNTGPTGNTGPTGSAGSASAKSIVFQGTNAGFQRIAGSPGIDSNVILYVTAGAGSIVGFAASINVNNLPAAVYTINICRNVPTNLTTPTSNYILSTITLTITDKITGTIVFSIKPTDTGSGQIQVFNPTPAVGPATVTWISITTGNPVSRGDAISLYINPGITASAVYSVFLITNI

SEQ ID NO: 26455 - protein, 148 aa, Bacillus cereus; identical to SEQ ID NO: 26098
  strain AH820

SEQ ID NO: 26456 - protein, 639 aa, Bacillus cereus; identical to SEQ ID NO: 26354
  strain AH820

SEQ ID NO: 26457 - protein, 564 aa, Bacillus cereus
  strain ATCC 10987
MKKVFSMVLAFILMLSTLPSAFAANEVPTKGSLTIHKYAHEKDGQQGEAGTGEPGQKVPEGATPIKGVKYEVVKVATFKVIERNGEIVKEAVEKVDNATPISDVTGEDGTVTFKDLPIGRYLVKEVSGPDNVNINTEPYTIDIPMTDKEGKKLNYDVHIYPKNEIKRGAVELTKVDDAGKPLKDVEFTLYHKGTDKVVVDKAGKELKDLKTDKDGKIRVDGLLYGEYYFKESKALEGYVLDPKKYEFKVEKSGAFPKDGQAGYGEIVKLDKIINYKKPTIDKKINGNLNGLPINVDEEFTYDIKTKLPGDIHLYKKYVITDNVDSRLTIIGTPVVTIDGEKVSSDVVKVTLGEKTAAGQLVTVTVENFAALKDKKELHLQIKAKVNGDINGGTVIENIAKIDYETGDKVTPPDDETTTPPVKVIVTDGKISLKKIDGATKDALEGAKFELRKDSKVVKVKGVDVVGVSDKDGIINWDNIPYGEYEIVEIEAPKYTDKGEVKSYQKLREPIKVKIDKDNQTVKLTVENNKSGWILPATGGIGTILFTVVGLVLMGAAFMFLRRKA

SEQ ID NO: 26458 - protein, 431 aa, Bacillus cereus; identical to SEQ ID NO: 26428
  strain ATCC 10987

SEQ ID NO: 26459 - protein, 1321 aa, Bacillus cereus
  strain ATCC 10987
MKERDKQNSLNSNFRISPNLIGPTFPPVPTGFTGIGITGPTGPQGPTGPQGPRGLQGPMGEMGPTGPQGVQGIQGPVGSIGATGPEGQQGPQGLRGPQGETGATGPQGVQGLQGPAGPTGATGAQGIQGIQGLQGPIGATGPEGPQGIQGVQGLPGATGPQGIQGAQGMQGLQGPSGNTGATGATGQGITGPTGVTGPTGITGPSGGPPGPTGPTGATGPGGGPSGSTGATGATGNTGATGSTGVTGSTGVTGATGSTGPTGSTGAQGLQGIQGIQGPIGPTGPEGPQGIQGIPGPTGVTGEQGIQGVQGIQGATGATGDQGPQGIQGAIGPQGATGATGDQGPQGIQGVPGPSGATGPQGVQGLQGPMGDIGPTGPEGPEGLQGPQGIQGVPGPVGATGPEGPQGIQGIQGPVGATGPQGPQGIQGIQGVQGITGATGVQGATGIQGIQGEIGATGPEGPQGVQGAQGGIGPTGPMGPQGVQGVQGIQGATGAQGVQGPQGIQGIQGIQGIQGPTGATGDTGATGATGEGTTGPTGVTGPTGPSGGPAGPTGPTGPSGPAGVTGPSGGPPGPTGATGATGVTGDTGATGSTGVTGATGETGATGVTGLQGPQGIQGVQGEIGPTGPQGVQGPQGIQGVTGATGDQGPQGVQGPQGDIGPTGPQGIQGPQGSQGIQGATGGTGAQGPQGIQGPQGDVGPTGPQGPTGIQGIQGEIGPTGPEGPEGLQGPQGIQGVQGPVGATGPEGPQGIQGIQGVQGATGSQGPQGIQGIQGVQGITGATGAQGATGIQGIQGEIGATGPEGPQGVQGVQGEIGPTGPMGPQGVQGVQGIQGATGAQGVQGPQGIQGIQGPTGATGETGATGATGEGTTGPTGVTGPTGVTGPSGGPAGPTGPTGPSGPAGVTGPSGGPPGPTGATGATGATGVTGDTGATGSTGVTGATGETGATGVTGLQGPQGIQGVQGEIGPTGPQGIQGPQGIQGVTGATGAQGPQGIQGPQGDIGPTGPQGIQGPQGPQGIQGATGATGAQGPQGIQGPQGEIGPTGPQGPQGIQGPQGIQGPTGATGATGATGLQGIQGPQGIQGPQGIQGPTGATGATGATGLQGIQGPQGIQGPQGIQGPTGATGATGATGLQGIQGPQGIQGPQGIQGPTGATGATGATGSQGPTGDTGPTGAGATGATGATGVSTTATYAFANNTSGTAISVLLGGTNIPLPNNQNIGPGITVSGGNTVFTVASAGNYYIAYTINLTAGLLVSSRITVNGSPLAGTINAPTVATGSFSATIIANLPAGAAISLQLFGLVAIATLSTTTPGATLTIIRLS

SEQ ID NO: 26460 - protein, 773 aa, Bacillus cereus
  strain ATCC 10987
MLAGATLAIGVIAPQVLPATAHADEQTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQHLVNEIKDDHQATIDYVNTAVGKTTAPINSYFSLVQDDPSVQLVTNAQKWYVEEEFKKPEYEKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIVNMTYEGKPVADNQEFIVATNNYRGSSQTFPGVSKGEVVYQSQDETRQIIVKYMQETPVIDPAADKNWTFKPIVADKLHTTFDSSPNAQKYIKKDGKISYVGPSENEFAKYAIDITKKNDDDKETGGENPTTPPTGEGNNGENPTTPPTSEGNNGENPTTPPTGEGNNGENPTTPPTDEGNNTGSGQTTTDNQNAKETTTVSEKKEERDLPKTGTSVVSTIGAGLAFVGAGFLLLFRRKKANR

SEQ ID NO: 26461 - protein, 971 aa, Bacillus cereus
  strain ATCC 10987
MKGYSKKVLVGVSFASFMLGSFQGGALAEGTKGEQVSYRNVLKMEPVGVQLPVQELAHSSKVLENKSFEKRLQFADLSQRPPEVKKKSKQLTAAKTYTIAELNQLSNQQLVDLLVTIDWEQITGLFQFNKDSLAFYQNDSRMQAIIDKLKQQGQAYTKDDSKGIETLVEVLRSGFYLGFYHTELSKLNDRSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTMWYQKIDSYINELSRFALIGTVTAKNGWLINNGIYYTGRLGTFHSTGTKGLQVVTDAMKMYPYLGEQYFVAAEQIATNYGGKDANGKVVDLDQIREDGKKKYLPKTYTFDDGAIVLKAGDKVTEEKVKRLYWAAKEVKAQFHRTVESDQPLEKGNPDDVLTMVIYNSPSEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLNNVSVKKNKSQFFHTFTLQGTYTGTTAKGEYEDWKTITQNVNDTLKRLSAKEWTGYKTVTAYFVNYRVNAAGQFEYDVVFHGINTEEGAVNKAPVAVINGPYSGKVNEAISFKSDGSKDEDGKIISYKWEFGDGAVSDEQNPTHVYTKEGTYTAKLTVTDDKGLTNTATTNVTVQKKEDNSVEKEPNNSFQTANKLQLNQILRASLGNGDTSDFFEINVDTAKNLQINVTNENNIGMNWVLYSEADLNNYVTYAQQEGNKLVGSYYTYPGKYYLHVYQYSGGTGNYTVEVK

SEQ ID NO: 26462 - protein, 372 aa, Bacillus cereus
  strain ATCC 10987
MKTKQTIAASTLALAMIAGANSAHAEVTDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDDKLAELKKAKQTAEDKLAELKENKPNTGNTLEELKKIKGNLDSLSANLELAKQDVKNKLAELQKAREDLLNKINEMKQTKQTVSDDLTKKKQDLDIKINDFKHTEKKIEDKLAEVHTTKQNVDNKINEVSQSKQTETKTGTTNTNNNARELPNAGSEQSNNMALGMLSVLGGVLLVTRNKIKTLFSK

SEQ ID NO: 26463 - protein, 455 aa, Bacillus cereus
  strain ATCC 10987
MNNRLLKQLQNMKMNKKSLGAVALTAGIIGTTLIPQNAYAHGFVEKPGSRSALCSPTYGALNVNCGSIMYEPQSLEAPKGFPQAGPIDGKIASAGGKFGGILDQQTADRWFKNTITGGENTFTWKYTAPHLTSKWHYYITKKGWNPNKALTRADFEPIGTVQHDGSTASNHLTHKINVPTDRSGYYVILAVWDVADTANAFYNVIDVNLINDIKPDTEAPSIPNGIQAQKVTANSIELAWNDSTDNVGVKGYQIFRNGEMIDTVPGTHFIDKKLQPSTEYSYTVKAIDAAGNASKESAKLTVKTAVEAPDTEAPTQPKGLHSMGTTSSSVDLMWSPSDDNIGVDHYDIYREEEGSMKKIATSNTTSYMDKNLLSNTTYKYVVKAVDVAGNESVQSDIFTITTKTESASYEEWNATKAYEKGDRVLYEGKVYEAVQSYKGNGDPNWIYALSLWKTV

SEQ ID NO: 26464 - protein, 580 aa, Bacillus cereus
  strain ATCC 10987
MQPNTPNRNLVIRTITQLINSLPTASLTQISALFQFLFQNLSSLISCSNISDPLLQQTFNLILQGILNSSLLNITGIPGPTGATGPRGFPGPKGATGPQGVQGIQGPEGPEGATGPQGVQGLQGPEGLAGATGPQGVEGLQGPEGPPGPTGPQGVQGIQGPPGPPGPTGSGTGMGVPGPPGPTGPQGVQGIQGPEGPEGPTGPQGIQGLQGPEGLEGPTGPQGVQGMQGPEGPPGPTGPQGVQGIQGPEGPPGPTGECECPPGPTGPTGPTAPTGPACNFLVYVTNAGAIDDLTNDTVSVINTGTNTVVATITVGNAPLEVTVSPNGTRAYVTNIFSNTVSVINTATNTVIATIPVGSNPIGVAVSPNNTTVYVGNHGNNTVSVINAATNTVVATIPVGNAPQGITVSPNGAFAYVANELSNNISVIDTATNTVSATIPVGIRPRIIVFTLDGTRAYVTNQNSNTVSVIDTTTNSVINTISVGSEPVGIDITPDGTRIYVVNKVSNNVSVISVATNTVIDTIPVALSPDQVTIIPDGTLAYVTNQGSNTVSVINTATNTVIDTVPVGVAPTGIATGTICE

SEQ ID NO: 26465 - protein, 503 aa, Bacillus cereus
  strain ATCC 10987
MFNKKMVAMAMTVPLVMGTITTVSALEKQQQVKLEAYSPQKKATEYLKENAAQYGLKADLSDLQYISTTETSVASYVRFQQVVNGAPVFSKQITVTLNGEGKGVLAVSDYQSVKGVKEATTKISEKDAIQKSMAYVGEVSEQNLWAPTEKEFGYIVEEGIARPVYKVVVHSNNPFGAWETFIDAENGKLIKKVDINRKAEGSGKVFLPNPVVSSGSLAGLKDNNDADSPALTNQLKTVTLKGLDGTGFLIGEYVTISSKAKTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDNNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26466 - protein, 336 aa, Bacillus cereus
  strain ATCC 10987
MKRSKTYLKCLALSAVVASSALALSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKSFTLDWKNKKLVEKK

SEQ ID NO: 26467 - protein, 982 aa, Bacillus cereus
  strain ATCC 10987
MSKYLKRISVICFIFTVLIGQIFMPIIGHAQELNTTGFVDSFSFEKTKLNYGEKNTIHVNFSEKPGKKMKSGDTLTLALPPELKGYSGTIPLKDDSGRIFGTCQINASNVVCTFNDTVEKLENIRGNFNFTVQGTNVEAGKTKDVQTNLGTDLEKQMVSITHPKGEGTEPGIFFYKSGDIQPDKSNEVRWFLNINLKKQYLHDNIVLKDTLQEGQTLNKDSFTITINNKEYLSLKQFQDRGYGYIKLISDNSFEVVIYRHMANATSFTVFYTSTITDSGKKLKYLQNDYKLDYQILYEKPSTESNSVKVENISFGGGAEGVLPAKGTLQIVKHIEGDEKKFIPGVSFKLFTESGQQIGDSYTTNQDGIVEAPNLTPGNYYVQEISAPNYVEFDSQAKIPFTIKTDATNGIKLMVPNKLKTTSVAGTKTWEGDKVNDRPKTIKVDLLQNGKVIATKEVTAENDWKYEFGKLPAVDSEGKAHTYEVKEQPVSGYQSKVNGYDITNIKIQEAIEVEEQNKEETTEELEDLEKPEEPKVTEEPNVLEKPEVKEKPEIWVKPIEEENKEETTEELEDLEKPEEPKVTEEPNVLEKPEVKEKPEIWVKPIEEENKEETTEELEDLEKPEEPKVTEEPNVLEKPEVTEKPEIWVKPEEEENKEETTEELEDLEKPEEPKVTEEPNVLEKPEVKEKPEIWVKPIEEENKEETTEELEDLEKSEEPKVTEEPNVLEKPEVKEKPEIWVKPIEEENKEETTEEMEDLEKPEEPKVTEEPNVLEKPEVKEQPEILVTPIEEENKEETTEEMEDLEKPEEPKVTEEPNVLEKPEVKEKPEIWVNLEEVENKEGTTEEITEELEGLLKPEELKVKEEPNVLEKPEVKEQPEILVTPIEEENKEETTEEMKDLLKPEEPKVKEEPNVLEQPEVSSKPEVQNKQDVQDKSEVTSNEEDNKQLKVLPQTGGASTEATSVIAGMLTLILGARLFRRSKN

SEQ ID NO: 26468 - protein, 378 aa, Bacillus cereus
  strain ATCC 10987
MHNVLLLDTFSFGLIRTEIVKYLKKVKSHNRVFDLFITIQMEVWNVKGKLLKGVLSFGIGLGVLYGGSSVQADTSTDQNNTLKVMTHNVYMLSTNLYPNWGQSQRADLIGAADYIKNQDVVILNEVFDNSASDRLLGNLKKEYPNQTAVLGRSNGNEWDKTLGSYSSSTPEDGGVAIVSKWPIVEKIQYVFAKGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYDDYSDHYPVAATISMK

SEQ ID NO: 26469 - protein, 965 aa, Bacillus cereus
  strain ATCC 10987
MNKKSKINKVMLSISTMALSLGAIQTHASAEEKVPYNVLHSKPVGIEKPVDEIGHVSKAEEILSFEERLKVGDFSQRPASIPNKAAVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFELGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGATRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLGQKEWSGYKTVTAYFVNYRVNSSNEFEYDVVFHGIAKDDGENKAPTVHINGPYNGLVKEGIQFKSDGSKDEDGKIVSYLWDFGDGSTSAEVNPVHVYEREGSYKVALRVKDDKGKESKSETTVTVKDGSLTESEPNNRPEEANRIGLNTTIKGSLIGGDHTDVYTFNVASAKNIDISVLNEYGIGMTWVLHHESDMQNYAAYGQANGNHIEANFNAKPGKYYLYVYKYDNGDGTYELSVK

SEQ ID NO: 26470 - protein, 163 aa, Bacillus cereus
  strain ATCC 10987
MLEKVSQIVLIFGIAFSLSACTETKDSNESKQEDVQDKVYKIGETVDVDGLQVTIDSVKLGYPDYDEDKKKEEILGIIFKVENNSKKEIPFAFYEFEITDKKGTRFKEYNNPDSFISKKLAPEEKIQDIMLFDVAKENTYIATYRPEFTRENRTIKFELKPNK

SEQ ID NO: 26471 - protein, 52 aa, Bacillus cereus
  strain ATCC 14579 / DSM 31
MSEIKKALNTLEIEDFDAIEMVDVDAMPENEALEIMGASCTTCVCTCSCCTT

SEQ ID NO: 26472 - protein, 431 aa, Bacillus cereus
  strain ATCC 14579 / DSM 31
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEVAVYDGVKSFYNIKR

SEQ ID NO: 26473 - protein, 3373 aa, Bacillus cereus
  strain ATCC 14579 / DSM 31
MKQVLKCFNVVTMITLLLSIILPSPSAFAEINKKSWDELQGNDVKIKAEQVNAEIYKGEVAKREHVFQYTIENTGATPIQELVLKQNNENEITFLSQSVKVNGEKLPENKVADFYVEEKDKGGKVLSSNLKIRDLKSHEKMTVLIKASRTQHFNKEYKQKISVQKDKVQIGNMSVDVEGIPSEEKVAANADEEADSSKKEVGPSANNTIKKVDEKLKVSVEDKNNPTSKTELPKQPVTEAEKQPEKEAVKQNVAEVQAAPENASKVQIQTGDKQGFGDPLYSTITAGNLVQTGNVTLGLTTDHYGRQSLGYKTNKMTVDVDNDDSTFNSSTGAFPTIPAGSKVKKAYLFWTAAMGTPTYPSKEYRVSDADVREPVKMKMGNKGYAEVSADSIRKADYLPYISNYSGAGAGYVAYADVTNVIAQQGISQTVTVANVPQIKFEKGSGYYWGNWNLILVYENHKETVKDMKIWEGLVSQKSTAWTDISVNKINTPKEGAFKAKFSYFSSQGDPAEKDGYAYDYGEYDFGAGYIKIKNINGKDNDANDSSMTEVQVDGTNEFVTKKYPGYNPDWTNSFSTDIHTYHLEGPTQVKNDLKEGKMRFRAYAGTGDIYVLNNATFVTEHNAPNLQVDKKALDSTGKEIKEIKAGEEFTYQIEVKNDTKNNQAPVSNVKGFDKLDDRLEYVPGSIQYISGSNKGNKTDDASDDEAEFVNNQIDFRVGEGANAKDGGVLKPGESAIITFKVKVKASVQSDTTVKNIVVVKGQDSTEVNYETADDADITVTTPKEIPGEIEAKKIASNKTPKLGEEVEYRITFKNKTKDGRLDVLTIEDELPSNLEYVKDSLKAEGAKPEPVELKFENGKVIAKYPEIMDMEERSIVFKTKVKETAKIGEEIVNKATVSDKTNPPKNLEEKITPQHKAGKIAAKKKATNKKPKLGEEVEYQISFQNTVENGKLDAVTIEDEIPANLEFVQGSERAEGAEPNPVELKVENGKVIAKYPEIMDTKERSIAFKVKVKEEAKAGETIVNKAVVSEPNGQTEHPEEKITPDYKYGKVDVEKSVTNQTPKLGEEVEYRITFYNTVENGKLEKVLVEDTLPKGVEYVKDSLKAEGIKPEPVELKVEDGKVMAKYPEITDTEKRSIVFKVKVKDSAKVGEAIVNKAIAKDPKNEPVESKVVITPQSKKGEIAATKVVNNKKPKLGEEIEYRISFHNTVENGKLEEVRVEDTIPKGLEYVENSIKAEGEAPGPVELAVENGIVKAKYIDIMDMKERSIVFKVKVKEEAKVDKEIVNKAIVDDTKNPPIEPEERITPQHKDGIIDSKKTVDNPSPKLGEEVEYRISFKNTVENGKLEKVIIEDTIPNGLEYVKGSEKAEGDKPAPLKLSVKDGKVIAEYENITDMKERSIVFKVKVKEEAEVGKEIINKAIVDDMKHPKEPEAKITPLHKDGKIKAKKSVNNETPKLGEEVEYRISMKNTVKYGKLTDVIIEDTLPEGLEYVENSLKAEGVGTDSVELKFENGKVMAKYPEIMDTEERSIVFKVKVKEGVTVGKKIINKATIDDSQNKPVNPTAEIIPQYKDGKLEAKKMVNNETPKLGEEVEYRISFKNTVEHGKLTEVKIEDDLPNGLEYVKDSVKVEGSKPDPVELKFENGKVMAKYPEITDTKERSITFKVKVKGKVSDSIVNEAIVSDTKHPPETPTAEIIPQHKDGKVKAKKTVNNETPKLGEEVEYRISFKNTVEDGKLAEVKIEDTLPEGLEYVENSVKAEGSKPDPVELKFENGKVMAKYPEITDTEERSITFKVKVKDEVKVGKKIVNKAIIDDTKNEPETPTAEITPQHKDGKVEAKKTVNNETPKLGEEVEYRISFKNTVENGKLAEVTIKDDLPNGLEYVKDSLRAEGSKPDPVELKVKDGKVIAKYPEIMDTEERSIVFKAKVKEEFKVGEGIVNKVVVDDTKDPTTSEVTITPEYKDGKLKAEKFVNNKKPKLGEEVEYRISFKNTVENGKLVEVTVEDEIPAGLEYVENSLQAEGSKPSPVELKFENGKVMAKYLEIADTKERSIIFKVKVKEEAEIGKEIVNKAIVVDTKNEPEEPRVEITPQYKDGKIAAQKVANNHKPKLGEEVEYRISFKNTVENGKLVEVNIKDTLPNGLEYVEGSITAEGSKPKPVELQVKNNKVMAKYPEITDTEERSIVFKAKVKESVKVGEEIVNEAIIDDTKNLPEEPYVPITPQYKDGKIEARKEVSNHEPKLGEEIEYRIIFNNTVKDGKLAEVKIEDEIPAGLEFVEGSEKAEGEEPKPVELKVENGKVMAKYSEIMDTKERSIVFKVKVKDSVAIGKDITNKAIIHVDDPNHPVIDPTAKITPQYKDGKIATHKKVNNHKPKLGEEIEYRISFNNTVKDGKLAEVKIEDEIPSGLEYVKDSLKAEGDKPAPVELKEEAGKVSAKYENITDMKERSIIFKVKVKDSVEVDKAIVNKAIVDDTKNPPERPEVEITPQHKDGKVKADKKVNKKDPKLGEEVEYRISFKNTVENGKLAEVKIEDQLPTGLEYVKDSLKSEGNEPAPVELKEEAGKITAKYENIIDTAERSIIFKVKVTEVAKVGKKIVNTAIVDDDNPKNPPQKPEAIITPEYKDGKLKAEKTVNNPAPKLGEEVEYRITFRNVVEHGKVAKVKIKDELPTGLEFVEGSERAEGENPKPLYVKVKNGIVLAEYPEITDMKERSIVFKVKVKEKAKVGEEIVNKAIVEDTINPPEQPNISIQPQYKDGALQAEKTVSNHEPKLGEEVEYRISFENTVENGKLTEVKVEDEIPAGLEYVQDSIKSDGPEPYPVELKVENGKVTAKYPEITDTKKRSIIFKVRVQETVQVGKEIVNKAIVDDNNPTPPPVESLIPITPQYKDGKLEARKEVSNHEPKLGEEIEYRITFNGTVDGGKLVDVKIEDEIPSGLEYVKDSLEAVGDKPVPTELKVENGKVTVKYPEITDTKERSVIFKVKVKETAKVGGEITNKAIIEVDDPKHPVIEPTAKIKPEYKDGKLTAAITVSNKEPKLGEEVEYRISFKNTGENGKLDVVTIEDEIPAGLEYVQGSIRFEGAEPNPIELKMEFGKVIAKYLEITDTKERSIIFNAKVKEAPSKGITNKAVVDDKINPPLEPTVTILPKTKEDFKIPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEVRLEKLIKEPQVKTERELPKTGAASPWMMSVGAGISFLVGGVLFVLGRRRKQ

SEQ ID NO: 26474 - protein, 353 aa, Bacillus cereus
  strain ATCC 14579 / DSM 31
MYPRNFFSCDGRRNSGSNGNTGPTGNTGPTGNTGPTGNTGPTGNTGPTGNTGPTGNTGPTGNTGPTGNTGPTGNTGPTGNTGPTGNTGPTGNAGPTGNTGPTGNAGPSGAGFQSTTTFSLAAAPNYKKGQVVTYTGSGYVVKKDAPQGFPNISPDYIVLVESGPTGSTGPTGITGPTGNTGPTGITGLTGSADSASAKSIVFQGTNAGFQRIAGSPGIDSNVIPYVTAGAGSIVGFSASININNLPAAIYTINICRNVPTNLTTPSSSYILSTITLTTTDKITGTMVFSIKPTDSGAGQIQVFNPTPAVGPATVTWTSITTGNPVARGDAISLYITPGITASAVYSIFLITDI

SEQ ID NO: 26475 - protein, 964 aa, Bacillus cereus
  strain ATCC 14579 / DSM 31
MLVGVSFASLMLGSFQGGSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGHPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDVNLNKEYQDYMQMLVDNREKYNVPLVSDDYLANHASKPVSDIAAEITAEAKLKNVSVKKNKSQFFNTFTLQGTYTGIAAKGEYEDWKTITQNVNDTLKRLSAKEWTGYKTVTAYFVNYRVNASGQFEYDVVFHGINTEEGAENKAPVAVINGPYSGNVNEAISFKSDGSKDEDGKIISYKWEFGDGTVSNEQNPTHVYIKEGTYTAKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYSGGTGNYTVEVK

SEQ ID NO: 26476 - protein, 1093 aa, Bacillus cereus
  strain ATCC 14579 / DSM 31
MGKKVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLIKVQAIAYRGTDTVQNATVLLERNEEKLSSDLAVNWEAAGSLKIKKVGENGEVLAGAVFEVFNVNNESVGKITTGADGMAELNNLPIGTYTLKEIKAPTGYVSDDKPQTIEVKTGETGAVQIVNNKVKGSIEIKKLSDSGKILPNVEFTVFTEDGKEVKKVVTKENGIANVEGLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIETKATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPFIKTTATNKADGSKELDASKSVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEQPNSGKNTTTPEQPNEQVKEQPQLKKEIQSKIGWLPQTGTNLTSWISMAAGALLLIVGGVIFLKRKNA

SEQ ID NO: 26477 - protein, 412 aa, Bacillus cereus
  strain ATCC 14579 / DSM 31
MKKAKEIAKCVAVASVIMSGSFGLQATSAFADSKGTVENLQNGGKVYNSFKTTYDMKQNIKNSIKVSFIEDPYADKKIAIVTTDGSNIDAKYTINSGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTETTSDLKITNRRISDQYNIEWVSSKWWGTNNKDTYNEFFTNHYKLDWKNHQVTLDNQKALEEQMNSINSVNDKLNKGKGKLSLSMNGNQLKATSSNAGYGISYEDKNWGIFVNGEKVYTFNEKSTVGNISNDINKLNIKGPYIEIKQI

SEQ ID NO: 26478 - protein, 251 aa, Bacillus cereus
  strain ATCC 14579 / DSM 31
MSEEYNILHGPALEPNLIGPTLPSIPPFTFPTGPTGITGPTGATGFTGIGITGPTGVTGPTGIGITGPTGVTGSTGIGITGPTGVTGSTGIGITGPTGVTGSTGIGITGPTGATGLGILPIFGTITSEVGIGFSAVVNTNINFTIPGPASGTTLNPLNNSITIDTTGVYSVSFSIVFVIQAISSSILNLTINDSIQFAIETRVGGASGVRATSARTDLLPLNQGDVLRVRIREATGDIIYSNASLVVIKVD

SEQ ID NO: 26479 - protein, 824 aa, Bacillus cereus
  strain ATCC 14579 / DSM 31
MALPLPLIGTTGPTGNSGPIGPTGGHEGPVGPTGVTGPTGATGPQGPQGIRGIQGPRGTTGAQGIQGVIGDTGEQGITGPTGLQGAQGLIGNQGLIGDIGVQGLEGIQGATGPAGSQGIQGIQGIQGEIGERGQTGAQGMQGERGVTGVSGVTGPQGPQGVQGIKGEQGAIGIQGEDGFQGIQGITGEEGPQGAQGIQGEVGPTGSTGMQGAQGISGIKGITGAIGLQGPQGVQGIQGITGATGFQGIKGIRGITGATGSIGTQGSEGPPGGPTGVTGPIGPSSGVTGPAGPPGPPGGPTGPTGATGSTGVSGGIGPIGGQGVQGITGPTGHQGVRGAQGAQGVVGAVGVQGAQGPQGNQGITGPTGAEGSQGIQGPLGVTGPTGAEGPKGIQGIQGVIGPTGAQGMVGIQGIAGPVGVTGAEGAQGAQGIRGATGPAGAQGIQGVQGIQGETGAAGTQGPQGVQGIQGTTGLTGTQGAQGPQGVQGIIGPTGAIGLQGPQGLQGITGPTGAQGVQGIQGVQGIIGPTGAQGIRGPQGNTGEIGITGPQGVQGAQGSQGPQGPQGNVGITGATGETGATGATGATGPQGVQGVQGITGIQGITGTAGNTGATSSQGIQGIQGVQGLQGPTGASGVTGASGSIGPVGAQGSQGPSGVVGPTGATGSAGSIGFFGIAGATGATGLPSGGGYFFSTSTSTIAANALIPINSGSTVFGSDVSLTNATTVTLSTPGIYLVSYYFQGDPTAGNETISVRLTLNGTQVAGSFIFYVTGGTFILEPAVSNTMVIEVTFSNATLSLQNGPLAIGHVTTLSGVITASLNVLKIV

SEQ ID NO: 26480 - protein, 837 aa, Bacillus cereus
  strain ATCC 14579 / DSM 31
MLVKNQDKCSKFQAPIPFPPPGITGPTGPTGPTGALGGPTGPQGIQGVQGPIGPTGPQGIQGVQGMQGENGPTGPTGLTGPQGSQGNQGPMGERGPQGIQGVQGIQGERGPTGPTGIQGIQGIPGPIGPTGPTGIQGIQGMQGEIGPTGPTGIQGIQGVQGEIGPTGPTGNTGIQGVQGNLGGSGLQGVTGIQGIQGPIGPTGPTGSQGIQGEQGPMGPQGETGVQGLQGPQGEMGQVGPTGIQGIQGVQGVIGPTGPTGLQGDPGPTGPTGATGITGPTGSATGPTGATGPTGPPGGPTGPTGPAGSPGGPTGPTGATGATGATGATGATGIQGVQGIQGPTGATGVTGLQGVQGPMGATGPTGDQGIQGPQGIQGVTGPTGPQGLQGIQGPVGATGPTGPQGVQGAQGPIGPTGPQGLQGIQGEQGVRGATGPTGLQGLQGIQGPSGPTGPQGVQGVQGPSGITGPTGPQGIQGIQGPQGSIGPTGPQGIQGVQGPQGPTGQTGATGPQGIQGIQGPIGPTGPQGIQGIQGVQGPQGPTGQAGPQGLQGITGQAGPTGPTGATGPTGATGPQGPQGIQGPQGATGQAGATGQTGATGPQGPQGIQGPQGVTGQAGATGPTGATGPQGIQGIQGPQGVTGATGATGATGVTGATGPTGIQGIQGITGATGVTGITGPTGATGPTGLTGATGSSAISTGGGYFFSTSTSTIAANANIPINSGSTVYGTGVSLTSATTVTVTTPGIYLVSYYFQGDANGGNETVSVRLLLNGTQLTGSFIQNVTTSTVVIEPAISNTLLVNVTSANSTLILQNGPLGVGHVTTIAGAITASLNVVRIL

SEQ ID NO: 26481 - protein, 91 aa, Bacillus cereus
  strain ATCC 14579 / DSM 31
MDKELKANTSYKYVVTAVDLAGNESSRSDVLDVTTKAEDSTYEKWDARKAYTKGDRVVYERKVYKAVQGYQGNGDTNWIFALSLWKPVLSK

SEQ ID NO: 26482 - protein, 380 aa, Bacillus cereus
  strain ATCC 14579 / DSM 31
MHMKEKRYKNMKTKQTIAASTLALAMIAGANSTHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNDNAKELPNAGSEQSNNMALGMLSVLGGILLLTRNKIKTLFSK

SEQ ID NO: 26483 - protein, 960 aa, Bacillus cereus
  strain ATCC 14579 / DSM 31
MNKNLRFTQMMIGISTMALSFGSIQTQVSAEETAPYNILQMKPMGTETSKDEIVHATKADETLNFEERLKIGDFSQRPTLVMKRDEIQLKQSYTLAELNKMPNSELIDTLSKISWNQITDLFQFNQDTKAFYQNKERMNVIINELGQRGRTFTKENSKGIETFVEVLRSAFYVGYYNNELSYLKERSFHDKCLPALKAIAKNRNFTLGTAEQDRVVTAYGKLIGNASSDTETVQYAVNVLKHYNDNLSTYVSDYAKGQAVYEIVKGIDYDIQSYLQDTNKQPNETMWYGKIDNFINEVNRIALVGNITNENSWLINNGIYYAGRLGKFHSNPNKGLEVITQAMNLYPRLSGAYFVAVEQMKTNYGGKDYSGNAVDLQKIREEGKQQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTVKQTLFSKYGSWDFYKYSFALQSYLYNHQFETFDKLQDLIRANDVKNYDSYRESLSNNTQLNAEYQAYMQQLIDNQDKYNVPKVTNDYLIQHAPKPLAEVKNEIVDVANIKDAKITKYESQFFNTFTVEGKYTGGTSKGESEDWKAMSKQVNQTLEQLSQKGWSGYKTVTAYFVNYRVNAANQFEYDIVFHGVATEEKEKTTTIVNMNGPYSGIVNEEIQFHSDGTKSENGKVISYLWNFGDGTTSTEANPTHVYGEKGTYTVELTVKDSRGKESKEQTKVTVKQDPQTSESYEEEKVLPFNTLVKGNLITPDQTDVYTFNVTDPKEVDISVVNEQNIGMTWVLYHESDMQNYVACGEDEGNVIKGKFAAKPGKYYLNVYKFDDKNGEYSLLVK

SEQ ID NO: 26484 - protein, 442 aa, Bacillus cereus
  strain ATCC 14579 / DSM 31
MVKYSKISKWILGVGLVTITCNGLQIQAETKEKNVKNVLQMEPVGIQKSVDELAHPSKVQENESFTKRLKLADLSQRPLAPTDNIKPLAEEKKYSMAELNQLNNKQLTDLLVTIKWYQIPELFQFNSDSLKFYQDDSRMQAIINKLAEQGQAYTQDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLEKWTC

SEQ ID NO: 26485 - protein, 442 aa, Bacillus cereus
  strain ATCC 14579 / DSM 31
MKSGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNQLNEEYQSYMQMLIDNRDKYTIPQVSDEYLTQHDPKSLSDVTSDITNEAKLKDVKVTKNTSQFFNTFTLQGTYTGSVAKGEVEDWKVMNEATNDMLKRLSGKEWTGYKTLTAYFVNYRVNNAGQFEYDVVFSGVNTEEGTAVEKEPNNSFETANPLSLNILLRGTLSNQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 26486 - protein, 455 aa, Bacillus cereus
  strain ATCC 14579 / DSM 31
MNNRFLKQLQNMKMNKKSLGAVALTAGIISTTLIPQNAYAHGFVEKPGSRSALCSSTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVIGTHFIDKKLQPSTEYSYTVKAIDAAGNVSKESTALTVKTTVEIPDTEAPTQPKGLHSMGTTASSVDLMWSPSDDNIGVDHYDIYRETEGSMKKIATSNTASYMDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 26487 - protein, 295 aa, Bacillus cereus
  strain ATCC 14579 / DSM 31
MFDKNKILQANAFNSNLIGPTLPPIPPFTLPTGPTGGTGPTGVTGPTGVTGPIGVTGPTGVTGPTGVTGPTGITGPTGVTGPTGVTGPTGVTGPTGVTGPTGVTGPTGVTGPTGVTGPTGVTGPTGVTGPTGSTESCLCDCCVLPMQNVLQQLIGETVLLGTIADAPNTPPLFFLFTITSVNDFLVTVTDGSTSYVVNISDVTGVGFLPPGPSITLLPPVDIGCECDCRERPIRELLDTLIGSTVNLLASTGSIAADFNVEQTGLGIVLGTLPINPTTIVRFAISTCKITAVNIL

SEQ ID NO: 26488 - protein, 234 aa, Bacillus cereus
  strain ATCC 14579 / DSM 31
MILIEYKNRDIFNTFIFSDVKPIIIPHHPTGPTGVTGRTGITGPTGVTGRTGITGPTGVTGPTGVTGKTGVTGPTGDTGSTGITGPTGVTGPAGVGLTNYLYIFDTTNQSIVVGGSVTFNTNGPIIGSAFTHIAGTGNITINTRGTYVAEFQLEAARENQFSFALNGTPIPGGRYGTGSPHSINQGTVAFTVTTVPSTLTLINNTSSAGTITLSNNDGGSLTNVSASISIFQVG

SEQ ID NO: 26489 - protein, 536 aa, Bacillus cereus
  strain ATCC 14579 / DSM 31
MDELLSSTLINPDLLGPTLPAIPPFTLPTGPTGSTGPTGPTGSTGPTGPTGSTGPTGPTGSTGLTGLTGPTGPTGPTGPTGPTGPTGSTGLTGPTGPNSDTGPTGPTGPTGPSDGPTGPTGATGPTGPPDGPTGDTGPTGSTGPTGDTGPTGSTGPTGDTGPTGSTGPTGDTGPTGSTGPTGDTGPTGSTGPTGDTGPTGSTGPTGPGCIEPLPTFTQIVYVNKAGNDATADGSECAPFLTVTAAMASITDAIAPFPDPLNITKRYAISIGPGNYIEPLIHLKANVQLVGTSTLLTRLQIPFDINDPSWFDLNFSQDPRSGFVNLTLLSGPLDFNFQTAQSVSGKLFFVSVNITPTPIFTALSTSVNQVNIRDSMLSGGYTQNGINMAMFASFVSSGNITINSQATTDTQVNLVGGGINGNVIINVLPGHIPIDPLNLTSFAITENIFNPSPNSGNLFVNGANNVITRVRATVDSLPIRSRINLIGTSTSLIRVDDAFDLAYTPINPANWAPLPPTTVQEALDRIAALMAITIGTP

SEQ ID NO: 26490 - protein, 553 aa, Bacillus cereus
  strain ATCC 14579 / DSM 31
MKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGAVFSLFKKDGTEVKKELATDANGHIRVQGLEYGEYYFQETKAPKGYVIDPTKREFFVKNSGTINEDGTITSGTVVKIEVKNNEEPTIDKKINGKLEALPINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDSANKNKLKGAEFVLKDNNGKIVVVAGKEVTGVSDENGVIKWSNIPYGDYQIFETKAPTYTKEDGTKTSYQLLKDPIDVKISENNQTVKLTIENNKSGWILPVTGGIGTTLFTVIGLTLMLTAAFVFFRKKFARN

SEQ ID NO: 26491 - protein, 893 aa, Bacillus cereus
  strain ATCC 14579 / DSM 31
MGNKKEIAIVALTTGFVLTSVTPYGVGHAEETGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLMAQGGTHNGVNVNGIGEDRMFDIFYYANTDELNMTSNFSELKLACLKVATNKYGANSIEVQAVQNAFDAAKITGTVKENEKTAENQAPELTVPFTITLRVGDTFDPMRNVKAVDKEDGDLTNKVKHKGDVDTSKPGTYIVEYMVVDSQGRNATATQTVIVEGNGETSDLEPKLTVPVGATIHVGDSFVPMAEVLAIDKEDGDLTSKIKVDGEVDTTKAGTYVLTYTVTDSKGHEVTAKQTVTVKVREEVKNDKPILKVPATTSITEGDQFDPLVGVSATDKEDGDLISKVAYEGTIDTTKAGTYEIIYSVRDSVGNEVNAIQKVLVKDKETSKANGLANKENKSNISNNSNSDKKEYTYKELPKTGVSTTNSAAIGILIIIVGTVLTLVRKFRKIQK

SEQ ID NO: 26492 - protein, 440 aa, Bacillus cereus
  strain ATCC 14579 / DSM 31
MYQNERLTWFQEGNAEFFAGSTRTNNVVPRKSIISGLSSDPASRYTAKQTLFAKYGSWDFYKYSFALQSYLYNHQFDTFDKLQDLIRANDVKNYDAYRELLSKNTQLNAEYQAYMQQLTDNQGKYNVHQVTNDYLIQHAPKPLAEVKNEIVDVANIKDAKITKHESQFFNTFSVEGTYVGGISKGESEDWKTMSKQVNQTLEQLSQKGWSGYKTVTAYFVNYRVNAANQFEYDIVFHGVATEEKEKTTTIVNMNGPYSGIVNEEIQFHSNGTTSENGKVISYLWNFGDGITSTKANPTHIYGEKGTYTVELTVKDSRGKESIEQTKVTVKQDPQTGGSLEEEKILPFNTLVKGNLVTPDQTDVYTFNVTDPKEVEISVVNEQNIGMTWVLYHESDMQNYVACGEDEGNTIKGKFVAKPGKYYLNVHKFDDKNGEYSLLVK

SEQ ID NO: 26493 - protein, 163 aa, Bacillus cereus
  strain ATCC 14579 / DSM 31
MSRKDRFNSPKIKSEISISPDLVGPTFPPIPSFTLPTGITGPTGNTGATGDTGPTGPTFNINFRAEKNGAQSFTPPADIQVSYGNIIFNNGGGYSSVTNTFTAPINGIYLFSANIGFNPTLGTTSTLRITIRKNLVSVASQTIDIQFSAAESGTLTVGSSNFF

SEQ ID NO: 26494 - protein, 279 aa, Bacillus cereus
  strain ATCC 14579 / DSM 31
MKRNDNLSLNKGMIGPENIGPTFPILPPIYIPTGATGPTGITGPTGETGPTGITGPTGVTGPTGITGPTGATGPTGITGPTGATGPTGITGPTGATGPTGETGPTGITGPTGATGPTGITGPTGATGPTGETGPTGETGPTGVTGPTGITGPTGATGPTGITGPTGATGPTGETGPTGITGPTGATGPTGGIGPITTTNLLYYTFADGEKLIYTDADGIPQYGTTNILSPSEVSYINLFVNGILQPQPLYEVSTGKLTLLDTQPPSQGSSIILQFIIIN

SEQ ID NO: 26495 - protein, 503 aa, Bacillus cereus
  strain ATCC 14579 / DSM 31
MFNKKMVAMAMTVPLVMGTISTVSALEKQQQVKLEAYSPQKKATEYLKENAAQYGLKTDLSDLQYISTTPPSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKARTKSTNLQFNYTRANDSFEDVMSYYHIDTLQRYIQSLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26496 - protein, 179 aa, Bacillus cereus
  strain ATCC 14579 / DSM 31
MFKKIATVTLAGTLAFSLSACDEKKEVAKTVSNNKKEEQSSAKKENTKNEDTREYNVEKTTQIRNQKLTVHKVQIAQVAEYDKLEKGNEFVIVHVTVENIGNQKVRINPLDFYLERGDGSIVDHTFSTSNKNVFKIKDVDPNGKITGAITFEAKKGDSNLELIYRPDVMSKEEVKVELK

SEQ ID NO: 26497 - protein, 128 aa, Bacillus cereus
  strain ATCC 14579 / DSM 31
MYAFNSAGISLDLGLNAPVPFNTVGSQFGTAISQLDADTFVIAETGFYKITVIVYTAAISVLGGLTIQVNGVSVPGTGATLISVGAPIVVQAITQITTTPSLVEVIVTGLGLSLALGTNASIIIEKIA

SEQ ID NO: 26498 - protein, 336 aa, Bacillus cereus; identical to SEQ ID NO: 26375
  strain ATCC 14579 / DSM 31

SEQ ID NO: 26499 - protein, 333 aa, Bacillus cereus
  strain ATCC 14579 / DSM 31
MKGKLLKGVLSLGVGLGALYSGTSAQAEVSTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTNQLKEIQDFIKNKNIPNNEYVLIGGDMNVNKINAENNNDSEYASMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 26500 - protein, 956 aa, Bacillus cereus
  strain ATCC 14579 / DSM 31
MMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDTYTVPEVADDYLAEHETKSLAAVKKEISDTLPMKDTKMTKHNSQFFNTFTLEGTYTGSVTKGESEDWKEMSKRVNESLEQLAQKEWSGYKTVTAYFVNYRVNSSNEFEYDVVFHGIAKDDGENKAPTVNINGPYSGLVKEGIQFKSDGSNDEDGKIASYLWEFGDGSTSVEVNPVHVYEREGSYKVSLRVKDDKGKESRSETTVTIKDGSLTESEPNNRPEEANRIGLNSTIKGNLIGEDHTDVYTFNVASAKDIDISVLNEYGIGMTWVLHHESDMQNYAAYGQANGNHIEAKFNAKPGKYYLYVYKYDNGDGTYSLSVK

SEQ ID NO: 26501 - protein, 163 aa, Bacillus cereus
  strain ATCC 14579 / DSM 31
MLKKVSQIVLIFGIAFSLSACTETKDSNESKQEDVQDKVYKIGETVDVDGLQVTIDSVKLGYPDYDENKKKEEILGIIFKVENNSKKEIPFAFYEFEITDKKGTRFKEYNNPDSFISKKLAPDEKIQDIMLFDVAKENTYIATYRPEFTHENRTIKFELRPNK

SEQ ID NO: 26502 - protein, 503 aa, Bacillus cereus
  strain B4264
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIIEEGIARPVYKVVVHSNNPFGAWETFIDAENGKLIKKVDINRKAEGSGKVFLPNPVVSSGSKVGLKDNNDADSTSLTNQLKTVTLKGLDGTGFLIGEYVTISSKAKTKSTNLQFNYTRANDSFEDVMSYYHIDTLQRYIQSLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26503 - protein, 300 aa, Bacillus cereus
  strain B4264
MKRNDKLSLNKGMIGPENIGPTFPILPPIYIPTGATGPTGITGPTGATGITGPTGITGPTGETGPTGETGPTGETGPTGITGPTGETGPTGITGPTGETGSTGETGPTGITGPTGETGPTGETGPTGITGPTGETGPTGETGPTGITGPAGETGPTGITGPTGATGPTGETGPIGITGPTGETGPTGITGPTGVTGLTGETGPTGATGPTGGIGPITTTNLLYYTFADGEKLIYTNADGIPQYGTTNILSPSEVSYINLFINGIMQPQPLYEVSTGKLTLLDTQPPSQGSSIILQFIIIN

SEQ ID NO: 26504 - protein, 887 aa, Bacillus cereus
  strain B4264
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLLRMQQIYEGKEVYGHQLTAHVDKKGIIKSISGASAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILATSASTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLMAQGGTHNGVNVNGIGEDRMFDIFYYANTDELNMTSNFSELKLACLKVATNKYGANSIEVQAVQNAFDAAKITGTVKENEKTAENQAPELTVPFTITLRVGDTFDPMRNVKAVDKEDGDLTNKVKHKGDVDTSKPGTYIVEYMVVDSQGRNATATQTVIVEGNGETSDLEPKLTVPVGATIHVGDSFVPMAEVLAIDKEDGDLTSKIKVDGEVDTTKAGTYVLTYTVTDSKGHEVTAKQTVTVKVREEVKNDKPILKVPATTSITEGDQFDPLVGVSATDKEDGDLTSKVAYEGTIDTIKAGTYEIIYSVRDSMGNEVNTIQKVLVKDKETSKANGLTNKTNNNNSDKKEYTYKELPKTGVSTTNSAAIGILMIITGTVLTFVRKFRKIQK

SEQ ID NO: 26505 - protein, 563 aa, Bacillus cereus
  strain B4264
MIEVVKGIREMKKIFSVLLVLFLTFSTWSSVLVKADSPSKGTLTIHKYEQEKDGAQGLEGDGSANQEVPKDAKPLKGVTFEVKKVASFEKISNDGKIVKEDVKPVMGATPTQVVTDDNGQAVLKDLQLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETNAPKGYVIDPTKREFFVKNSGTINEDGTITSGTVVKLEVKNYEEPIIDKKINGKLEALPINPLTNYNYDIKTLIPEDIKEYKKYVVTDTLDNRLVIQGKPIVKIDGAEVNASIVEVAIEGQKVTATVKDFTKLDGKKEFHLQIKSQVKEGVPSGSEILNTAKIDFTNKNDVIGEKESKPVVVVPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKFANN

SEQ ID NO: 26506 - protein, 729 aa, Bacillus cereus
  strain B4264
MLSVSFVVYVPQEAYGSTTNLEGLGDISRYNAVVFGNHKAIGGDIEGAIAVQGDMDASGYTIVGAAAGTSNIVGEKWVDEGYPSLLLSGKFKKSREESFIIQNGIVVMTKESDPDRIIQSSYDHIVYKEKLEIDAKFNEFRNIVNQVSKNAGQYKTNTPIPNMSYGIGKDINNSNIYVSSELTGKNNLDIRDVFLPSAKDKDFIVMYSDATEVTFKNGSILYDTNNIGRATDIVPTSQPYSPNSPFTELYGKVIWVFPNAKKITTEGYGVVGSVFAPNAVLETKGGSINGQAFVGAVQQTGGFEFHNFKFNWQHWNKPSTGKVKIKKVDSNNDNKKLEGAKFKIEDSKGKIVGELVTNEEGEAISKDLPIGNYTLVEKEAPKGYELLKDNITVKIEKDAVVEIKIGNKKLPDPMGKMKLVKVDISDKNKKLAGAKFKIEDSKGKIVGELVTNEEGEAISKDLPIGNYTVVEVEAPKGYELLKDNITVKIEKDAVVEIKIGNKKLPDPMGKMKLVKVDISDKNKKLARAKFHIEDSNKKVVGELVTNEEGEVISKNLPIGNYTVVEIEAPKGYELLKDKIAVKIEKDTVVEIKIGNKKLPDPTGQFEIEKVDDMDSELKLKGAVFQVLDKEGKEVSRLITDEKGKVISNQLAIGKYTIKEIKAPNGYMLLRDSIEIEITEAVKTQKITVKNAKNNWVIPNTGGRGTTIFYVIGIMLMFGVLYFCKKNRIL

SEQ ID NO: 26507 - protein, 497 aa, Bacillus cereus
  strain B4264
MDKFNKCNHIPFPCAFPIPEAGPTGPTGPSGLPGPTGSSGGPPGPPGPTGPTGPQGVQGIQGVPGIQGIQGDPGSTGPQGITGPQGVPGISGPIGPTGPTGLQGIQGIQGIPGIPGPIGPTGITGPTGLQGIQGIQGVQGIQGIQGIPGPTGPQGIPGVPGSAGPTGPSGAVGPTGPSGGPPGPTGPTGPSGGPPGPTGPTGPPGGSTGVTGPTGPTGAPGPTGLQGIQGIQGIPGPTGPQGIQGIQGIQGNPGPIGPIGPTGITGATGLQGIQGIQGNPGPIGPIGPTGPTGLQGIQGIQGIQGIPGPTGPQGLQGIQGPTGSQGATGATGPVSTSSTKEVIYGGSNAGFQILVGSPGPESATIPYTVGGDGSIVGFAISTNTNNLQANTYQFQVCKNVPNNAATPPIGDIIATITFTVTAAITGTIIFTIRPTDIGPQPVKVSNNAPYVITPNASVTWTTNLPGNPINRTDALSVFLDRNISNSMVSIVFLNTSI

SEQ ID NO: 26508 - protein, 1297 aa, Bacillus cereus
  strain B4264
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGPQGVQGLQGPIGPTGATGAQGIQGIQGLQGPIGATGPEGPQGIQGVQGLPGATGPQGIQGAQGIQGPSGNTGATGATGATGQGITGPTGITGPTGITGPSGGPPGPTGPTGATGPGGGPSGSTGATGATGSTGATGSTGVTGATGTTGPTGSTGAQGLQGIQGIQGPIGPTGSEGPQGIQGIPGPTGVTGEQGIQGVQGIQGITGATGDQGPQGIQGAIGPQGATGATGDQGPQGIQGVPGPSGATGPQGVQGIQGPMGDIGPTGPEGPEGLQGPQGIQGVPGPAGATGPEGPQGIQGIQGPVGATGSQGPQGIQGIQGVQGITGATGVQGATGIQGIQGEIGATGPEGPQGVQGAQGAIGPTGPMGAQGVQGIQGIQGPTGAQGVQGAQGIQGIQGPTGATGDTGATGATGEGTTGPTGVTGPTGVTGPSGGPAGPTGPTGPSGPAGVTGPSGGPPGPTGATGATGVTGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGPQGPTGIQGIQGEIGPTGPEGPEGLQGPQGIQGVPGPVGATGPEGPQGIQGIQGPVGATGPQGPQGIQGIQGVQGITGATGAQGATGIQGIQGEIGATGPEGPQGVQGIQGAIGPTGPMGAQGVQGIQGIQGATGAQGVQGPQGIQGVQGPTGATGETGSTGATGEGSTGPTGVTGPTGVTGPSGGPAGPTGPTGPSGPAGVTGPSGGPPGPTGATGATGVTGDTGATGSTGVTGATGATGSTGVTGLQGPQGIQGVQGEIGPTGPQGIQGPQGIQGVTGATGAQGPQGIQGPQGDIGPTGPQGIQGPQGPQGIQGTTGATGAQGPQGIQGPQGDIGPTGPQGPQGIQGPQGIQGPTGATGVTGATGPQGIQGPQGIQGPQGIQGPTGVTGATGATGPQGIQGPQGIQGPTGATGATGATGPQGIQGSQGIQGPTGATGATGSQGPTGDTGPTGAGATGATGATGVSTTATYAFANNTSGTAISVLLGGTNVPLPNNQNIGPGITVSGGNTVFTVANAGNYYIAYTINLTAGLLVSSRITVNGSPLAGTINAPTVATGSFSATIIANLPAGAAVSLQLFGVVAVATLSTATPGATLTIIRLS

SEQ ID NO: 26509 - protein, 163 aa, Bacillus cereus
  strain B4264
MLKKVSQIVLIFGIAFSLSACTETKDSNESKQEDVQDKVYKIGETVDVDGLQVTIDSVKLGYPDYDENKKKEEILGIIFKVENNSKKEIPFAFYEFEITDKKGTRFKEYNNPDSFISKKLAPDEKIQDIMLFDVAKENTYIATYRPEFTHENRTIKFELKPNK

SEQ ID NO: 26510 - protein, 878 aa, Bacillus cereus
  strain B4264
MVKYSKISKWILGVGLVTITCNGLQIQAETKEKNVKNVLQMEPVGIQKSVDELAHPSKVQENESFTKRLKLSDLSQRPLAPTDNIKPLAEEKKYSMAELNQLNNKQLTDLLVTIKWYQIPELFQFNSDSLKFYQDDSRMQAIINKLAEQGQAYTQDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVLAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDVTSDITNEAKLKDVKVTKNTSQFFNTFTLQGTYTGSAAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 26511 - protein, 305 aa, Bacillus cereus
  strain B4264
MYPRNCFSCDGRRNSSSNENTGPTGNTGPTGNAGPSGAGFQSTTTFSLAAAPNYKKGQVVTYTGSGYVVKKDAPQGFPNISPDYIVLIESGPTGSTGPTGITGPTGNTGFTGITGPTGNTGFTGITGPTGNTGPTGITGPTGSADSASAKSIVFQGTNAGFQRIAGSPGIDSNVIPYVTAGAGSIVGFSASININNLPAAIYTINICRNVPTNLTPPASSYLLSTITLTTTDKITGTMVFSIKPTDSRAGQIQVFNPTPAVGPAAVTWTSLTTGNPVARGDAISLYITPGITASAVYSIFLITDI

SEQ ID NO: 26512 - protein, 965 aa, Bacillus cereus
  strain B4264
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSRGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDMQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHAPKSLTEVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSVEVNPVHVYEREGSYKVSLRVKDDKGKESRSETTVTIKDGSLTESEPNNRPEEANRIGLNSTIKGNLIGGDHTDVYTFNVASAKDIDISVLNEYGIGMTWVLHHESDMQNYAAYGQANGNHIEAKFNAKPGKYYLYVYKYDNGDGTYSLSVK

SEQ ID NO: 26513 - protein, 455 aa, Bacillus cereus
  strain B4264
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVLGTHFIDKKLQPSTEYSYTVKAIDAAGNVSKESAALTVKTTVETPDTEAPTQPKGLHSMGTTASSVDLMWSPSDDNIGVDHYDIYRETEGAMKKIATSNTTSYLDKNLLANTTYKYVVKAVDVAGNESVQSEIFTITTKTENASYEAWDAKKAYKKGDRVLHEGKVYEAVQSYQGNGDPNWIYALSLWKTV

SEQ ID NO: 26514 - protein, 1093 aa, Bacillus cereus
  strain B4264
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSESGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKPQTIEVKTGETGAVQIVNNKVKGNIEIKKLSDSGKILPNVEFTVFTEDGKEVKKVVTKENGIANVEDLTYGKYYFLETKTPNGYIGNKTKYPFEIREHNKTLNFTVENTEVKGSVKLLKVDNEDISKKLEGAAFELKDASGKVVGEYKTDKNGEINVKDLAYGKYSFVEKASPNGYVLVKEPIMFEIKEHGKVIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYNLKGKLMNKETNKPLVVNGKEVTVETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKALLIDGKEVTAETKFTAKEKNGFVTLDFTFVGAEQQGREVVVFEDLLHEGQVIATHADINDVGQTVRFVEPSIKTTATNKADGSKELDASKTVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEQPNSGKNTPTPEQPNEQVKEQPQLKKEIQSKIGWLPQTGTNLTSWISMAAGALLLIVGGVIFLKRKNA

SEQ ID NO: 26515 - protein, 971 aa, Bacillus cereus
  strain B4264
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAMANNPNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNTSGQFEYDVVFHGINTEEGAENKAPVAVINGPYSGNVNEAISFTSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 26516 - protein, 3409 aa, Bacillus cereus
  strain B4264
MKQVLKCFNVVTMITLLLSIILPSPSAFAEINKKSWDELQGNDVKIKAEQVNAEIYRGEVAKREHVFQYTIENTGDTPIQELVLKQSNENKITFLSQSVKVNGEKLPENKVADFYVEEKDKGGKLLSSNLKIRDLKSHEKMTVLIKASRTQHFNKEYKQKISVQKDQVQIGNMSVDVEGIPSEEKVAANADEEADSSKKEVGPSANNTIKKVDEKLKVSVEGKNNPTSKTELPEQPVTEAEKQPEKEAVKQSVAEVQAASENASKVQIQTGDKQGFGDPLYSIIAPGNLVQTGNVTLGLTDNHYIRQSVGGKTNKKAVDVDNDDTTFNSSTGAFPNIPAGSKVKKAYLFWTAAMGTPSDARIDYRVSDEDVREPVKMKMGNKQYAEISADSIRKADYLPYIANHYSSGAGYVAYADVTNVIAKQGLSQTVTVANVPQIKFEKGSGYYWGNWNLILVYENYKETVKDMKIWEGLVSQKSTAWTDISVNKINTPKEGAFKAKFSYFSSQGDPADHDGYAYDYGEYDFGLGYQKFKNITGKDNDVNDSSMTEVQVDGTNEFVTKKYPGYNPDWTNSFSTDIHTYHLEGPTQVKNDLKEGKMRFRAYASTGDIYVLNNATFVTEHNAPNLQVDKKALDSTGKEVKEIKSGEEFTYQIEVKNDTKNNQAPVSNVKGFDKLDNRLEYVPGSIQYVSGSNKGNKTDNASDDEAEFVNNQIDFRIGEGANAKDGGVLKPGESAIITFKVKVKASVQSDTTVKNIVVVKGQDSTEVNYETADDADITVTTPKEIPGEIEAKKIASNKTPKLGDEVEYRITFKNKTKDGRLDVLTIEDELPSNLEYVKDSLKAEGAKPEPVELKFENGKVIAKYPEIMDMEERSIVFKTKVKETAKIGEEIVNKATVSDKTNPPKNLEEKITPQHKAGKIAAKKKATNKKPKLGEEFEYQISFQNTVENGKLDAVTIEDEIPANLEFVQGSERAEGAEPNPVELKVENGKVIAKYPEITDTKERSIAFKVKVKEEAKAGETIVNKAVVSEPNGQTEHPEEKITPDYKYGKVDVEKSVTNQTPKLGEEVEYRITFYNTVENGKLEKVLVEDTLPKGVEYVKDSLKAEGIKPEPVELKVEDGKVMAKYPEITDTEKRSIVFKVKVKDSAKVGEAIVNKAIAKDPKNEPVESKVVITPQSKKGEIAATKVVNNKKPKLGEEIEYRISFHNTVENGKLEEVRVEDTIPKGLEYVENSIKAEGEAPGPVELAVENGIVKAKYIDIMDMKERSIVFKVKVKEEAKVDKEIVNKAIVDDTKNPPIEPEERITPQHKDGIIDSKKTVDNPSPKLGEEVEYRISFKNTVENGKLEKVIIEDTIPNGLEYVKGSEKAEGDKPAPLKLSVKDGKVTAEYENITDMKERSIVFKVKVKEEAEVGKEIINKAIVDDMKDPKEPEAKITPLHKDGKIKAKKSVNNETPKLGEEVEYRISMKNTVKNGKLTDVIIEDTLPEGLEYVENSLKAEGARIDSVELKFENGKVMAKYPEITDTEERSIVFKVKVKEEVKVGKKIINKATIDDSQNKPVNPTAEIIPQYKDGKLEAKKMVNNETPKLGEEVEYRISFKNTVEHGKLTEVKIEDDLPNGLEYVKDSVKVEGSKPDPVELKFENGKVMAKYPEITDTKERSITFKVKVKGKVSDSIVNEAIVSDTKHPPETPTAEIIPQHKDGKVKAKKTVNNETPKLGEEVEYRISFKNTVEDGKLAEVKIEDTLPEGLEYVENSVKAEGSKPDPVELKFENGKVMAKYPEITDTEERSITFKVKVKDEVKVGKKIVNKAIIDDTKNEPETPTAEITPQHKDGKVEAKKTVNNETPKLGEEVEYRISFKNTVENGKLAEVIIKDDLPNGLEYVKDSLRAEGTKPDPVELKVKDGKVIAKYPEITDTEERSIVFKAKVKEEFKVGEGIVNKVVVDDAKDPTTSEVTITPEYKDGKLKAEKFVNNKKPKLGEEVEYRISFKNTVENGKLVEVTVEDEIPAGLEYVENSLQAEGSKPSPVELKFENGKVMAKYLEIADTKERSITFKVKVKEEAEIGKEIVNKAIVVDTKNEPEEPRVEITPQYKDGKIAAQKVANNHKPKLGEEVEYRISFKNTVENGKLVEVNIKDTLPNGLEYVEGSITAEGSKPKPVELQVKNNKVMAKYPEITDTEERSIVFKVKVKESVKVGEEIVNEAIVDDTKNLPEEPYVPITPQYKDGKIEARKEVSNHEPKLGEEIEYRIIFNNTVKDGKLAEVKIEDEIPAGLEFVEGSEKAEGEEPKPVELKVENGKVMAKYSEIMDTKERSIVFKVKVKDSVAIGKDITNKAIIHVDDPNHPVIDPTAKITPQYKDGKIAAHKKVNNHKPKLGEEIEYRISFNNTVKDGKLAEVKIEDEIPSGLEYVKDSLKAEGDKPAPVELKEEAGKVSAKYENITDMKERSIIFKVKVKDSVEVDKAIVNKAIVDDTKNPPERPEVEINPQHKAGKFKANKKVNKKDPKLGEEVEYRISFKNTVENGKLAEVKIEDQLPTGLEYVKDSLKSEGNEPAPVELKEEAGKITAKYENITDTAERSISFKVKVTEVAKVGKKIVNTAIVDDDNPKNPPQKPEAIITPEYKDGKLKAEKTVNNPAPKLGEEVEYRITFRNVVEHGKVAKVKIKDELPTGLEFVEGSERAEGENPKPLYVKVKNGIVLAEYPEITDMKERSIVFKVKVKEKAKVGEEIVNKAIVEDTINPPEQPNISIQPQYRDGALQAEKTVSNHEPKLGEEVEYRISFENTVENGKLTEVKVEDEIPAGLEYVQDSIKSDGPEPHPVELKVENGKVTAKYPEITDTKKRSIIFKVRVQETVQVGKEIVNKAIVDDNNPTTPPVESLIPITPQYKDGKLEARKEVSNHEPKLGEEIEYRITFNGTVDGGKLVDVKIEDEIPSGLEYVKDSLEAVGDKPVPTELKVENGKVTVKYPEITDTKERSIIFKVKVKESVKVGGEITNKAIIEVDDPKHPVIEPTAKIKPEYKDGKLTAAKTVSNKEPKLGEEVEYRISFKNTVENGKLDVVTIEDEIPAGLEYVQGSIRFEGAEPNPIELKMEFGKVIAKYLEITDTKERSIIFKAKVKEAPSKGITNKAVVDDKINPPLEPTVTILPKTKEDFKIPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKEPKEPEVKPEDPKDPKEPEVKPEDPKEPKEPEVKPEDPKEPKEPEVKPEDPKEPKEPEVKPEDPKEPKEPEVKPEDPKEPKEPEVKPEEPKEPEVKPENPKEPKEPEVKPEVRLEKLIKEPQVKTERELPKTGAASPWMMSVGAGISFLVGGVLFVLGRRRKQ

SEQ ID NO: 26517 - protein, 333 aa, Bacillus cereus
  strain B4264
MKCKLLKGVLSLGVGLGALYSGTSAQAEVSTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTDQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 26518 - protein, 370 aa, Bacillus cereus
  strain B4264
MKTKQTIAASTLALAMIAGANPAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDGLSANLELAKQDVKNKLAELQKAREDLLNKINEIKQSKQTVSDDLTKKKQDLDIKINDFKHTEKKIDDKLAELHTTKQNVDNKINEVSQSKQTQADNSTKNNNAKELPNAGSEQSNNMALGMLSVLGGILLITRNKIKTLFSK

SEQ ID NO: 26519 - protein, 1451 aa, Bacillus cereus
  strain B4264
MSRYNDNQNKFSKPCFPSSAGRIPNTPSIPITKAQLRTFRAIIIDLTKIIPTLFANPSPQNIEDLIDTLNLLSKFICSLDATSSLKAQGLAIIKNLITILRNPTFVASAVFIELQNLINYLLYITKLFRIDPCTLQELLKLIAALQTALVNSASFIQGPTGPTGPAGATGATGPRGNTGATGATGPRGNTGATGATGPQGNTGATGATGATGPRGNTGATGATGPQGNTGATGATGATGPRGNTGATGATGPQGNTGATGATGATGATGPRGNTGATGATGATGPQGNTGATGATGPQGNTGATGATGATGPQGAQGNTGATGATGATGPQGVQGNTGATGATGATGIGVTGPTGPSGGPPGPTGPTGPQGNTGATGATGPQGAQGNTGATGATGPQGAQGNTGATGATGPQGVQGNTGATGATGATGPQGVQGNTGATGATGPQGAQGNTGATGATGPQGVQGNTGATGATGPQGVQGNTGATGATGPQGAQGNTGATGATGPQGVQGNTGATGATGPQGNTGATGPRGNTGATGATGPQGNTGATGATGATGPRGNTGATGATGPQGNTGATGATGATGPRGNTGATGATGPQGNTGATGATGATGATGPRGNTGATGATGATGPQGNTGATGATGPQGNTGATGATGATGPQGAQGNTGATGATGATGPQGVQGNTGATGATGATGIGVTGPTGPSGGPPGPTGPTGPQGNTGATGATGPQGAQGNTGATGATGPQGAQGNTGATGATGPQGVQGNTGATGATGATGPQGVQGNTGATGATGPQGAQGNTGATGATGPQGVQGNTGATGATGPQGVQGNTGATGATGPQGAQGNTGATGATGPQGVQGNTGATGATGPQGNTGATGPQGAQGNTGATGATGPQGVQGNTGATGATGPQGIQGPTGATGATGPQGVQGNTGATGATGPQGVQGNTGATGATGPQGVQGNTGATGATGPQGVQGNTGATGATGPQGVQGNTGATGATGPQGIQGPTGATGATGPQGVQGNTGATGATGPQGVQGNTGATGATGPQGVQGNTGATGATGPQGVQGNTGATGATGPQGVQGNTGATGATGATGPQGVQGNTGATGPQGVQGNTGATGATGATGPQGVQGNTGATGATGPQGVQGNTGATGATGPQGVQGNTGATGATGPQGVQGNTGATGATGATGPQGVQGNTGATGPQGVQGNTGATGATGATGPQGVQGNTGATGATGPQGVQGNTGATGATGPQGAQGNTGATGATGPQGVQGNTGATGATGATGPQGVQGNTGATGATGPQGIQGPTGATGATGIGVTGPTGPSGGPTGPTGPTGPSFPIATIVVTNNIQQTVLQFNNFIFSTAINVNNIIFNGTDTVTVINGGIYVISVSISTTAPGCAPLGVGISINGAVATDNFSSNLIGDSLSFTTIETLAAGARISVQSTLNEITIPATGNTNIRLTVFRIA

SEQ ID NO: 26520 - protein, 306 aa, Bacillus cereus
  strain B4264
MNIKQSFKILAMFLSVLFVLFPLQKAFAEVMDHTKYEMNWSYSKSKKKPIRTELIKTADGKIAFCLNVDLKSPSGQDLPEMGKVDINVYRVLLNGYPQKSPQELGVSDWREAHYATQLAVWNALKQIDINDLDFRNKNVEKVTKDIVAKASASEELQEITMSVTPTEEQEAVLKNDFFETGLYTVETNAKSGTYKVQATGAPAGVKFANEKGETKTEFNVGEKFRILIPKQTPAGGFSFKVSGNLTKLQGIAHKGTPTIQNAVVLLERSEEKTSPELAVSWKKAEAPNKPNKPYTPNEPHKPNQKR

SEQ ID NO: 26521 - protein, 431 aa, Bacillus cereus; identical to SEQ ID NO: 26472
  strain B4264

SEQ ID NO: 26522 - protein, 459 aa, Bacillus cereus
  strain B4264
MSSWSNNVNGYCGCNNQNGVHVDSCCFSCDGTVPKVGPTGATGATGPTGATGSTGPTGATGSTGPTGATGDTGATGATGPTGITGATGSTGPTGATGITGATGSTGPTGATGITGATGSTGPTGATGSTGATGPTGATGDTGATGATGPTGITGATGSTGPTGATGITGATGSTGPTGATGITGATGSTGPTGATGITGATGSTGPTGATGITGATGSTGPTGATGITGATGSTGPTGATGPTGATGPTGATGPTGATGPTGATGITGATGPTGPTGATGITGATGSTGPTGATGITGATGSTGPTGATGITGATGSTGATGTSITATYAFANNTSGTAISVLLGGTNVPLPNNQNIGPGITVSGGNTVFTVANAGNYYISYSINITASLLVSSRITINGAPLAGTINSPAVATTSFSATIITTLAAGDAISLQLFGLLAVATLSTTTPGAVLTIIRLS

SEQ ID NO: 26523 - protein, 179 aa, Bacillus cereus
  strain B4264
MNKKLLASLLCSTFLFGASACSSHDAPAKNEQATSKKTENDKLSSKDPQKELPTNVDSSDVYMSMGSAESLDVLGTGEVKAQGVFKVLDIAVYNRKEEPITLDINNFKLIDGFGREYHISNEYQSVLKAANISTFKFNIVNPNESSEGNIVFDVPKNTQGLTLKINNDKLDKELQLKVE

SEQ ID NO: 26524 - protein, 183 aa, Bacillus cereus
  strain B4264
MRKLSILLTFILVLVSVTAACTQDKTDSAVENGPIEEPTAKNENEELINFEEKEDMSRLEQGILLVGESVKGGYYLTAVQSAYLNASNDSVIVNVSVKNVRGQTIGLSELKYNLKDEKDGKIYKGKVLDQNPSDIQVKPNETVELKIAFEVPRTADEYMFYIESSLDPLQTYWKIDKLQSQTN

SEQ ID NO: 26525 - protein, 2272 aa, Bacillus cereus
  strain B4264
MQMKSTKRHISMVSLVFLVLFSVLNVWAPVIQAAVMKSPVDEINISRTDGTTSEPYQASDGMKVEVKWSAKEKIKSGDQFTIDMPKEFRKDLMNMSFPLKDAEGKIVGTCEMKKGLLTCTMGDYVEGKNNIKGSLFVEFYFGLEAYDGVKEIPLEFNVDGQIVNKEVNVSNTTERPKPQPNTDNLLKWGSYNQEDPSIADWLVYVNATGTEMQDLKLTDTLGPGHELITDSVVLEEAVFEDGYAPTNIKPADLSNIKINATKAGFTIEFPDSSKGYILRYKTKITNPSAKPHKNTVKLEGKNIKTEEKVGQVFVSGGGGSGSGDNNPPSIEKNIVDENGKLVENEQLKKMDQVIQYQVGTHIPNDPPKYTSMVIRDDLEDVLEVLEAKVYDQNGQDITSKGTLNIDKQRSEVTFTFGESFDYKSYEDQIINLSIKAKIKSDADLSSYVDKKIPNKAELHFDDKTLTSKEVTITPPEAPKDGTVSLHKIDSENPNKGLKGAEFEVRNSANEVVAKLKTDEKGFSVPQTLAPGTYKVYETVAPEGYQKLKEPVEVTLQAGETKTIEIKNTMQKGQIEVKKIDSENGEKPLANAEFDIVKDGVVVEHIITDKDGKAISKPLAPGKYILKETKAPEGYQLKEAEFEVNVTGDGIFPIQVENAMVDKGNIEITKVDKENGAVLADVEFEVQDEKDGVVRKVVTDKDGKANVSDLSVGKYKLVETKSLPGYKKLTEPVPFEIKKGMTKSLAIKVENEQLDKGSVEIIKIDKDSQKVLEGVVFEVQDEQGKVVTEVKTDKDGKAKISDLSVGKYKLVETKSLPGYKKLTDSVSFEITKGMTTVLSLKVENEQLDKGSVEITKIDKDSKKALKGVVFEVQDEAGTVVKEVKTDKDGKAKISDLSVGKYKLVEKESLPGYKKLTEPVSFEITKGMTEILSLKIENEMVDTGNIEITKIDKDNKAPLTGVTFIVQDEKGKEVTKVTTDKEGKANVSDLPVGKYELVEVESLPGYKKLEKPVSFEIKKGMTEVLSLKVENEMVDTGNIEITKIDKDSKAPLENVVFEVRDSKGKVVAKVKTDKEGKANVSDLSIGKYELVEVETPAGYKPLEKPISFEIEKGRVTALQLTVENELVDTGNVEITKVDKENKDALADAVFEIQDEAGQVVAKITTDKKGQAQVTNLSVGTYKVVEVKAPKGYKQLVDPITFQIEKGMTKSLALTVENEMLDKGNVEVTKVDKDSQKVLEGVVFEVQDEQGKVVTEVTTDKDGKANVSDLSVGKYKLVETKSLPGYKKLTEPVSFEIKKGMTKVLSLKVENELLDKGSVEITKVDKESGAVLAGVTFEVQDEKGKVVTKVTTDKEGKATISDLPVGKYKLVEVESLPGYKKLAKPVSFEIKKGMTEVLSLKVENELVDKGSVEITKVDKDGQKALEGVVFEIQDEAGKVVTEVKTDKNGKAKISDLSVGKYKLVEKESLPGYKQLTEPVSFEIKKGMTEVLSLKVENELVDKGSVEITKVDKDSQKVLEGVVFEVQDDKGKVVAEVTTDKEGKANVSDLSVGKYKLVETKSLPGYKKLTEPVSFEITKGMTKVLSLKVENELLDKGSVEITKVDKESGAVLAGVTFEVQDEKDKVVTKITTDKEGKATISDLPVGKYKLVEVESLPGYKKLAKPVSFEIKKGMTEVLSLKVENELVDKGSVEITKVDKESGALLKGVTFEVQDEQGKVVTKVTTDKEGKAKISDLSVGNYKLVEVESLPGYKKLAEPVSFEIKKGMTEVLSLKVENEQLDKGSVEITKVDKDSQKVLEGVVFEVQDDKGKVVTEVKTDKNGKAKISDLSVGKYKLVEKESLPGYKQLTEPVSFEITKGMTEVLSLKIENEMVDTGNVEITKIDKDNKAPLAGVVFEVQDDKGKVVTKVTTDKAGKATVSDLSVGKYKLVEVESLPGYKKLEKPVPFEITKGMTKSLAFTVENEMVDTGNVEITKIDKDSKAPLENVVFEVRDSKGKVVAKVTTDKEGKANVSNLSVGKYKLVETKSLPGYKKLTEPVSFEITKGMTKVLSLKVENEQLDKGSVEITKMAAESKEVLSGAVFEVHDEKGKVVVKVTTDKDGKAKITDLSVGNYTLVEVEAPKGYEKLTNPIPFEITNGMINAVQLEVLNKLNHLAPPGPETPDPEKPGTPDPEKPGTPNPEKPGTPDPEKPGTPDPEKPGTPNPEKPGTPDPEKTGTPDPEKPGTPDPEKPGTPNPEKPEKELPKTGQKMPVEPYMGALLVMMSFGLLVLGRKQQR

SEQ ID NO: 26526 - protein, 336 aa, Bacillus cereus
  strain B4264
MKRSKTYLKCLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKSFTLDWKNKKLVEKK

SEQ ID NO: 26527 - protein, 179 aa, Bacillus cereus
  strain B4264
MFKKIATVTLAGTLAFSLSACDEKKEVAKTVSNNTKEEQSSAKKENTKNEDTREYNVEKTTQIRNQKLTVHKVQIAQVAEYDKLEKGNEFVIVHVTVENIGNQKVRINPLDFYLERGDGSIVDHTFSTSNKNVFKIKDVDPNGKITGAITFEAKKGDSNLELIYRPDVMSKEEVKVELK

SEQ ID NO: 26528 - protein, 300 aa, Bacillus cereus
  strain G9842
MSSWSNNINGYCGCNNQNGVHVDSCCFSCDGTVPKVGPTGPTGATGITGATGSTGATGVTGDTGATGATGITGATGPTGVTGVTGATGVTGDTGPTGATGITGATGPTGVTGITGATGPTGATGGTGPTGATGVTGDTGATGATGITGATGDTGATGATGPTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 26529 - protein, 179 aa, Bacillus cereus
  strain G9842
MNKKLLTSLLCSTFLFGVSACSSHDTSAKNEQKTSKKTENNELNRKVPQKELPTNVDSSDVYMSMGSAESLDVLGTGEVKAQGVFKVLDIAVYNHKEEPITLDINNFKLIDGFGREYHISNEYQSVLKAANISTFKFNIVNPNESSEGNIVFDVPKNTQGLTLKINNDKLDKELQLKVE

SEQ ID NO: 26530 - protein, 455 aa, Bacillus cereus
  strain G9842
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTKKVTANSVELTWNSSTDNVGVKGYQIFRNGEMIDTILGTHFIDKKLQPSTEYSYTVKAIDAAGNVSKESTALTVKTTVATPDTEAPTQPKGLHSMGTTASSVDLMWSPSDDNIGVDHYDIYREIEGLMKKIATSNTTSYMDKNLLANTTYKYVVKAVDVAGNESVQSDIFTITTKAESASYEAWDAKKAYKKGDRVLHEGKVYEAVQSYQGNGDPNWIYALSLWKTV

SEQ ID NO: 26531 - protein, 183 aa, Bacillus cereus
  strain G9842
MRKLSILLTFILVLVSVTAACTQDKTDSAVENAPIEEPSAKNVNEELINFEEKEDMSRLEQGILLVGESVKGGYYLAAVQSAYLNASNDSVMVNVSVKNVRGQTIGLSELKYNLKDEKDGKIYKGKVLDQNPSDIQVKPNETVELKIAFEAPGTVDEYMFYIESSLDPLQTYWKIDKLQSQKN

SEQ ID NO: 26532 - protein, 951 aa, Bacillus cereus
  strain G9842
MKNRDNKGKQQSNFRIPPELIGPTFPPVPTGFTGIGITGPTGPQGPTGPQGPRGFQGPMGEMGPTGPQGVQGIQGPVGPIGATGPEGQQGAQGLRGPQGETGATGPQGVQGLQGPIGPTGATGAQGIQGIKGLQGPIGATGPEGPQGIQGVQGLPGATGPQGIQGAQGIQGTQGPSGNTGATGATGQGLTGPTGITGPTGITGPSGGPPGPTGPTGATGPGGGPSGSTGATGATGDTGATGSTGVTGATGTTGPTGSTGAQGLQGIQGIQGSIGPTGPEGPQGIQGIPGPTGITGEQGIQGVQGIQGVTGATGDQGPQGIQGAIGPQGVTGATGDQGPQGIQGVPGPSGATGPQGVQGIQGPMGDIGPTGPEGPEGLQGPQGIQGVPGPVGATGPEGPQGIQGIQGPVGTTGPQGPQGIQGIQGVQGITGATGVQGATGIQGIQGEIGATGPEGPQGVQGAQGEIGPTGPMGPQGVQGVQGIQGATGAQGVQGPQGIQGIQGPTGATGDTGATGATGEGTTGPTGITGATGVTGPSGGPAGPSGPTGPSGPTGVTGPSGGPPGPTGATGATGVTGDTGATGSTGVTGATGETGATGVTGLQGPQGIQGVQGDIGPTGPQGIQGPQGIQGVTGATGDQGPQGIQGPQGIQGPTGPQGIQGEQGPQGIQGATGATGAQGPQGIQGIQGIQGPTGPQGPTGIQGVQGEIGPTGPQGVQGLQGPQGPTGDTGATGAQGPQGVQGIQGPTGATGATGATGPQGIQGPQGIQGPTGATGATGSQGPTGNTGPTGSQGIQGPTGPTGAGATGATGATGATGVSTTATYAFANNTSGSIISVLLGGTNIPLPNNQNIGPGITVSGGNTVFTVANAGNYYIAYTINLTAGLLVSSRITVNGSPLAGTINSPAVAAGSFSATIIANLPAGAAVSLQLFGVIALATLSTATPGATLTIIRLS

SEQ ID NO: 26533 - protein, 367 aa, Bacillus cereus
  strain G9842
MKTKQTIAASTLALAMIAGANPAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDDLSKKKQDLDIKINDFKHTEKKIDDKLAEIHTTKQNVDNKINEVSQAKQTNGTKNNNAKELPNAGSEQSNNMALGMLSVLGGVLLLTRNKIKTLFSK

SEQ ID NO: 26534 - protein, 431 aa, Bacillus cereus
  strain G9842
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 26535 - protein, 838 aa, Bacillus cereus
  strain G9842
MRHHKNCKKFGVALPLPLIGATGPTGNSGPVGPTGGHEGPVGPTGMTGPTGATGPQGPQGPQGIRGIQGSRGTTGAQGIQGAVGDTGEQGITGPTGLQGAQGLIGNQGPIGDIGVQGLEGTQGATGPAGSQGIQGIQGIQGEVGERGQTGAQGIQGERGVTGVPGVTGSQGPQGVQGIQGEQGATGIQGEDGAQGIQGITGEQGHQGDQGAQGVVGPTGSTGIQGPQGISGIKGITGVTGPQGPQGVQGIQGVSGSTGFQGAKGVRGITGATGPTGTQGSEGPPGGPTGTTGPIGPSSGVTGPSGPPGPPGGPTGPTGATGSTGVSGGIGPIGAQGVQGITGPTGPQGVRGVQGSQGVVGAVGVQGAQGPQGNPGITGPTGAEGSQGIQGTRGVTGPTGAEGPKGIQGIQGVIGPTGAQGMVGIQGIAGPAGVTGAEGVQGEQGIRGATGPAGAQGIQGVQGIQGETGAAGAQGPQGVQGIQGTTGLTGAQGAQGLQGVQGIIGPTGAIGLQGPQGLQGITGPTGVQGVQGIQGVQGIIGPTGAQGIRGPQGNTGEVGITGPQGVQGAQGSQGPQGPQGNIGITGATGETGATGATGSTGPQGVQGVQGITGIQGITGMTGDIGATGPQGIQGIQGIQGLQGPIGASGVTGASGSIGPVGAQGSQGQNGAVGPTGATGNVGSIGFSGIAGATGATGLPSGGGYFFSTATSTIAANALIPINSGSTIFGAGVSLTNATTITLSTPGIYLISYYFQGDAILGNETISVRLVLNGTQVAGSFILYVTKGNFILEPAISNTMVIEVTSPNSTLSLQNGPLAIGHVTTLAGIITASLNILQIV

SEQ ID NO: 26536 - protein, 237 aa, Bacillus cereus
  strain G9842
MNEEYNTLHGPALEPNLIGPTLPSIPPFTFPTGPTGITGPTGATGFTGIGITGPTGVTGPTGIGITGPTGVTGPAGIGITGPTGVTGPTGIGITGPTGATGLGILPVFGTITSEVGIGFSAVVNTNVNFTIPGPVSGTTLNPVDNSITIDTTGVYSVSFSIVFVIQAISSSILNLTINDSIQFAIETRVGGASGVRATSARTDLLPLNQGDVLRLRIREATGDIIYSNASLVVIKVD

SEQ ID NO: 26537 - protein, 458 aa, Bacillus cereus
  strain G9842
MKLKLTSKLERLRTSKKGIGACVLAAGMTAITMAPQSAYAHGFVEKPSSRAALCSQNYGVLNLNCGNVMYEPQSLEAPKGFPDSGPIDGKIASAGGLFGGILDQQTSNRWFKNTIKGGVNTFTWKYTAAHSTSKWHYYITKKGWDPNKPLTRAELEPIGTVKHDGSAASNNLTHTINVPTDRNGYHVILAVWDVADTSNAFYNVVDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHTIPDIEAPTQPKGLHSMGTTSTTVDLMWSPSEDNVGVDHYIVYRESAGVMNKIGTAANTSFMDKDLKANTSYNYVVTAVDLAGNESSRSDVLNVTTKSENSAYEKWDARKAYTKGDRVVHEGKVYEAVQNHQGNGDSNWIFALSLWKPVLNK

SEQ ID NO: 26538 - protein, 412 aa, Bacillus cereus
  strain G9842
MKKAKEIAKCVAVASVIMSGSFSLQATSAFADSKGTVENLQNGGKVYNSFKTTYDMKQNIKNSIKVSFIEDPYADKKIAIVTTDGSNIDAKYTVNSGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTETTSDLKITNRRISDQYNIEWVSSKWWGTNNKDTYNEFFTNHYKLDWKNHQVTLDNQKFLEEQMNSINSVNDKLNKGKGKLSLSMNGNQLKATSSNAGYGISYEDKNWGIFVNGEKVYTFNEKSTVGNISNDINKLNIKGPYIEIKQI

SEQ ID NO: 26539 - protein, 1055 aa, Bacillus cereus
  strain G9842
MNWSYSNSLGKHIRTEMIKNSSGQIAYCLTLGLKSPNGEDLPEMGKTDNVVYRLLLNGFPQKSVQQLGVANQNEAHYATQLAVWNALGQLDVNELKHENKNVEKAAKAIISNANNSEETQDVFMNVIPAEKQKAELKGEFFETNLYSVQTNAKGGSYKVVAKNAPNGVKIVSENGEVKDQLSVGEKFRIQIPKNTKTGEFNLSVAANLTKVQAIAYRGTDTVQNATVLLERNEEKLSSDLAVNWEAAGSLKIKKVGENGEVLADAVFEVFNANNESVGKITTGADGIAELNNLPIGTYTLKEIKAPTGYVSDDKPQTIEVKTGETGAVQIVNNKVKGNIEIKKLSDSGKVLPNVEFTVFTEDGKEVKKVVTKENGIANVEGLTYGKYYFLETQTPNGYIGNKTKYPFEIKEHNKTLTFTVENTEVKGSVKLLKVDNEDVSKKLEGAEFELKDASGKVIGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTVKGKLMNKETNKPLVVNGKEVTAETKFTPTEANGFITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKSVTIQDKVEYKDLIVGKEYVVKGKLMDKATNKPLLVDGKEVTVESKFTAKEKNGSIILDFTCNASALQGKEVVVFEELYQDNILIAIHAEIEDKGQTVKFKEVKPEQPKPEQPNSDENTPTPEQPNEQVKEQPQPKKEIQSKIGWLPQTGTNLTSWISMAAGALLLIVGGVIFLKRKNA

SEQ ID NO: 26540 - protein, 971 aa, Bacillus cereus
  strain G9842
MKGYSKKMLVGVSFASLMLGSFQGVSLAEDTKGEQVSYRNVLKMEPVGVQLPVQELAHSSKLLESKSFEQRIQFADLSQRPPEVKKESKQLAVAKTYTIAELNQLSNQQLVDLLITIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGSFHSTGTKGLQVVTDAMKIYPYLGEQYFVAAEQIATNYGGKDANGKVVNLDQIREDGKKKYLPKTYMFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLFDNREKYNVPLVSDDYLANHAPKPVSDIAAEITAEAKLKNVSVKKNKSKFFNTFTLQGTYTGTAAKGEYEDWKIITQNVNDTLKRLSAKEWTGYKTVTAYFVNYRVNASGQFEYDVVFHGINTEEGAENKAPVAVINGPYSGNVNEAISFKSDASKDEDGKITSYKWEFGDGTVSNEQNPTHVYTKEGAYTAKLTVTDDKGATNTATATVTVQKKEDNSLEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 26541 - protein, 163 aa, Bacillus cereus
  strain G9842
MLKKVSQIVLIFGIAFSLSACTETKDSNESKQEDVQDKVYKIGETVDVDGLQVTIDSVELGYPDYDEDKKKEEILGVIFKVENNSKKEIPFAFYEFEITDKKGTRFKEYNNPDSFISKKLAPDEKIQDIMLFDVAKENTYIATYRPEFTHENRTIKFELKPNK

SEQ ID NO: 26542 - protein, 503 aa, Bacillus cereus
  strain G9842
MFNKKMVAMAMTVPLVMGTISTVSALEKQQQVKLEAYSPQKKATEYLKENAAQYGLKADLSDLQYISTTETSVASYVRFQQVVNGAPVFSKQITVTLNGEGKGVLAVSDYQPVTGVKEVTTKISEKDAIQKSMAYVGEASEQNLWAPTEKEFGYIVEEGMARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26543 - protein, 252 aa, Bacillus cereus
  strain G9842
MKRNDNLSLNKGMIGPENIGPTFPILPPIYIPTGETGPTGITGATGETGPTGITGPTGITGPTGITGATGETGSTGITGATGETGSTGITGPIGITGATGETGPIGITGATGETGPTGITGSTGITGLTGVTGLTGETGPIGITGPTGITGPTGVTGATGPTGGIGPITTTNLLYYTFADGEKLIYTDTDGIPQYGTTNILSPSEVSYINLFVNGILQPQPLYEVSTGKLTLLDTQPPSQGSSIILQFIIIN

SEQ ID NO: 26544 - protein, 995 aa, Bacillus cereus
  strain G9842
MKQNKRKRINAMIIAAALSLPFAVYSTPALAAVAIEANKTGQGLEDGTYDAVIKAYKDKTNEESMAAVYIKDPKLTIENGKKIVTATLSDSDFFQYLKTEDIHTPGVFHDVKVLSEDKKKNGTKVIQFEVGELGKTYNMQMHIYIPTMAYDNKYQVQFEVNAINLENNVSEKQKENKEEQQDENGNVILDKQLQKYINKYNLDRDNVDAPITKKDLLQIKTLSIYSGKGINEIAGLEYMTNLEKLTLRESNVTDISAISKLRSLKYVDLTSNSIESIHPIGQLENINMLFLRDNKISDLTPLSKMKKIKTLDLIGNNIKDIQPLFTLSTMKQLYLANNQISDLNGIDRLNNVELLWIGNNKINNVESISKMSNLIELEIADSEIKDISPLSQLGILQVLNLEENYISDISPLSTLTNLHEINLGANEISDVRPVEELGKRISIDIQRQKIFLNEASVDEELKIPVYNLKGEPLQNINVKSEGATLNNGFIKWNSPGEKIYEFKLDTNSTESKIRFNGTVIQNIVEKQKERANVILDKTLQQHINKENLGRENLNAPITKEDLLQVKKLEILKEKGNEIKDITGLEYMTNLENLTLEGVGLKNIDFISNLKRLNNVNVSHNQIEDITPLSSLKNLQWLNLTENRITDVTVLGSMLDLLSLKLAENEIRDVRPLIQLGQWVTIDVRRQKVILDDAEINKEVKIPVYDLEGEPIEKITLKSEGGTLTDEGIIWRTLGEKIYEFDLDADHYETGILYSGIVMQNIVEKLIPKEEVKEPTKEVEESKEEVKEPTKEVEETKEEVKEPTKEVEESKEEVKEPTKEVEESKEEVKEPTKEVEESKEEVKEPTKEVEESKEEVKEPTKEVEESKEEVKEPTKEVEESKEEVKEPTKEVEESKEEVKEPTKEVEESKEEVKEPTKEVEEAKEEVKEPKGNNQVVENEGRTADTLNTQHVNKTEEGKKSLPSTGGEASTSTLLSGITLVLSALSMFVFRKRLFKK

SEQ ID NO: 26545 - protein, 965 aa, Bacillus cereus
  strain G9842
MNKKSKINKVMLSISTMALSLGALQTHAVAEEKVPYNVLKTKPVGIEKPVDEVGHVSKVDETLSFQERLKVGDFSQRPASITKKTAVKQVKESYSMADLNKMNDQELVETLGSIKWHQITDLFQFNEDTKAFYKDKGKMQVIIDELAHRGSTFTKDDSKGIQTFTEVLRSAFYLAFYNNELSELNERSFQDKCLPALKAIAKNPNFKLGTDEQDTVVSAYGKLISNASSDVETVQYASNILKQYNDNFTTYVNDRMKGQAIYDIMQGIDYDIQSYLVEARKEANETMWYGKVDGFINEINRIALLNEVTSENKWLVNNGIYFASRLGKFHSNPNKGLEVVTQAMHMYPHLSEPYFVAIEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLINNQDTYTVPEVADDYLAEHATKSLTAVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNVNGPYNGVVKEGIQFKSDGSNDEDGKIVSYLWEFGDGSTSAEVNPVHVYEREGSYKVSLRVKDDKGKESRSETTVTIKDGSLTESEPNNRPEEANRIGLNSTIKGNLIGGDHTDVYTFNVASAKDIDISVLNEYGIGMTWVLHHESDMQNYAAYGQANGNHIEAKFNAKPGKYYLYVYKYDNGDGTYELSVK

SEQ ID NO: 26546 - protein, 333 aa, Bacillus cereus
  strain G9842
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFIHVIGTHLQAEDSMCGKTSPASVRTNQLKEIQDFIKNKNIPNNEYVLIGGDMNVNKINAENKNDSEYTSMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 26547 - protein, 893 aa, Bacillus cereus
  strain G9842
MGNKKEIAIVALTTGFVLTSVTPYGLGHAEETGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGDSAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVQSVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGNKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSIFRNMKNPTAINFSDGLPYPDDYSKYNDLNGEDYGGVHFNSSIINKVAYLIAQGGTHNGVNVNGIGEDKMFDIFYYANTDELNMTSNFSELKLACLKVATNKYGTNSIEVQAVQNAFDAAKIIEKVKENEKTAENQAPELTVPFTITLRVGDTFDPMRNVKAVDKEDGDLKNKVKHKGDVNTSKPGTYIVEYLVVDSKGGNATAIQTVIVEGNGEISDLEPKLTVPVGAILHVGDSSVPMAEVLAIDKEDGDLTSKIKVDGEVDTSKAGTYVLTYTVTDSKGHEVTAKQTVTVKVREEIKNEKPILKVPATTSITEGDQFDPLIGVSATDKEDGDLTSKVAYKGTIDTTKAGIYEIIYSVRDSVGNEVNTIQKVLVKDKETSKPNGLANKTNSNSISNNSNTDKKEYTYKELPKTGVSTTNSAAIGILMIITGTVLTLIRKFRKIQK

SEQ ID NO: 26548 - protein, 563 aa, Bacillus cereus
  strain G9842
MIEVVKGIREMKKIFSVLLVLFLTFSTWSSVLVKADSPSKGTLTIHKYEQEKDGAQGLEGDGSANQEVPKDAKPLKGVTFEVKKVASFEKISNDGKIVKEDVKPVMGATPTQVVTDDNGQAVLKDISLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPIIDKKINGKLEALPINPLTNYNYDIKTLIPEDIKEYKKYVVTDTLDNRLVIQGKPIVKIDGAEVNASIVEVAIEGQKVTATVKDFTKLDGKKEFHLQIKSQVKEGVPSGSEILNTAKIDFTNKNDVIEEKESKPVVVVPTTGIIELTKIDGANKNKLKGAEFVLKDKNGKIVVVAGKEVTGVSDENDVIKWSNIPYGDYQIFETKAPTYTKEDGTKASYQLLKDPIDVKISENNQTVKLTIENNKSGWVLPVTGGIGTTLFTVIGLTLMVTAAFVFFRKKSANN

SEQ ID NO: 26549 - protein, 372 aa, Bacillus cereus; identical to SEQ ID NO: 26433
  strain Q1

SEQ ID NO: 26550 - protein, 187 aa, Bacillus cereus; identical to SEQ ID NO: 26434
  strain Q1

SEQ ID NO: 26551 - protein, 837 aa, Bacillus cereus
  strain Q1
MLVKDQDKCSKFQAPIPFPASGITGPTGPTGPTGSLGGPTGPQGIQGVQGPIGPTGPTGIQGVQGVQGENGPTGPTGLTGPQGSQGNQGPMGERGPQGIQGVQGIQGERGPTGPTGIQGIQGIPGPIGPTGPTGIQGVQGVQGEIGPTGPTGIQGIQGVQGEIGPTGPTGNTGIQGVQGDLGNSGLQGVTGIQGIQGPIGPTGPTGSQGIQGEQGPMGPTGATGVQGLQGPQGEMGLTGPTGSQGIQGVQGVIGPIGPTGLQGDPGPTGSTGPTGVTGPTGSATGPTGATGPTGPPGGPTGPTGPAGSPGGPTGPTGATGATGATGATGATGIQGVQGVQGPTGATGLTGLQGVQGPMGATGPTGDQGIQGPQGVMGVTGPTGLQGLQGIQGPVGVTGPTGPQGVQGAQGPIGQAGPQGIQGIQGEQGVRGATGPTGLQGLQGIQGIQGPTGPQGIQGVQGLSGITGPTGPQGIQGIQGPQGNIGPTGSTGIQGVQGPEGPTGPTGATGLQGIQGIQGPQGPTGPQGIQGIQGIQGPIGPTGPTGPQGIQGITGSTGPTGQAGATGPTGVTGPQGPQGIQGPQGVTGQTGATGETGATGSQGPQGIQGPQGITGPTGATGPTGATGPTGPQGIQGPQGVTGATGATGATGVIGATGPTGIQGIQGITGATGRTGVTGPTGATGPTGLTGATGSSAISTGGGYFFSTSTSAIAANANISINSGSTVYGTGVSLTSPTTVTVSTPGIYLVSYYFQGDATGGNETVSVRLLLNGTQVAGSFIQNVTTSTVVIEPAISNTLLVNVTSANSTLILQNGPLGVGHVTTIAGAITASLNVVRIL

SEQ ID NO: 26552 - protein, 835 aa, Bacillus cereus
  strain Q1
MRHHRKCKKFGVALPLPLIGATGPTGNSGPIGPTGGHEGPVGPTGVTGPTGATGPQGPQGIRGIQGPRGTTGAQGIQGAIGDTGEQGITGPTGLQGAQGLIGNQGLIGDIGVQGPEGIQGITGPTGSQGIQGPQGIQGEIGERGQTGAQGMQGVIGEAGITGVTGPQGSQGAQGIQGEEGTTGIQGEEGPQGIQGITGEQGHQGDQGIQGVVGPTGSTGPQGPQGISGIKGITGVTGPQGPQGVQGIQGVSGSTGFQGAKGVRGITGATGSTGTQGVEGPPGGPTGATGPIGPSSGVTGPSGPPGPPGGPTGPTGETGARGITGGTGAIGSQGLQGITGPTGPQGVRGAQGAQGVVGAVGVQGAQGSQGNQGITGATGVEGPQGIQGPQGEIGPTGAEGPKGVQGIQGVTGPTGAQGMQGLQGIQGPTGVAGAAGAQGAQGIQGATGPAGAQGIQGAQGIRGETGAAGVQGIQGVQGIQGITGLTGPQGAQGPQGVQGIIGPTGAIGSQGPQGIQGIVGPTGAQGSQGMQGIQGITGPTGAQGIRGPQGNLGENGITGPQGVQGAQGNQGPQGAQGNIGATGVTGETGATGEVGATGAQGIQGVQGIMGIQGSTGMTGPTGATGVTGIQGSQGIQGPQGPTGARGTTGVSGSVGPAGAQGSQGPIGAVGPTGATGSAGSIGFLGIAGATGATGLPSGGGYFFSTSTSTIAANALIPINSGSTVFGSGVSLTNATTVTLSTPGIYLVSYYFQGDPTAGNETISVRLTLNGTQVAGSFIFYVTGGTFILEPAVSNTMVIEVTASNATLSLQNGPLAIDHVTTLSGVITASLNVLKIV

SEQ ID NO: 26553 - protein, 971 aa, Bacillus cereus
  strain Q1
MKGYSKKVLVGVSFASFMLGSFQGDALAEGTKGEQVSYRNVLKMEPIGLQLPVQELAHSSKVLENKSFEKRLKFADLSQRPPEVKKESKQLAVAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNSNFKLGTLEQNRVVSSYGKLIGNASSDVETITSAAKIFKQYNDNFSTLVDNLSAGNAIYDIMQGVDYDIQSYLYDTRKAPEDTIWYQKIDSYINELSRFALIGTVTAKNGWLINNGIYYTGRLGTFHSTETKGLQVVTDAMKIYPYLGEQYFVAAEQIATNYGGKDANGKVVDLDQIREDGKKKYLPKTYTFDDGAIVLKAGDKVTEEKVKRLYWAAKEVKAQFHRTVESDQPLEKGNPDDVLTMVVYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLSNVSVKKNKSQFFHTFTLQGTYTGTTAKGEYEDWKTITQNVNDTLKRLSAKEWTGYKTVTAYFVNYRVNAAGQFEYDVVFHGINTEEGAVNKAPVAVINGSYSGNVNAAISFKSDGSKDEDGKIVAYKWEFGDGTVSNEQNPTHVYTKEGTYTAKLTVTDDKGLTNTATTNVTVQKKEDNSVEKEPNNSFQTANKLQFNQVLRASLGNGDTSDYFEINVETAKNLQINVTKENNIGVNWVLYSEADLNNYVTYAQQEGNKLVGSYYTYPGKYYLHVYQYGGGTGNYTVEVK

SEQ ID NO: 26554 - protein, 733 aa, Bacillus cereus
  strain Q1
MNNKNKGKVFYGNDCCEVRACSHINISKSELTEFVILLQALGQAIQAVFQNPSQNNIDNLIAALNNLQKFLNCLDLSPAQKQIGNSIIANLLTILRTTPFSCGALYVELQSLLNYLLYIAKLFKVDCCTTDKLVKLITEIQAILVQYGSGCLGGGGATGATGATGATGATGPQGPAGATGATGATGPQGPAGAQGATGPQGPQGAQGPAGVQGATGPQGPQGIQGPAGATGATGPQGVQGPAGATGATGAQGPQGATGATGATGAQGPQGVQGPAGATGATGAQGPQGATGATGATGAQGPQGVQGPAGATGATGAQGPQGVQGPAGATGATGAQGPQGVQGPAGATGATGAQGPQGVQGPAGATGPQGVQGPAGATGATGAQGPQGVQGPAGATGPQGVQGPAGATGATGAQGPQGVQGPAGATGATGAQGPQGVQGPAGATGATGAQGPQGVQGPAGATGATGAQGPQGVQGPAGATGATGAQGPQGVQGPAGATGATGAQGPQGVQGPAGATGATGAQGPQGVQGPAGATGATGAQGPQGVQGPAGATGATGAQGPQGVQGPAGATGPQGPAGATGATGAQGATGAQGATGATGPAGTPIPVTIAAIGNSNPQTISPGTNLQFNQVFELTNISFNDTSDTLTILETGVYDISFSASTTFPGSSPFGFGISFNGQPPTRNFSTNVIGSAVSFSTIVTLQAGTTISIQPTANTISIPNTGDTTATLSVFRIY

SEQ ID NO: 26555 - protein, 1261 aa, Bacillus cereus
  strain Q1
MSNKDKKFKNPLNFDDIISAISYDPSVIGPTFPNTTIVSPTGITGPTGSTGSTGATGDTGATGDTGPTGNTGPTGNTGPTGDTGATGDTGPTGNTGPTGITGSTGDTGPTGNTGPAGITGSTGDTGPTGATGPSGATGNTGPTGVTGPSGATGNTGSTGVTGTTGPTGITGPTGITGATGNTGPTGNTGPTGDTGSTGSTGPTGNTGPTGVTGTTGPTGITGATGDTGTTGPTGITGPTGITGATGDTGPTGNTGSTGDTGSTGVTGTTGATGPTGATGNTGNTGPTGNTGPTGITGATGATGPTGNTGSTGDSGPTGNTGSTGDSGPTGNTGITGPTGATGNTGSTGSTGPTGNTGPTGVTGTTGITGPTGNTGPTGNTGPTGNTGPTGVTGTTGPSGATGNTGSTGNTGPTGITGATGDTGPTGITGPTGITGATGDTGPTGNTGPTGITGPTGDTGPTGNTGPTGNTGPTGNTGSTGDTGPTGNTGPAGNTGAIGNTGPTGITGPTGDTGPTGNTGPTGATGNTGSTGVTGPTGSTGPTGNTGPTGVTGTTGPTGITGPTGNTGPTGNTGPTGNTGPTGVTGTTGPSGATGNTGPTGNTGPTGDTGATGDTGPTGNTGPTGITGATGDTGPTGNTGPTGATGNTGPTGNTGPTGDTGSTGSTGPTGNTGPTGVTGTTGPSGNTGPTGVTGTTGPTGITGPTGITGPTGITGPTGITGATGDTGPTGNTGPTGNTGPTGNTGPTGDTGSTGDTGPTGNTGPAGNTGAIGNTGPTGNTGSTGDTGPTGSTGVTGTTGPTGNTGATGDTGATGDTGSTGPTGNTGSTGPTGPTGNTGATGDTGSTGPTGNTGSTGVTGTTGPTGNTGPTGDTGSTGVTGTTGPTGNTGPTGDTGSTGPTGVTGTTGPTGNTGPTGATGPTGATGNTGNTGPTGVTGTTGPTGITGPTGDTGPTGNTGPTGNTGPTGDTGATGDTGPTGNTGPTGNTGPTGITGATGDTGPTGNTGPTGVTGTTGPTGITGPTGITGPTGDTGSTGVTGTTGPSGNTGPTGATGPTGNTGPTGVTGTTGPSGNTGPTGATGITGPTGATGPSGSTGPTGRTGTTGNTGPTGSTGPTGSTGPTGTLAQAYASLTLGVNQTVAANGKVNFSGGGTNLNGITFNGSDTLTIQQNGDYMITLNVSPALGSVTPAAFGVGLNNNPTPSTNMVSNVSGGMISSTTIISLTAGTTLSLFNNSGVAVSLNNGAGGAAGGGVARVTVIRVD

SEQ ID NO: 26556 - protein, 553 aa, Bacillus cereus; identical to SEQ ID NO: 26419
  strain Q1

SEQ ID NO: 26557 - protein, 788 aa, Bacillus cereus
  strain Q1
MLAGATLAIGVIAPQVLPATAHADEQTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVINANTNRIINMTYEGKPVADNQEFIVATNNYRGSSQTFPGVSKGEVVYQSQDETRQIIVKYMQETPVIDPAADKNWAFKPIVADKLHTTFDSSPNAQKYIKKDGNISYVGPSENEFAKYAIDITKKNDDDKETGGENPTTPPTSEGNNGENPTTPPTSEGNNGENPTTPPTGEGNNGENPTTPPTGEGNNGENPTTPPTGEGNNTGSGQTTTDNQNVKETTTVSEKKEERDLPKTGTSVVSTIGAGLAFVGAGFLLLFRRKKANR

SEQ ID NO: 26558 - protein, 503 aa, Bacillus cereus; identical to SEQ ID NO: 26421
  strain Q1

SEQ ID NO: 26559 - protein, 204 aa, Bacillus cereus
  strain Q1
MNSDEKLSLNKGMVRPENIGPTFPVLPPIYIPTGATGVTGATGATGVTGATGATGVIGVTGTTGATGATGVTGATGATGVTGTTGATGATGATGATGATGTTGATGVTGATGPTGVIGPITTTNLLFYTFSDGEKLTYTDSDGLAQYGTTHILSPDEVSYINLFINGILQPHPLYQVSTGQLTLLDNQPPSQGSSIILQFIIIN

SEQ ID NO: 26560 - protein, 1330 aa, Bacillus cereus
  strain Q1
MRERDNKRQQHSLNPNFRISPELIGPTFPPVPTGFTGIGITGPTGPQGPTGPQGPRGFQGPMGEMGPTGPQGVQGIQGPVGPIGATGPEGQQGPQGLRGPQGETGATGPGGVQGLQGPIGPTGATGAQGVQGIQGLQGPIGATGPEGPQGIQGVQGLPGATGSQGIQGVQGIQGPQGPSGNTGATGATGQGITGPTGITGPTGITGPSGGPPGPTGPTGATGPGGGPSGSTGATGATGNTGATGNTGITGATGSTGPTGSTGAQGLQGIQGIQGPIGPTGPEGPQGIQGIPGPTGVTGEQGIQGVQGIQGITGATGDQGPQGIQGVIGPQGVTGATGDQGPQGIQGVPGPSGATGPQGVQGIQGPMGDIGPTGPEGPEGLQGPQGIQGVPGPVGATGPEGPQGIQGIQGVQGATGPQGPQGIQGIQGVQGITGATGIQGATGIQGIQGEIGATGPEGPQGVQGAQGAIGPTGPMGPQGVQGVQGIQGATGAQGVQGPQGIQGIQGPTGATGDMGATGATGEGATGPTGVTGPTGVTGPSGGPAGPTGPTGPSGPAGVTGPSGGPPGPTGATGATGLTGDTGATGSTGVTGATGETGATGVMGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGPQGPTGIQGIQGEIGPTGPEGPEGLQGPQGIQGVQGPVGATGPEGPQGIQGIQGVQGATGPQGPQGIQGIQGVQGITGATGAQGATGIQGIQGEIGATGPEGPQGVQGIQGAIGPTGPMGAQGVQGIQGIQGATGAQGVQGPQGVQGIQGPTGATGDTGATGATGEGTTGPTGVTGPTGVTGPSGGPAGPTGPTGPSGPAGVTGPSGGPPGPTGATGATGVTGDTGATGSTGVTGATGETGATGATGVTGLQGPQGIQGVQGEIGPTGPQGIQGPQGIQGVTGATGAQGPQGIQGPQGDIGPTGPQGIQGPQGPQGIQGATGATGAQGPQGIQGPQGDIGPTGPQGPQGIQGPQGIQGPTGATGATGATGPQGIQGPQGIQGPQGIQGPTGATGATGATGSQGIQGPQGIQGPQGIQGPTGATGATGATGPQGIQGPQGIQGPTGATGATGATGPQGIQGPQGIQGPTGATGATGSQGPTGDTGPTGAGATGATGATGVSTTATYAFANNTSGSVISVLLGGTNIPLPNNQNIGPGITVSGGNTVFTVANAGNYYIAYTINLTAGLLVSSRITVNSSPLAGTINSPTVATGSFSATIIANLPAGAAVSLQLFGVVALATLSTATPGATLTIIRLS

SEQ ID NO: 26561 - protein, 405 aa, Bacillus cereus
  strain Q1
MGLLEAPDLPGILDPLGIPDLLEAPDPLASLDLLVTPDLPEALDLLVTPDLPEALDPLGTPDLLEAPDLPEAPDPLASPDLLASPDLLEALDPLASLDPLASLDLLASLDPPASPDLPEALDPLASLDLLASLDPPASPDLPEALDPLASLDLPEALDPLASLDLLVTPDLPEALDPLASLDLLVNTGSTGSTGPTGITGPTGITGPTGNTGPTGNTGSTGSTGPTGITGPTGITGSTGPTGSAGSASAKSIVFQGTNAGFQRIAGSPGIDSNVIPYVTAGFGSIVGFTASINVNNLPAAAYTIDICRNVPTNLTAPTSSYILTTITLTTTNKITGTIVFSIKPTDTGSGQIQVFNPTPVVGPATVTWTSITTGNLVSRGDAISLYINPGITASAVYSVFLITDI

SEQ ID NO: 26562 - protein, 965 aa, Bacillus cereus
  strain Q1
MNKKSKINKVMLSISTMALSLGALQAPASAEEKVPYNVLKTKPVGIEKPVDEIGHVSKAEETLSFQERLKVGDFSQRPASIPNKAAVKQVKESYSMADLNKMNDQELVETLGCIKWHQITDLFQFNEDAKAFYKDKGKMQVIIDELAHRGSTFTRDDSKGIQTFTEVLRSAFYLAFYNNELSELNERSFQDKCLPALKAIAKNPNFKLGTAEQDTVVSAYGKLISNASSDVETVQYASNILKQYNDNFNTYVNDRMKGQAIYDIMQGIDYDIQSYLIEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPAVADDYLAEHAPKSLTAVEKEMTETLPMKDAKMTKHSSQFFNTFTLEGTYTGSVTKGESEDWNAMSKKVNEVLEQLAQKEWSGYKTVTAYFVNYRVNSSNEFEYDVVFHGIAKDDGENKAPTVNINGPYNGLVKEGIQFKSDGSKDEDGKIVSYLWDFGDGRTSTEVNPVHVYEREGSYKVALIVKDDKGKESKSETTVTVKDGSLTESEPNNRPEEANRIGLNTTIKGSLIGGDHTDVYTFNVASAKDIDISVLNEYGIGMTWVLHHESDMQNYAAYGQANGNHIEANFNAKPGEYYLYVYKYDNGDGTYKLSVK

SEQ ID NO: 26563 - protein, 431 aa, Bacillus cereus; identical to SEQ ID NO: 26428
  strain Q1

SEQ ID NO: 26564 - protein, 338 aa, Bacillus cereus
  strain Q1
MEVWNVKGKLLKGVLSLGIGLGVLYGGSSAQADTSTDQNNILKVMTHNVYMLSTNLYPNWGQSQRADLIGAADYIKNQDVVILNEVFDNSASDRLLGNLKKEYPNQTAVLGRSNGNEWDKTLGSYSSSTPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFVENKVLQPKSPQWTVTSWLKKYTYDDYSDHYPVAATISMK

SEQ ID NO: 26565 - protein, 564 aa, Bacillus cereus; identical to SEQ ID NO: 26430
  strain Q1

SEQ ID NO: 26566 - protein, 456 aa, Bacillus cereus
  strain Q1
MNKKILGQFRKMATNKKGLSAAAVAVGIMSTTLIPQNAYAHGFVEKPGSRAALCSQNYGALNSNCGNIMYEPQSLEAPKGFPQGGPADGKIASAGGLFGGILDQQTADRWFKNTIKGGENTFTWKYTAPHSTSQWHYYITKKGWNPNNPLTRADFEPIGTVKHDGSKASNNLSHKINVPTDRSGYHVILAVWDVADTVNAFYNVIDVNLINDEKPDTEAPAQPSGLQVVKTTSNSVELNWKPATDNVGVKEYQVLRNGELINTVVGTSVIDKKLNPNTEYTYTVRAVDAAGNISEKSEALVIKTTEEKPDTEAPTQPKGLHSMGTTTSSIDLMWSPSEDNVDVSHYIVYREVGGAMKEIGTANTTSFMDKDLQANTAYKYVVSAVDTSGNESMKSDAITVTTKGQENSYEQWDARKAYKAGDRVVHEDKVYEAVQSYQGNGDPNWIFALSLWKEVN

SEQ ID NO: 26567 - protein, 176 aa, Bacillus cereus
  strain ZK / E33L
MYKKLGTIALTGALAFSLAACGETEVKEVSKDNAPKQEEKKDKKETTENKVYKVGDTIEVNGLQLTFSSVKFVEPNEYIKPEKGKVLEIAFNAKNNGKKDIFFGTSELKIADAQGNQFKEYFGGENTFVTENIAPGNQITNKMLYDVPEGDKFVGTYKPTFTFDEKSVKFEFDVAK

SEQ ID NO: 26568 - protein, 187 aa, Bacillus cereus
  strain ZK / E33L
MEVEKKSKVWEYVGWGSFILVGSFLFFCALILVFGDPKTKYQAQEVTAQGQEVKNAEKDVKKEYSVGETIKLGDHRLTVNDVKKSSGGEYDKPKQGHEYVLVAVNIYNGGKEDISYNPFDFEMRNSQGNITRAVPSIINQNTQLSAGQLAPNGQVAGTVVFEQPIGEKLKLQFTPNFWSKKKIIVNL

SEQ ID NO: 26569 - protein, 260 aa, Bacillus cereus
  strain ZK / E33L
MKPIRVYLVCKFLNYLHLPFRKKKQSRLKLTLHKLSLIAMWFYPKEGCSSLFLFSFDRMRQNSCNHFCYDNLGNLTFFIIGGTEMYKKLGTIALTGALAFSLAACGDTNESAKKVSTNENKTEQPSEKKEEKKEFKVGETIQLGNHKLTVSNIEKSQGGEFDKPKEGHEFIIANLTIENGGKEEISYNPFDFTLQNSEGNIVNETFTTVNQNTQLNAGQLAPNGKVTGSIAFEAKQGDPKLQLIFKPNFLSSKEIRVNLQ

SEQ ID NO: 26570 - protein, 791 aa, Bacillus cereus
  strain ZK / E33L
MIKENGFMKRIILCIFVLSFVMGSFSLNAVAETEESAKMISNWKRVLVGEPFTNDDVILKNIVWDKEKDLQDNVLSNLNKENESPSLFKNLPDWKQNSAQITETVKNIEKMAVLYQTPNSIYYQKDTLQKDIMYAIEYFYDQMYNEKIKNTYGNWWDWEIGIPQSYNNILVLMFDDLTEVELSKYIMAVDRFVPDPTKRLNGIKETGANLLDKSFIVMVRGILNNNNNKIQLGIDATNDVYKIVQNGDGFYKDGSFIQHTYNPYTGGYGEVLLARSADIHELFSGTDRLTNVQGIKKLYTYIETTYLPVMKQGEVFDMTRGRGMSRQNSSSSIVGRNILYEILVISSQNQDLSYRGKYARYVKEAIFQHNDSESYYNGLSIHKTQTFQRLMSDSSIKPDFGVRDTNNMLSAMNQMTHQKKDFAAGLSLFGKQISSFEYGNGENMKGFYMGTGMLYLYNNDLGQYDNDYWATIDMTRLPGTTTDHKLGNLIDWKNYNNPKSWSGGVSDGQIGSASMYYTMQNVTGSSLEAKKSWFFLKDKIVAMAAGINSKENADTETIVENRRLGKNGSNLLKVENTEVALDQGILFKGASWAHLKGKNNQSDIGYVFPQSENIYAEKKERSGKWSDVNKGGSSDQVSNMFATLSIPHGKSPSGGEYVYVILPGKNQEETSTYAKEMDVSILSNTPMQQVIYDDADDIWMGNFYEIGKVNEVEAKTRGTIAINYKGNGVKVVMADPMKEQAKVIFTIPKKLGYKVAEKDDEITVKEDANSWIIEMDSSDKSGKSSQVYFEQ

SEQ ID NO: 26571 - protein, 456 aa, Bacillus cereus
  strain ZK / E33L
MNKKILGQFRKMATNKKGLSAAAVAMGIMSTTLIPQNAYAHGFVEKPGSRAALCSQNYGALNSNCGNIMYEPQSLEAPKGFPQGGPADGKIASAGGLFGGILDQQTANRWFKNTIKGGENTFTWKYTAPHSTSQWHYYITKKGWDPNKPLARADFELIGTVKHDGSKASNNLSHKINVPTDRSGYNVILAVWDVADTVNAFYNVIDVNLINDEKPDKEAPTKPSELQVIKATSNSVEFNWKPATDNEGVKEYQVLRNGELINTVVGTSVIDKKLNLNTEYTYTVSAVDAAGNISEKSEALVIKTTEEKPDTEAPTQPKGLHSMGTTTSSIDLMWSPSEDNVDVSHYIVYREVGGAMKEIGTANTTSFMDKDLRANTTYKYVVSAVDTSGNESMKSDAIKVTTKGQENSYEQWDAHKAYKAGDRVVHEDKVYEAVQSYQGNGDPNWIFALSLWEEIN

SEQ ID NO: 26572 - protein, 173 aa, Bacillus cereus
  strain ZK / E33L
MKKLLASATAFTLLTVGYSSAAFAAKSPNDTKNCGHFKNQQEAQAFWNQNGYGVGNDPHRLDNDKDGIPCEDYKYPTNTNTTTDNKETTKPQEQTKQENPKQEPVKQENTQQNNQATNNKQGETKQTAVKTETKKQGEKLPNTASNSITMMLASAALVLAGSILVFRRKKINA

SEQ ID NO: 26573 - protein, 960 aa, Bacillus cereus
  strain ZK / E33L
MNKKSKFTQMMLSISTMALSFGSIQTQVSAEEKAPYNVLQIKPIGTETSKDEIVHATKADEILTFEERLKVGDFSQRPTLVMKRDESQLKQSYTLAELNKMPDSELIDTLSKISWNQITDLFQSTQDTKAFYQNKERMNIIIDELGQRGSAFTKEDSKGIETFVELLRSAFYVGYYNNELSYLKERGFHDKCLPALKAIAKNPNFTLGTAEQDRVVAAYGKLISNASSDTETVQYAVNILKQYNDNLSTYVSDYTKGQAVYEIVKGIDYDIQSYMQDTNKKPNETMWYGKIDNFINEVSRIALIRNITTENSWLINNGIYYAGRLGKFHSNPYKGLEVITQAMSLYPRLSGPYFVAVEQIKTNYGGKDYSGNAVDLQKIREEGKRQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFETFDKLQDLIRANDVKNYDLYRESLSNNTQLNAEYQTYMQQLIDNQDKYNVPQVTNDYLIQHAPKPLAEVKNEIVDVANIKDEKITKHESQFFNTFTVEGKYTGGTSKGESEDWKTMSKQVNQALEQLSHKGWSGYKTVTAYFVNYRVNAANQFEYDIVFHGVATEEKEKTNTIVNMNGPYSGIVNEEIQFHSDGTKSENGKVISYLWNFGDGATSTEANPTHVYGEKGTYTVELTVKDSRGKESKEQTKVTVKQDPQTGESHEEEKVLLFNTLVKGNLVTPDQTDVYTFDVTDPKEVDISVVNEQNIGMTWVLYHESDMQNYVACGEDEGDVIKGKFAAKPGKYYLNVYKFDDKNGEYSLLVK

SEQ ID NO: 26574 - protein, 88 aa, Bacillus cereus
  strain ZK / E33L
MGQTVKFKEGKVEQSKPAQPHPDISNPTSEQPKEQVKVQPQPKKEIESKIGWLPQTGTNLTSWISIAAGALLLIVGEVIFLKRKMHKN

SEQ ID NO: 26575 - protein, 309 aa, Bacillus cereus
  strain ZK / E33L
MMENKKGSKHNEFLSAKAFNPNLVGPTLPPVPSFTLPTGPTGATGATGVTGATGATGATGATGVTGATGATGVTGATGATGVTGATGATGATGATGVTGATGATGVTGATGATGVTGATGATGVTGVTGATGATGATGVTGPTGATGATGATGVTGPTGATGATGATGGLAVASASAMTSTAQTVDNLVAVQFTAPVLELDSVIFNGTDTFTVLVPGNYYCIGSLMPAETQTGPFAVGIGLNGIPVPALDGANYAQSAGQEVVGFGLTGQIPAGTTISLFNLSGHTISIGGTISGATSVAARLLLFRIS

SEQ ID NO: 26576 - protein, 431 aa, Bacillus cereus
  strain ZK / E33L
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERLGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 26577 - protein, 3472 aa, Bacillus cereus
  strain ZK / E33L
MKKSLKCFNVVTIIALLLSITLPSPSAFAEIHKKSWDELQGNDVRIKAEQVNAEIYRGEVAQREHVFQYTIENTGDTPIQELVLKQNNENEITFLSQSMKVNGEKLPENKVADFYVEEKDKGGKLLSSNLKIRDLKSHEKMTVLIKASRTQHFNKEYKQKISVQKDQVQIGSMFFDVEGIPSEEKVEANADDEADSSKEEVGPSADSTTKKVDEKLKVSVEDKNKSTSKTELPKQPVTEAEKQPEKEAEKQNGTEVQAASENASKVQIQVGDKQGFGDPLYSTIAAGNLVQTGNVTLGLTDNHYTRQSVGGKTNKKAVDVDNDDTTFNSSTGAFPNIPAGSKVKKAYLFWTAAMGTPASGYKDYRVSDEDVRQPVKMKMGNKEYAEVSADSIRKANSLPYISNYSGSGAGYVAYADVTNVIAKQGISQTVTVANIPQIKFENGGGYYWGNWNLILVYENYKETVKDMKIWEGLVSQKSTAWADISVNKINTPKEGAFKAKFSYFSSQGDPAENDIYAYDYGEYDFGFGYQKLKNINGKDNDVNDSSMTEVQVDGTNEFVTKKYPGYNPDWTNSFSTDIHTYHLEGPNQVKNDLKEAKMRFRANGGGGDIYVLNNATFVTEHNAPNLQVDKKALDSAGKEIKEVKAGEEITYQIEVKNDTKNNQAPVSNVKGFDKLDDRLEYVPGSIQYVTGSNTGQKTDDASDDEAEFVNNQIDFRIGEGADAKDGGVLKPGESAILTFKVKVKESIKSDTTVKNVVAVKGQDSAEIKYESEDDANVTVTIPKEVPGEIEARKIASNKSPKLGDEVEYRITFKNKVKDGRLDVLTIEDELPGSLEYVKDSLKAEGVQPEPVELKFENGKIIAKYPAITDMEERSIVFKTKVKENAEIGKEITNKATVSDKTTSPKNIEEKITPQHKAGKIDAKKKATNKHPKLGEEFEYQISFNNTVENGKLEAVTIEDEIPANLEFVQGSERAEGAGPSPVELKVENGKVIAKYPEITDTKERSIIFKVKVKEEAKAGETIVNKAVVSDPNGQSEYPEEKVTPDYKDGKVDVDKSVTNQTPKLGEEVEYRITFHNKVENGKLENVLVEDTLPKGVEYVKDSLKAEGSKPEPVELKMENGKIIAKYPEITDTEKRSIVFKVKVKDSAKVGEAIVNKAIAKDPKNEPVESDVVITPQSKKGEIAATKVVNNKKPKLGEEIEYRIRFHNMVENGKLAEVRVEDTIPKGLEYVENSIKAEGEAPSPVELTVEAGVVKAKYIDITDTKERSIVFKVKVKEEVEVGKEIVNKAIVDDTKHQPIEPEERITPQHKDGIINAAKIVDNPSPKLGEEVEYRISFKNTVENGKLEKVKIEDTIPNGLEYVKGSEKAEGDKPAPVKLHVKDGKVIAEYENITDTKERSIVFKVKVKEEAEVGKEIVNQAIVDDTKDSKKPEAKITPLHKDGKIKAKKSVNNETPKLGEEVEYRISFKNTVKNGKLAEVKIEDTLPEGLEYVENSLKAEGAGPNPVELKMENGKVLAKYPEITDIEERSITFKVKVKEEVKVGEKIVNKAIVDDTKHDPINPKAEITPQYKDGKIEAEKVVNNETPKLEEEVKYRISFKNTVEHGKLAEVIIEDDLPNGLEYVKGSLQAEGSKPNPVELKFENGKVLAKYPEITDTKERSITFKVKVKGNVSDTIVNEAIVSDTKHPPETPKAEIIPQHKDGKLEAKKVVNNLLPKLGEEVEYRISFKNTVENGKLAEVKIEDTLPEGVEYVENSVKAEGAGPNPVELKVEKGKVLAEYPAITDTEERSITFKVKVKEEVKIGEKIVNQAIVDDTKNKPETPTAEITPQHKDGKVEAKKTVNNPSPKLGEEIEYRISFKNTVENGKLAEVKIEDNLPNGLEYVKDSVKAEGSKPEPVELQVKDGKVIAKYPEITDIEERSIVFKAKVKEDFKVGEGIVNKVVVDDTKDPKTREVTVTPEYKDGKLKAEKFVNNKKPKLGEEVEYRINFKNTVENGKLVEVKIEDNLPNGLEYVKDSLQAEGSKPSPVELKFENGKVMAKYPVITDTKERSIVFKAKVKEEAEIGKEIVNKAIVVDTTHEPEKPYVEITPQYKDGKITAEKVANNHKPKLGEEVEYRIRFKNTVENGKLAEVNIKDTLPKGLEYVEGSITAEGSKPKPVELKVENGKVTAKYPAITDTEERSIVFKAKVKESVKAGEEIVNEAIVDDTKNVPEEPYVPITPQYKDGKIEARKEVSNYEPKLGEEIEYRIIFNNTVKDGKLAEVKIEDEIPAGLEFVQGSEKAEGAEPKPVELKVENGKVIATYAEIMDTEERSIVFKVKVKESVTIGKAITNKAIIHVDDPNHPIIEPTAKITPQYKDGKIIAHKKVNNDKPKLGEEIEYRISFSNTVKDGKLAEVKIEDEIPSGLEYVKDSLKAEGDEPAPVELKEEAGKVTAKYENITDTKERSIIFKVKVKDSVEVEKAIVNKAIVDDTKNPPERPEVDITPQHKDGKVKADKKVSKKDPKLGEEVEYRISFKNTVENGKLAEVKIEDQLPTGLEYVKDSLKAEGNEPNPVELKEEAGKITAKYENITDTAERSIIFKVKVTEAVKVGKEIVNTAIVDDHNPKNPLQKPEAIITPEYKDGKLKAEKTVNNPAPKLGEEVEYRITFRNVVEHGKVAKVKIKDELPSSLEFVEGSERAEGANPKPLHVKVKNGIVLAEYPEIVDTKERSIIFKVKVKEKAKVGEEIVNTAVVEDTINPPEQPNVTIHPQYKDGALQAEKTVSNQEPKLGEEVEYRISFENTVENGRLTEVKVEDEIPAGLEYVQDSIKSDGPEPNPVELKVENGKVTAKYPEITDMKKRSIIFKVKVQETVQVGKEIINKAIVDDNNPTTPPVESLIPITPQYKDGKLEARKEVSNHEPKLGEEIEYRITFNGTVDGGKLVDVKIEDEIPAGLEYVKDSLEAVGDKPVPTELKVENGKVTAKYPEITDTKERSIIFKAKVKETVKVGGEITNKAIIHVDDPNHPVIEPTATIKPEYKDGKLKATKAVSNKEPKLGEEVEYRISFKNTVENGKVAEVKVEDEIPAGLEYVQDSLRFEGAEPNPVELKVEFGKVIAKYLDIADRKERSIIFKAKVKETVETGEKIVNKAIVGDTINQPEEPVVSITPQYKDGMLKAEKEVSNKEPKLGEEVEYRISFKNTVENGKLAEVKIEDQLPDGLEYVKDSVKAKGAIEVKVENGKLTAKYENIIDTKERNITFKVKVKEKAGEEIVNRAIVDDGINQPLEPTVSIKPKEPEVKPEDPKEPEVKPEDPKEPEVKPEDPKEPEVKPEDPKEPEVKPEDPKEPEVKPEDPKEPEVKPEDPKEPEVKPEDPKEPEVKPEDPKEPEVKPEDPKEPEVKPEDPKEPEVKPEDPKEPEVKPEDPKEPEVKPEDPKEPEVKLEKPEVRLEKLIKEPQVKVERELPKTGAASPWMMSVGAGISFLVGGVLFVLGRRRKQ

SEQ ID NO: 26578 - protein, 148 aa, Bacillus cereus
  strain ZK / E33L
MKKKLLPICAIALLTVGYSSVASADTGTVTKEEATQLQQDKAKKEAAIKEQQKNEEEKKRIAQEQLKNDMAKKEEAIKAQQKSEEGKKEAAQVQQKNAATKKEVAKPAVQGEKLPNTASNNVVMMGLSACLVAIGTLFGLKRRNKVKA

SEQ ID NO: 26579 - protein, 815 aa, Bacillus cereus
  strain ZK / E33L
MVKVVEGNSGKSKIKSSLNSNFKLSSGLVGPTFPPVPTGMTGITGSTGATGNTGPTGETGATGSTGVTGNTGPTGETGVTGSTGPTGETGSTGNTGATGETGPTGSTGATGSTGVTGSTGPTGNTGPTGETGVTGSTGPTGNTGATGETGPTGSTGPTGETGVTGSTGVTGPTGATGNTGATGSTGVTGNTGPTGETGVTGSTGPTGNTGATGNTGPTGETGSTGVTGSTGATGSTGVTGPTGVTGPTGETGVTGSTGPTGNTGATGNTGPTGETGVTGSTGPTGNTGATGNTGATGETGSTGVTGSTGVTGSTGATGSTGVTGNTGATGSTGATGNTGPTGATGSTGVTGNTGPTGETGPTGSTGPTGNTGATGNTGATGATGATGATGSTGPTGNTGATGNTGPTGVTGSTGPTGSTGETGETGPTGETGVTGSTGPTGPTGATGNTGPTGETGATGSTGETGETGPTGETGVTGSTGPTGNTGATGNTGPTGETGVTGSTGPTGNTGATGNTGPTGETGETGVTGSTGVTGNTGATGSTGATGNTGPTGETGATGPTGATGVTGSTGPTGNTGPTGETGSTGSTGATGSTGVTGNTGATGETGPTGSTGATGNTGATGETGPTGATGVTGPTGSTGVTGSTGPTGSTGATGATGSTGPTGSTGTTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFNATIIASLPAGAAVSLQLFGVVALATLSTATPGATLTIIRLS

SEQ ID NO: 26580 - protein, 337 aa, Bacillus cereus
  strain ZK / E33L
MQERYSRQILFSGVGEEGQRKIREKHVLIIGAGALGAANAEAIVRAGVGKITIADRDYVEWSNLQRQQLYTEEDAKQYKPKAVAAAEHLKAINSEVEINPVVTDVTVQEMEELVKDVDLILDATDNFETRLLINDISQKYNIPWIYGGCVGSYGVTYTIVPGKTPCFRCLMEHPASGATCDTAGIIQPAVQLVVAHQITEALKILVEDFEALRETMLSFDLWNNQQMAFKVNRQKKDTCLSCGRLRTYPSLTFEAQTKTEVLCGRNTVQIRPGVRNEFNLEEIKKRLQRSVDVKATPYLVSFLVEEFRFVLFTDGRAFIHGTNDINVAKRLYTRYIG

SEQ ID NO: 26581 - protein, 327 aa, Bacillus cereus
  strain ZK / E33L
MINMSSWRNNINGYCGCNDQNGVHVDLCCFSCDGTVPKLGPTGPTGPTGATGVTGSTGATGITGSTGSTGSTGPTGSTGSTGSTGSTGSTGLTGATGSTGPTGVTGSTGPTGATGSTGPTGVTGSTGPTGATGSTGPTGVTGSTGPTGSTGPTGSTGSTGSTGSTGSTGPTGPTGPTGPTGSTGPTGVTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGDAISLQLFGLLAVATLSTTTPGAVLTIIRLS

SEQ ID NO: 26582 - protein, 779 aa, Bacillus cereus
  strain ZK / E33L
MKKSKKMLAGATLAIGVIAPQVLPTTAHADEKAGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDKETGGENPTTPPTGEGDNGENPTTPPTGEGNKGENPTTPPTGEGNNGGNPTTPSTDEGNNAGSGQTTTDNQNSKETTTVSENKEERDLPKTGTSVASTIGAGLAFIGAGFLLLFRRKKANR

SEQ ID NO: 26583 - protein, 813 aa, Bacillus cereus
  strain ZK / E33L
MGLLDLLDLKVTQVLLVPLDLKVFKVTRALLVPLDLKVFKDQQVPLDLKALKDQRVLLALLDLKAFKVTQVLLVPLDLKALKDQQVLLVPLDLKAFKVTRVLLVPLDLKVFKDQQVPLDLKVFKDQQVPLDLKALKVTQVLLVLLDLRVFKDQQVLLDLRVFKDQRVLPVPLDLKVFKVTQVLLVPLDLRVFKDQRVLLVLLDLRVFKDQRVLPVPLDLKVFKVTQVLLVPLDLKVLKVTRALLVPLDLKVFKDQQVLLDLKVFKGQQVLPVPLDLKVFKVTRVLLVPLDLKVLKVHGATGATGPQGVQGPAGATGATGPQGVQGPAGATGATGPQGVQGNTGATGATGPQGAQGNTGATGATGPQGVQGPAGATGPQGVQGPAGATGATGPQGVQGNTGATGATGPQGAQGNTGATGATGPQGVQGPAGATGPQGVQGPAGATGPQGVQGNTGATGATGPQGAQGNTGATGATGPQGVQGPAGATGATGPQGAQGPAGATGATGSQGVQGPAGATGATGPQGVQGPAGATGPQGAQGPAGATGPQGAQGPAGATGPQGAQGPAGATGATGPQGIQGPAGATGATGPQGVQGPTGATGIGVTGPTGPSGGPPGPTGPQGPQGNTGATGPQGIQGPAGATGATGPQGTQGPAGATGATGPQGVQGPTGATGIGVTGPTGPSGPSFPVATIVVTNNIQQTVLQFNNFIFNTAINVNNIIFNGTDTVTVINAGIYVISVSISTTAPGCAPLGVGISINGAVATDNFSSNLIGDSLSFTTIETLTAGANISVQSTLNEITIPATGNTNIRLTVFRIA

SEQ ID NO: 26584 - protein, 748 aa, Bacillus cereus
  strain ZK / E33L
MSRYDDSQNKFSKPCFPSSAGRIPNTPSIPVTKAQLRTFRAIIIDLTKIIPKLFANPSPQNIEDLIDTLNLLSKFICSLDAASSLKAQGLAIIKNLITILKNPTFVASAVFIELQNLINFLLSITKLFRIDPCTLQELLKLIAALQTALVNSASFIQGPTGPTGPAGATGATGPQGAQGNTGATGATGPQGAQGNTGATGATGPQGAQGNTGATGATGPQGAQGNTGATGATGPQGVQGNTGATGATGPQGAQGNTGATGATGPQGAQGNTGATGPQGAQGNTGATGPQGVQGNTGATGATGPQGAQGNTGATGATGPQGAQGNTGATGPQGAQGPAGVTGATGPQGAQGNTGATGPQGAQGPAGATGATGPQGAQGNTGATGPQGIQGNTGATGATGIGVTGPTGPSGGPPGPTGPQGNTGATGATGPQGVQGNTGATGATGPQGVQGPAGATGPQGAQGPAGATGATGPQGVQGNTGATGATGPQGAQGPAGATGATGPQGVQGNTGATGATGPQGVQGPAGATGPQGVQGPAGATGPQGAQGNTGATGATGPQGVQGPAGATGPQGVQGPAGATGATGPQGVQGNTGATGATGPQGVQGPAGATGATGPQGVQGPAGATGATGPQGVQGNTGATGATGPQGAQGNTGATGATGPQGVQGPAGATGPQGVQGPAGATGATGPQGVQGNTGATGATGPQGAQGTRRYWCHWTSRCSRTSRCYWCYWTSRCSRSCRCYWCHWTSRCSR

SEQ ID NO: 26585 - protein, 1018 aa, Bacillus cereus
  strain ZK / E33L
MNAKSSVNFARYGYICERYLIFSQYSIKSKNSKIMAWDTKKCKVGKSMKGYSKKMLVGVSFASLMLGSFQGGALAEGTKGEQVSYRNVLKMEPVGVQLPVQELAHSSKVLKNKSFEKRLQFADLSQRPPEVKKESKQLAVAKTYTIAELNQLSNQQLVDLLVTIDWEQITGLFQFNKDSLAFYQNDSRIQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDVNLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKAPVAVINGPYSGNVNEAISFKSDGSKDEDGKITSYKWEFGDGAVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGEFGNYTVEVK

SEQ ID NO: 26586 - protein, 372 aa, Bacillus cereus
  strain ZK / E33L
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNDLKEVKKQVDEKLAELKKAKQTAEDKLAELKENKPNTGNTLEELKKIKSNLDSLSANLELAKQDVKNKLAALQEARQDLINKINEIKQSKQTVSNDLSKKKQDLDIKINDFKHTEKKIDDKLAEIHTTKQNVDNKINEVSQSKQTETKTGTTNANNNARELPNAGSEQSNNMALGMLSVLGSVLLVARNKIKTLFSK

SEQ ID NO: 26587 - protein, 455 aa, Bacillus cereus
  strain ZK / E33L
MKNQFLKQLQNMKMNKKSLGAVALTAGIIGTTLIPQNAYAHGFVEKPSSRSALCSPTYGALNVNCGSVMYEPQSLEAPKGFPQGGPVDGQIASAGGKFGGILDQQTADRWFKNTITGGENTFTWKYTAPHLTSKWHYYITKKGWNPNKALTRADLEPIGTVQHDGSAASNHLTHKINVPTDRSGYHVILAVWDVADTANAFYNVIDVNLINDVKPDREAPSIPNRIQAQKVTANSIELAWNASTDNVGVKGYQIFRNGEMIDTVPGTHFIDKKLQPSTEYSYTVKAIDAAGNVSKESATLTVKTTVEVPDTEAPTQPKGLHSMGTTASSVDLMWSPSDDNIGVDHYDIYRETKGSMEKIATSNTTSYMDKYLLSNTTYKYVVKAVDVAGNESVQSDIFIITTKTESVSYEEWDAKKAYEKGDRVLHEGKVYEAVQSYKGNGDPNWIYALSLWKTV

SEQ ID NO: 26588 - protein, 412 aa, Bacillus cereus
  strain ZK / E33L
MKKAKEIAKSVAVASVIMSGSLGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKAPKEQMIGINNVNNQLNKGKGKLSFSMNGNQLKATSSNAGYGISYEDKNWGIFVNGEKVYTFNEKTTVGNISNDINKLNIKGPYIEIKKI

SEQ ID NO: 26589 - protein, 286 aa, Bacillus cereus
  strain ZK / E33L
MKQNDKLWLNKGIIGPENIGPTFPVLPPIHIPTGTTGVTGATGITGATGPTGTTGVTGATGITGVTGATGITGVTGATGITGVTGATGITGVTGATGITGVTGATGITGVTGATGITGVTGATGITGVTGATGITGVTGATGTTGVTGATGITGVTGATGITGVTGATGITGATGPTGTTGVTGATGITGVTGPTGVIGPITTTNLLFYTFADGEKLIYTDSDGLAQYGTTHILSPDEVSYINLFINGILQPQPLSNKVSTGQLTLLDNQPPPQGSSIILQFIIIN

SEQ ID NO: 26590 - protein, 503 aa, Bacillus cereus
  strain ZK / E33L
MFNKKMVAMAMTVPLVMGTISTVSALEKQQQVKLEAYSPQKKATEYLKENAAQYGLKPDLSDLQYISTTETSVASYVRFQQVVNGAPVFSKQITVTLNGEGKGVLAVSDYQSVKGVKEVTKKITEKDAIQKSMAYVGEASEQNLWAPTEKEFGYIVEEGIARPVYKVVVHSNNPFGAWETFIDAENGKLIKKVDINRKAEGSGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDNNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26591 - protein, 336 aa, Bacillus cereus
  strain ZK / E33L
MKRSKTYLKCLALSAVFASSALVLSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQIAYTKHADDYQLRPGYTFGTANWVGNNVKDVDQKTFNKSFTLDWKNKKLVEKK

SEQ ID NO: 26592 - protein, 123 aa, Bacillus cereus
  strain ZK / E33L
MSRLEQGILLVGESVKGGYYLSAVHSAYLNDSNDSVVVNVSVKNIRGQTIGLSELKYNLKDEKDGKVLDQNPSDIQVKPNETVELKIAFEVPSTADEYMFYIESSLDPLGAHWKIDKLQSQKN

SEQ ID NO: 26593 - protein, 913 aa, Bacillus cereus
  strain ZK / E33L
MNFLRKSFNQKIKKISSSFIVVLLVCMNFLIHLPNKAEAATTELKGLGDVSYYNAVIFGDHSATSADIEGAMAIQKNMNASSYTVLAAATGAHNLAGATWVEEGYPSLLLGGQFTKAGTGQVIIQDGTVAMTKDGDLEGAMKSSYDRISYKEQAEIDAKFKEFRKDVNSVIEDAGQLHTDKPKTGMTFGIGEDVNNPNIYVSSGQNGKKEFEVKDVFLPNVDNKDFIVIYSDAEEVSFGGGAILYDTTDKGEFTLVNTSQVYDPNSFFTELASKVIWVFPNATKLTTEGYGVVGSVFAPNAVVDTKGGSINGQVFLGGLHQRDGFEVHNFKFNWPKWNKPSVEKVTGQFEIEKVDASDETKLLSGAEFEVYKDGKQIDTLRTDKTGKVISKKLEPGKYTLKETKAPEGYKLLKEEIEVNVEENKVVSVIVKNVKELGSLQVIKKDAESKNVLEGAEFRLKNENGQIVGGIKTTNKDGVVTFENLVPGKYTLEETKAPEGYKVKEVKVEVNVIANEVVKREVLNEKEPSKGPENPGEETENPGEETEKPSEETEKPGEETEKPGEETEKPGEETEEPGEETEKPGEETEKPGEETEKPGEETEKPGEETEKPGEETEKPGEETEKPGEETEKPGEETEKPGEETEKPGEETEKPGEETEKPGEETEKPGEETEKPGEETEKPGEETEKPGEETGKPGEETEKPGEETEKPGEETEKPGEETGKPGEETGKPGEEIEKPGEETGTSGEETEKPGGETGKPGEETGKPGEEIEKPGEETGTSGEETEKPGGETGKPGEETGKPGEEIEKPGEETGTSGEETEKPGGETGKPGEEIEKPGEETGTSGEETEKPGGETGTPSEGMENVDKENPTLPEKGQGASHAQLPATGHDMNYLPFIGLALVLLGIRLRFMIKNS

SEQ ID NO: 26594 - protein, 378 aa, Bacillus cereus
  strain ZK / E33L
MPNVLLLDTFSFGLIRTEIVKDLKKVKSHNRVFDLFITIHMEVWNVKGKLLKGVLSFGIGLGVLYGGSSAQADTSTDQNNTLKVMTHNVYMLSTNLYPNWGQSERADLIGAADYIKNQDIVILNEVFDNSASDRLLGNLKKEYPNQTAVLGRSNGNEWDKTLGSYSSSTPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 26595 - protein, 965 aa, Bacillus cereus
  strain ZK / E33L
MNKKSKINKVMLSISTMALSLGALQAPVSAEEKVPYNVLKTKPVGIEKPVDEIGHVSKAEETLSFQERLKVGDFSQRPASITNKATVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGATRTNNVVPRKSIISGLSSDPASRYTAERTLFAKYGSWDFYNYSFALQSYLYTHQFETFDKIQDLIRANDVKNYDAYRENLSKDLKLNEEYQEYMQHLIDNQDKYNVPEVADDYLAEHAPKSLTAVEKEITETLPMKDAKMTKHSSQFFNTFTLEGTYTGSVTKGESEDWNAMSKKVNEALEQLAQKEWSGYKTVTAYFVNYRVNSSNQFEYDVVFHGIAKDDEENKAPTVNINGPYNGLVKEGIQFKSDGSKDEDGKIVSYLWDFGDGSTSAEVNPVHVYESEGSYKVALIVKDDKGKESKSEITVTVKGGSLTESEPNNRPEEANRIGLNTTIKGSLIGGDHTDVYTFNVASAKNIDISVLNEYGIGMTWVLHHESDMQNYAAYGQANGNHIEANFNAKPGKYYLYVYKYDNGDGTYELSVK

SEQ ID NO: 26596 - protein, 372 aa, Bacillus cereus 03BB108
MKTKQTIAASTLALAMMAGASSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDELSKKKQDLDIKINDFKHTEKKIDDKLAEIHTTKQNVDNKINEVSQSKQTETKTGTTNANNNARELPNAGSEQSNNMALGMLSVLGGILLVTRNKIKTLFSK

SEQ ID NO: 26597 - protein, 279 aa, Bacillus cereus 03BB108
MNEKYIILYGTALEPNLIGPTLPPIPPFTFPTGPTGITGPTGIGITGPTGVTGPTGIGITGPTGVTGPTGIGITGPTGVTGPTGIGITGPTGVTGPTGIGITGPTGVTGPTGIGITGPTGITGPTGIGITGPTGITGPTGATGLGILPVFGTITSEVGIGFSAIVNTNVNFTIPGPASGTTLNPLNNSVTIDTTGVYSVSFSIVFVIQAISSSILNLTINDSIQFAIETRVGGGPGVSATSARTDLLPLTQGDVLRVRIREATGDIIYSNASLVILKVD

SEQ ID NO: 26598 - protein, 971 aa, Bacillus cereus 03BB108
MKGYSKKVLVGVSFASLMLGSFQGGALAEGTKGEQVSYRNVLKMEPVGVQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTWVDNLSAGNAIYDIMQGVDYDIQSYLHDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVLDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKAPVAVINGPYSGNVNEAISFKSDGSKDEDGKITSYKWEFGDGAVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 26599 - protein, 412 aa, Bacillus cereus 03BB108; identical to SEQ ID NO: 26409

SEQ ID NO: 26600 - protein, 455 aa, Bacillus cereus 03BB108; identical to SEQ ID NO: 26414

SEQ ID NO: 26601 - protein, 748 aa, Bacillus cereus 03BB108
MEGNGGKSKIKSSLNSNFKILSDLVGPTFPPVPTGMTGITGSTGATGSTGPTGSTGVTGSTGPTGETGVTGSTGGTGNTGSTGETGPTGSTGPTGETGATGSTGATGNTGATGSMGPTGSTGVTGNTGSTGSTGVTGSTGPTGETGVTGSTGPTGETGVTGSTGPTGETGVTGSTGPTGETGVTGSTGPTGETGVTGSTGPTGETGVTGSTGPTGETGPTGSTGETGATGNTGPTGETGSTGTTGPTGETGATGSTGATGSTGPTGSTGETGATGSTGVTGNTGPTGSTGETGATGSTGVTGSTGATGSTGATGSTGVTGSTGATGNTGATGETGPTGSTGATGNTGATGETGATGSTGVTGSTGPTGETGPTGSTGVTGNTGLTGSTGVTGSTGPTGSTGPTGETGSTGSTGAPGNTGATGSTGVTGNTGSTGSTGVTGSTGPTGSTGPTGNTGPTGETGATGSTGVTGSTGVTGNTGVTGETGPTGSTGVTGSTGATGSTGVTGNTGATGNTGATGSTGVTGNTGATGETGPTGSTGATGNTGATGETGPTGSIGATGNTGATGNTGETGVTGPTGSTGVTGSTGPTGSTGTTGNTGVTGDTGPTGATGVSTTATYAFANNTSGSVISVLLGGTNISLPNNQNIGPGITVSGGSTVFTVANAGNYYIAYTINLTAGLLVSSRITVNGSPLAGTINSPTVATGSFSATIIASLPAGAAVSLQLFGVVALATLSTVTPGATLTIIRLS

SEQ ID NO: 26602 - protein, 160 aa, Bacillus cereus 03BB108; identical to SEQ ID NO: 26412

SEQ ID NO: 26603 - protein, 178 aa, Bacillus cereus 03BB108
MGKIFKFGCLGFIGLIVLGIIAASLGGGDDKKEQSSTGTKQETTAPVAKEGESSKVKIAVGSVESVDSVGGEYLKEKAQGVFKVVEVTVTNNQKDAITVDANSFKLVDNKDREFTYSTQAQTAFDVGNGGQSDFFLKQLNPGLSQTGKIIFDVPADAQGLVLKARGGMTGKEIKLKVE

SEQ ID NO: 26604 - protein, 1871 aa, Bacillus cereus 03BB108
MQMKSTKRHISMVSLVFLVLFSVLNVWAPVIQAAVMKSPVDEINISRTDGTTSEPYQASDGMKVEVKWSAKEKIKSGDQFTIDMPKEFRKDLMNMSFPLKDAEGKTVGTCEMKKGLLTCTMGDYVEGKNNIKGSLFVEFYFGLEAYDGVKEIPLEFNVDGQIVNKEVNVSNTTERPKPQPNTDNLLKWGSYNQEDPSIADWLVYVNATGTEMQDLKLTDTLGPGHELITDSVVLEEAVFEDGYAPTNIKPADLSNIKINATKVGFTIEFPDSSKGYILRYKTKITNPAAKPHKNTVKLEGKNIKTEEKVGQVFVSGGGGTGSGDDNPPSIEKNIVDENGKLVENEQLTQMDQVIQYQVGTHIPNDPPKYTSMVISDDLEDVLEVLEARVYDQNGQDITSKGTLNIDKQRSEVTFTFGENFDYKSYEDQIINLSIKAKIKNNADLSSYVDKKIPNKAELHFDDKTLTSKEVTITPPEAPKDGIVSLHKIDSENPNKGLKGAEFEVRNSANEVVAKLKTDEKGFSVPQTLAPGTYKVYEIVAPEGYQKLKEPVEVTLQAGETKTIEIKNTIQKGQIELKKIDSENGEKPLANAEFDIVKDGVVVEHIVTDKDGKAISKPLALGKYILKETKAPEGYQLKEKEFEVSVTGDGIFPITVENAMVDKGNVEITKVDKESGAVLAGVEFEVQNEKSEVVRKVTTDKDGKANVSDLSVGKYKLVETKSLPGYKKLTEPVPFEITKGMTKVLSLKVENELLDKGSVEITKVDKDSQKVLEGVVFEVQDENGKVVTEVKTDKDGKAKISDLSIGKYKLVETKSLPGYKKLTDPVSFEIKKGMTTVLSLKVENEQLDKGSVEITKVDKDSQKVLKGVIFEVQDEAGTVVKEVKTDKDGKAKISDLSVGKYKLVEKESLPGYKKLTDPVSFEITKGMTEILSLKIENEMVDTGNIEITKIDKDNKAPLAGVTFIVQDEKGNEVTKVTTDKAGKANVSDLPVGKYDLVEVESLPGYKKLEKPISFEIKKGMTEVLSLKVENEMVDTGNVEITKIDKDSKAPLENVVFEVRDSKGKVVAKVKTDKEGKANVSDLSIGKYELVEVETPAGYKPLEKPISFEIEKGRITALQLTVENELVDTGNVEITKVDKENKDVLADAVFEIQDEAGQVVAKITTDKKGQAQVTNLSVGTYKLVEVKAPKGYKQLVDPITFQIEKGMTKSLVLTVENEMLDKGNIEITKVDKDSQKALAGVVFEVQDEQGKVVTEVTTDKEGKVKVSDLSVGKYKLVEKAGLPGYKQLTEPVSFEIKKGMTKVLSLKVENELLDKGSVEITKVDKENGAVLAGVVFEVQDEKGKVVTKVTTDKEGKAKVSDLSVGKYKLVETESLPGYKKLTESVSFEIKKGMTEVLSLKVENEQLDKGSVEITKVDKDSQKALEGVVFEIQDEAGKVVTKVKTDKEGKAKISDLSVGKYKLVETESLPGYKKLTESVSFEIKKGMTEVLLLKVENEQLDKGSVEITKVDKDSQKALAGVVFEVQDEQGKVVTEVTTDKEGKAKVSDLSVGKYKLVETESLPGYKKLTESVSFEIKKGMTEVLSLKVENEQLDKGSVEITKVDKDSQKALEGVVFEIQDEAGKVVTKVKTDKEGKAKISDLSVGKYKLVETESLPGYKKLTESVSFEIKKGMTEVLLLKVENEQLDKGSVEITKMAAESKNVLSGAVFEVHDEKGKVVTKVTTDKEGKAKVSDLSVGHYTLVEVEAPKGYEKLTNPIPFEITKGMISPVQLQVLNKLTSLAPPGPEKPETTDPEKPETTDPEKPGTTDPEKLETTDPEKPGTTNPEKPETMNPEKPEKELPKTGQKMPVEPYMGALLIMMSFGLLVLGRKQQR

SEQ ID NO: 26605 - protein, 369 aa, Bacillus cereus 03BB108
MSSWRNNINGYCSCNNQNGVHVDSCCFSCDGTVPKLGPTGPTGATGATGPTGVTGATGVTGATGATGATGATGITGVTGATGATGATGATGATGATGITGVTGATGVTGATGATGATGATGITGATGPTGATGITGATGITGTTGATGATGATGATGATGATGATGATGATGATGATGATGATGATGITGATGATGATGATGATGATGATGITGPTGATGPTGEIGPTGVTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 26606 - protein, 3330 aa, Bacillus cereus 03BB108
MKKLFNICLIVFVLFSQFISFPYNQAKAETLQETSLFDTVEMKDGTDHIIDEAKNPNNLIKIGSTIQVEYAWSIKDQQVVHANDTAVIQIPLALKVSKDLQGDLVTDQKNIGQYFITAKDNKLKLIFNDQVENSKDAKGKIKIDTVFNPTLKAEEKSVQIAFPLGTLVQPITVPIQLEDSKEDGTKQDTNKQVPDQVAKPATDNPEQNPATKPATDNPEQNPATRPVTDNPEQNSATKPATDNPEQNPATKPATDNPEQTPATKPAADNPEQNLASDPAESTNSGPKQITTNILTGVKLTDKDGKPFTEDNRPSTDSPANIEFTWELLKSMNVKSGDYYIFDLPKHFKIYNTINSPLYDSENNPIGNFTVTKDGKVTMTFNDYVEEHPDVVGNLQLKTEFNKAEIKGTTTQEIPFPIKDKDVSITVDFKPNIQTTTNKKGLPDRPINTNEINWTVEMNKTKDTLKNAVFKDNIPQGTSLNKDSIKVYYLEVDVNGNATRGKEADPADYKIISSDGSKLEIAFKDSIKEAYQIEYVTKITDENVKNFQNNVTITSDNQGQQKASSTVTVSRGTHLNKTSKYDPKTQTIEWTITYNGDQRNIKKTDALLKDIFDDTHELDVNSIVVKNASYDDKGRLVTGDAVNNYTVSNKKNGFDLQFNEDINSAYVITYKTKPTNNVIKDGKIKNIVTADNGSSKENEAGFQQQNIIKSNNKAETNYKDKTTTWTITVNNNNYPLNNAIITDTFDHGGLQLKDKKLEIKDGDYTLQAGTDYVLDVTDKGFKITLIGTYQSNMTKTLVVKYTTDFDYTKLESGKTSFKNTGNLSWIDTDSNPQSNKVEANFDPDNFTKANGYKYGSYNAQTKEITWVIGFNYNNVEIKDPYVIDVIQDKQKLVPGSIEVRDMILNGSPDNAQPGNAVPTEKYELEEPTEKNKNTLKVHFKQSINSPYYIIFKTSLDGELIQGTYKNEAELKDGSKIVNTLKGDAQVKKGGSFVTKKAVQDDNYINWSIAINESQSTIADAVVTDDPTDNQVLVEDSFHLYPTTVDYYGNVTKDTANELKQGTDYKLKITTDNNTGKQHFEIAFLKKIDRAYILEYRSLINADDKEKVSNKAKIAGNQLTVKNTETTETIEVRMSSGSGGGSATKGRGNLEIIKVDNDNKNTLLTGAEFTLYDRTGKTVIRKITTDKDGIAKFNNLKRDKYLLKETKAPEGYVISWDLKQGKIVELGTQETTTYKLANKKFVGKVVLTKSDDLNKNVTLQGAVFTLLDKDKKIISEHEKLTTNNKGQITVEHLKPGTYYLKETKAPEHYKLDDRLIEVKIAEDQTTVINRTATNSLIPGSAILTKVDKDGKTLAGAEFSVRDRKNKIIPGYGKLTTNDQGQIEATNLRPGDYQFVEEKAPKDYDIDKTPIEFTIVKSQKKAVTVTATNHLIKGGVTLTKTDDIDGTALAGAIFKIVDANDEKKVIRENVKTGADGKVTVKDLEPGTYKFIETEAPKDYVLNTNPIEFTIDKSQQSFATVTATNSLKTGEVELLKVDEFGDKKPLKGAVFKIVDVNNNDVRTDLTTDADGKTKADKLRPGTYKFIETAAPEHYVLRAEPIEFTIDRSQKETLLVKAENALKPGDVELTKVDDIDGTALAGAVFKIVDANDEKKVIRENVKTGADGKAIATGLRPGDYKFIEVTAPKYYDKNTNPIEFTIKESQGTSPITVTAKNSLTKGGIELTKVNAADEKETLEGAVFKIVNRDTNEDARTNLVTNSEGKLIVDDLRPGNYKLIETKAPTYYDVNVEPIEFTIEKGQQTLLPLTFKNSLTKGKVKLIKEDDVKSSIALAGAVFTLQDANGTEIAKDLKTDEHGVLVIPDLAPGDYQFIETAAPEHYKLDQTPIKFTIKKGSKEDLPVPVTVKNSLLTGGVTLTKVDDVDGTTLEGAEFIIVDAHDTEKVVRKGLTTDEHGKVSASDLRPGDYQFIEVKAPKDYTLGNDPIPFTIGKSQKENITVTATNSLKKGAVTLTKIDDIDRTMLKGAIFKIVDMDGNEVRTNLVTNKNGKIYVPDLRPGDYQFIETKAPEHYVLDETPIPFTIERNQTKEINVTGKNTLKKGSVELTKIDDIDTDTKLANAVFNLLDADGEIVEEGLKTNAEGKIVVENLRPGTYQFVETIAPEHYDLNKTPIEFTIKKSQTETLHVTAKNALTKGAVELSKVDDIDGTKLEGAVFNIVDMKGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKRPIVVTVEKSQKNIATVTMKNSLTKGGVELSKVDDVDGTTLEGAVFNIVDMKGTVIRENLTTNSQGKISVSNLRPGDYQFVETKAPKHYDLNKEPIPFTIEKGQAEPISVTAKNSLTKGAVELSKVDDIDGTALEGAVFKIVDMNGNDVRTGITTDAKGKISISDLHPGDYQFIETTAPKHYKLDATPIKFTIEKSQAEKLQVTAKNSLIEGAVELIKVDDINPDTKLSDAVFTIIDAKGQVVRTNLTTDKDGKVSASNLRPGDYQFVETKAPKDYDLNKTPIPFTIEKSQPTHVSVTAKNGLTKGGVELTKVDSLDTKETLEGAVFKITDMNGNDIRTNLVTNKDGKIIAKDLQPGDYQFIETKAPKHYDLNEDPIKFTIERSQTKHVFVTATNSLTKGSVELIKVDDVEENTTLEGAVFKIVNKDGHDVRTDLTTDKNGRLVVDELPPGDYEFIETKAPTHYDLNETPIKFTVKKGQEKIASVTATNSLTKGAVELSKVDDVDGSALKDAVFKIVDMNGNNVRSNLTTNKDGKISVSDLRPGDYQFIETKAPTHYDLNQTPINFTVEKSQTTTASVTAKNSLTKGAVELTKVDDIDGATLEGAVFKIVDQNGLDVRTDLTTDKDGKISVSDLRPGDYQFVETKAPTHYDLNQNPINFTVEKSQTTTASVTAKNSLTKGAVELTKVDDIDGATLEGAVFKIVDMNGNDVRSDLTTNKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPETHGKETSEELENGNPETHGKETSEELENGNPKTQTNKQQDDQNKGKELPNTGHKKDSTQTVGILLLLAGLLSILATKRKKYY

SEQ ID NO: 26607 - protein, 564 aa, Bacillus cereus 03BB108; identical to SEQ ID NO: 26416

SEQ ID NO: 26608 - protein, 431 aa, Bacillus cereus 03BB108; identical to SEQ ID NO: 26106

SEQ ID NO: 26609 - protein, 503 aa, Bacillus cereus 03BB108
MFNKKMVAMAMTVPLVMGTISTVSALEKQQQVKLEAYSPQKKATEYLKENAAQYGLKTDLSDLQYISTTETPVASYVRFQQVVNGAPVFSNQITVTLNGEGKGVLAVSDYQPIKAVKQVTEKISEKDAIQKSMAYVGEASEQNLWAPTEKEFGYIVEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFKNINNRSIKVNVNGTTADNSFYSPSTKALTFGTGGVDDAEDAGIIAHEYGHSIQDNQVPGFGSSLEGGAMGEGFGDFLGATYEDAVSTTGYGKACVGEWDAAAYSSSDPTCLRRLDTNKVYPKDIKNQVHADGEIWSQGQYEMAQAFGRDVATKIILQSHWSLTPNSKFSDGAKAIKQADALLYGGQHAADIDRIWAARGISTN

SEQ ID NO: 26610 - protein, 965 aa, Bacillus cereus 03BB108
MNKKSKINKVMLSISTMALSLGAIQTHVSAEEKVPYNVLHSKPVGIEKPVDEIGHVSKAEETLSFQERLKAGDFSQRPAPTMKKVAVKQVKESYSMADLNKMNDQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTTEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVTNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLAQKDWSGYKTVTAYFVNYRINSSNQFEYDVVFHGIAKDDEENKAPTVHINGPYNGLVKEGIQFKSDGSKDEDGKIVSYLWDFGDGSTSAEVNPVHVYEREGSYKVALIVKDDKGKESKSETTVTVKDGSLTELEPNNRPEEANRIGLNNTIKGSLIGGDHTDVYTFNVASAKNIDISVLNEYGIGMTWVLHHESDMQNYAAYGQANGNHIEANFNAKPGKYYLYVYKYDNGDGTYELSVK

SEQ ID NO: 26611 - protein, 781 aa, Bacillus cereus 03BB108
MTKSYNQKIKKLSSSFIVVLLVCMNFLIHLPNKAEAATTELKGLGDVSYYNAVIFGDHSATSADIEGAMAVQKNMNASSYTVLAAATGAHNLAGATWVEEGYPSLLLGGQFTKAGTGQVIIQDGTVAMTKDGDPEDAMKSSYDRISYKEQAEIDAKFKEFRKDVDSVIEDAGQLHTDKPKSGMTFGIGEDVNNPNIYVSSGQNGKKTFDVKDVFLPNVDNKDFIVIYSDAETVNFASGAILYDTKNTGMATDLINTSQAYDPNSSFTELASKVIWVFPNAKKITTKGYGVVGSVFAPNAVVETKGGSINGQAFVGGLHQRDGFEVHNFKFNWPKWKKPSVEKVTGQFEIVKVDASDETKLLSGAEFEVYKDGQQIDTLRTDKTGKVISKKLEPGKYTLKETKAPEGYKLLKEEIEVNVEENKVVPVTVRNVKELGSLQVIKKDAESRNVLEGAEFRLKNENGQIVREAKTTNKDGVVIFENLVPGKYTLEETKAPEGYKAIEVTVEVNVIANKVAKQEVLNEKETEKGPENPGGEIEKPGEETEKPGEETEKPGEETEKPGEETEKPGEETEKPGEETEKPGEETEKPGEETEKPGEETEKPGEETEKPGEETEKPGEETEKPGEETEKPGEETEKPGEETEKPGEETEKPGEETEKPGEETEKPGEETEKPGEETEKPGKETEKPGEETEKPGKETEKPGEETEKPGGETEKPGKETEKPGEGMENPDKEKENPTLPEKGQGTSHAQQLPATGHDMNYLPFIGFALVLLGIRLRFMTKNN

SEQ ID NO: 26612 - protein, 333 aa, Bacillus cereus 03BB108
MKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVKKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 26613 - protein, 780 aa, Bacillus cereus 03BB108
MKKSKKMLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTTPPTGEGDNGENPTTPPTGEGNNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 26614 - protein, 305 aa, Bacillus cereus 03BB108
MNIKQSFKLLAMFLSILFVLFPLQKAFAEVMDHTKYQMDWSYSKSKKKPIRTELIKTADGKIAFCLNVDLKSPSGQDLPEMGKVDINVYRVLLNGYPQKSPQELGVSDWREAHYATQLAVWNALKQIDINDLDFRNKNVEKVTKDIVAKASASEELQEITMSVVPSEEQQAVLKNDFFETGLYTVETNAKSGTYKVQATGAPAGVKFVNEKGEAKTEFNVGEKFRILIPKQTPAGGFSFKVLGNLTKLQGIAHKGTPTIQNAVVLLERSEEKTSPELSVSWKTTNGHDNNKPHTPNEPHKPNQKR

SEQ ID NO: 26615 - protein, 187 aa, Bacillus cereus 03BB108
MEVEKKSKIWEYIGWGSFILVGSFLFFCALILVFGDPKTKYQAQEVTAQGHEVKDAEKDVKKEYSVGETIKLGDHRLTVTDVKKSSGGEYDKPKQGHEYVLVAVNIYNGGKEDISYNPFDFEMRNSQGNITRAVPSIINQNTQLSAGQLAPNGQVAGTVVFEQPIGEKLKLQFTPNFWSKKKIIVNL

SEQ ID NO: 26616 - protein, 234 aa, Bacillus cereus 03BB108
METLAVLIFLASIVLFVLFIIAIFKKKPKAKLFISSIVCLVLAMVLIPTKDKEEKPKAKETTQQASKEVKEEPKKEEVKKEEPKKKEEPKKEEPKKEEPKKELSKEGESSKVKIAVGSVETVSSVGGEYLNEKAQGVFKVVEISITNNQKDAITVDANSFKLMDNQDREFKYSTQAQTAYDIGNGGKSDFFLNQLNPGLTQTGKIIFDIPADAQGLVLKARGGMMGKEIKLKVE

SEQ ID NO: 26617 - protein, 910 aa, Bacillus cereus 03BB108
MRKSTLTKFLTLVSVFVLFFSMFLPKAYAEVMTHEKYSMNWSYSNQLGKYIRTEMIKNSSGQIAYCLTLGLKSPNGEDLPEMGKTDNVVYRVLLNGFPQKSVEQLGVANQNEAHYATQLAVWNALGQLDVNELKHANKNVEKAAKAIINAANNSEDTQDIYMNVIPAEKQKAELKGEFFETNLYTVQTNAKSGSYKVVAKNAPNGVKIVSENGEVKEQLSVGEKFRIQIPKNTKTGEFNLSVAANLTKVQAIAYRGTDTVQDATVLLERNEEKLSSDLAVNWEAAGSMKIKKVGENGEVLAGAVFEVFNANNESVGKITTGADGMAELNNLPIGTYTVKEIKAPTGYVSGDKPQTIEVKTGETGTVQIVNNKVKGNIEIKKLSDSGKVLPKVEFTVFTEDGKEVKKVVTKENGIANVDGLTYGKYYFLETKTPNGYIGNKTKYPFEIKEHNKTLTFTVKNTEVKGSVKLLKVDNEDTSKKLEGAVFELKDASGKVIGEYKTDKNGEVNVKDLAYGKYSFVEKASPNGYVLVTEPITFEIKEHGKIIELLAVNHLIKGNLEITKVDVADGNNKLPNAEFTIYNEAGKEVIKGKTDDKGIAKFEKLPFGKYTYKETVAPNGYVISEETFPFEITKDGDIIKHIVENKKITGSLEITKVDVADGNNKLPGAEFTIYNEAGKEVVKGKTDKNGIAKFEKLPFGKYTYKETLAPNGYVVNEETFPFEITKDGDILKHIVENKKITGTLEITKVDVADGNNKLPGAEFTIYNEAGKEVVKGKTDENGIAKFEKLPFGKYKYKETIAPNGYLLNEETFEFEIKKDGDIIKHVVEDQKKPVAPGTTEKPKDNTPKEDQPTKVQEKEQPKEQVKEQPKKGSLFTWLPKTGGEPTNWISAIVGFVLLVAGGIFLVKRKNA

SEQ ID NO: 26618 - protein, 852 aa, Bacillus cereus 03BB108
MKQFIVRTTIPTFVIAMILGLSLPNTANALEYTLGSPHNEEDKFKETLKTKHYDEWKKSLTSSESDSLEAFNHSDINSLISEVNGNIEFINKEIHVNYGNKKGILDADSIRDTIQTLDKTLLKSKKIEGDIHVYKYLSDKDIDFKLGILYNQDMTSINRDKYHLISKNFKYGIFSGYLDPHLTKTEDRSKGPILLDIKIPKGTHVGYLDNDGHILLQRNQGLLISNSHIIVENGKERIKVEAQLIDKNTVMNNIKNKENTINKLFREAIEEGTSIHREMEITIENKLVNILTNSLNASVILNRTENLLYFLTKNIPSDLLIKTLEQMKHNAPITITDSNWDTVENELNIKMKDRPQNASVYYNSSTSQIILNLSHMEQQIDPIPDVQYGSLTSETDSKILLQQFGFAVNELLIKDTILSETEEFKKIYDEEKDHLNNLSKFTSTREFFADVFEKMYSSNQNERLKIEEKVPKSVEYIKGKIKLATSDKIDLDGINVDEGNVAVEGAGLVPEHVEKFKHVAKERNTFIFVRPVNKLATSLIKKGAATKGMNVHGKSSDWGPAAGYIPFDQDLSKKHGNKEAVEKGNTDNEESLQEHMNEISTVKLKLDNNRIEELKKEGLISIGEKETDNGKDYNVIKTENSIYDFRIDILNQEVQYKTKDGIHTILGKEFGWKDLEVMAKVINGDHKPLTADYDLFALSPKLTEIKKYIPTQEWEQAVINQKPLDKLKKITKLLIKYGFKREAFPGKGQMPNWQVDFIDALNIAAREAGYEGGTVVNHGTEQDNENFPEQDNEIFVITPNGKLILTKSWKDTRLFIEKNIVKNGNFFYFNRSYNKIAPGNHKQIEWTDPIGK

SEQ ID NO: 26619 - protein, 494 aa, Bacillus cereus 03BB108
MKRSLLKTTIPSIMMVTVFGFTLTNSVHAQENTLGIPQNESKEEKNKEIFKTARFDEWKKSLTPSETDALEVFKQTHINQFIWGVDGNIDFIKRDLYVNIGSKEEKLDADGIRNTIRSLDKALMKSKKIEEDIHVYKYLTEKDLDFRIGNLYSSSDLNTINKEKFKLISKNFKYGFYNSYIDPHLTKKKSVSKRWPILLDIKLPKGTHVGYLDNEGHILLQRNQGIIITNSSIIVEDGTERIKVEAELIDKKLMKNEIQAREDSFNDYFRQLIEKDTSIHRENEIPTETKLIKLVTNSLNASFTLNRAETLLHVLTQNIPSNLLIKTLEQMNPDKAITITDSSWNNLENELGEKFKDADDDTIAFFDHKTKELIVNLSLVDHHINSLQSIRDNKPALESDVQTLIHEFGHAVDDLILNDLSLTSEFNSLYEEEKENIKIEDYMTSDQREFFASAFSYIFSPNTLYQMRIKQEAPKTVAFIQKALEERGLLKKIN

SEQ ID NO: 26620 - protein, 263 aa, Bacillus cereus 03BB108
MKFINNKILTSTLASVVFLSVYPFSNPSQAWAASSDEIISNHIDNLIDFEGEHEKAKGWGEKKYKEWKERLTSEEKESIEYYTDFDYLEINQYLREVKGKLKTSDLNNTIKHIDSALKKGRISEPITVYRRAKGFSLGINNGLLVDWKNPNKIIKENISKISEMLIGKTKTEYGYISTSLSQDAASNFSKLPILLKIHLPVGTEAAYLGNLSTNPGENEVLIGRGFTYQIEKASIIELEGREYLEIEAKGKKDRKSWKYYMIS

SEQ ID NO: 26621 - protein, 478 aa, Bacillus cereus 03BB108
MKYSLTRTIIPAFAITTALGLLPIHTVNAQETLPGSTHNDSKEEEFKETLITKDYDEWRKSLTYDENLIFSLFDVLQLNSLIKEVNGNIDIINSNELDQFDKRKSILALDALLMKKKIDMDIHVYKHLTAEEVGFKLSELCLPYESTINRNAFKNISENFKYGIYVGYLDPHLTKKESKSNGPILLDLKLPKGTHIGYLDTNGRILLPRDRGIIITNSSIILEKGKEKIKVEAELVDKNTVTTKIESKENTINKHFRTAIENNTSIPGKNKIPVETKFIKIVTNNLNASFAVNKAATLLHIFTKSVPGDLLVKTLEQMNSNAALTITDIPWRKLGGVINQDIQGISDSSFASYNVNSKQIVLNLSTHKQLLYSLQPIGDDDSAPETPIQTLIHEFGHAVDILILNKLSTTSEFEDLYKEEKNNIKIEDYMKKNPQEFFASAFSYLFSPNTHYQERIKKEAPKTVEFIQNELKKKGLLN

SEQ ID NO: 26622 - protein, 491 aa, Bacillus cereus 03BB108
MKYFLSRTTISAFVITMILGLSPMNTVNAQENSSGMPHNESKEKNKEIIKTEQFDKWKKSLTPSEEDALEGFKYSKINELIKKVDGNIDFIKGDLYVNVGNTYKLLGVDGIREVIRNLDTALMKSKKIEKDIHVYRYLTEADVDFRIGDLSTSFHQSTINRDKYKLISQNFKYGFYNDYLDAYLTEEEGLSKSEILLDLKLPKGTHVGFLNNKDHILLSRNQGILVTNSSIIVINGKEKIKVEAELIDKNLIKNKIQTKEDRLNDYFRKIIEKDTSIHRENEIPTETKLIELVTNSLNASFTVNRAETLLHTLTQNIPSDLLLKTLEQMNHRAAITITDSSWENLESELGQSFSDLNENALAFYDHKTKELIVNLSIHDHEINPFKLIRDDHSAFDTDVQTLIHEFGHAVDDLILNDLSQTSEFMDLYQEEKGNIKIEQYMTSDQEEFFASAFSYIFSPNTQYQMRIKQEAPKTVAFIQKALEEKGLYKKN

SEQ ID NO: 26623 - protein, 498 aa, Bacillus cereus 03BB108
MFLTKLEEWRNQMNNKIKCKKNAFVFFTFFSMFLFYPIHSSAITEGIDFYPIDGVMDFEHKTENVKEWGEIQYNRWINTLNKEEIESLEVLNSSSKDGNYDINRTLKGLGGNLDRRPIDSELKEKNEKYKKDVKNIERALSREGSKLNEGLYVYKSISLADFIDIEDKHLTNIDGTINREKFQELKKHLLFSKNQEFTIVDLTETQEKKSGLLKWRIKLPKGVSVGHINKNQLILDRNIGLKILNSRIVRQEGKECIRIEATLIPKERIDKIIEINEIKLNNDFNSLLKFPLNSKMIEFRLHNLASSVISSQGIELLRDLGDQIDKDVLNRIINFMLEKNGKIIIADITPAAIIEAFAPKQPLVDTLLPYATAGGIYNPDNRTIVINALHSFQEGTQLNSGDLIHEFGHALDYYIGELIFSGKSVAMSESLGFEQIYAIEKNNLTDYAKTNSREFWAEAFQLMHSKKPEDIKMVKEKAPQTYKFINDILKVVKTMPLK

SEQ ID NO: 26624 - protein, 976 aa, Bacillus cereus 03BB108
MNIKSVYKCIATTVLLSQIMSPSILHAQEVSDKAESGVVTQPENKRTGLMGYYYNDSNFSELVMMTPEKNGELKIIKEDHGELLPEGKRNIQSIRWIGYIKPSEDGEYIFSTSSDQNIVMQIDGKTVINQSPMENKIELDKDKLYEIRLEYRQDENGKHQNLSDLKLFWSRTNSDKIVIPEENLVLPNFAPGENKTKLIPETHSFDDNSIPDTADLCLDTDDDSIPDYWETNGFTIKGNKFVEWTDDLAKKGYIKYVSNPMTAYTTGDPYTDFEKSAGQMPAAVAKEAHNPLVAAFPAVGVKMEKMIISENKDYTNAEEHAMSSNQSSGTTVGTEVHVGVSENYGITGGVSASFSHSNTTENTISKSNGNTIHLNEADAAFTNLNVRYYNSGTAPIYRVAPTTSFVLGGETIGSFTAQANQIGNDLNPGDTYPNKELHALSLNTMDQFNAQPIKMNRQQLERLRAGAPVKLETPQVAGKYAKVLSNGDISVAGDWAPKLGQIENKTADIILNTGDTVKEEKVAAREYNNPEDKTPELTLADALKLAFGAKEENGKLTFNGHNISEHSVELFYDENTKKEMKKQLEKMSNKNMYDIKLTPKMKIVIKTPTILESGTDSNIDWETTNTNQPGLDDVGYSTANIGYGILKSKLEPNTSYVLSAYFKGTKHEKEIEFGIGSGKGDYAVNQKFELSQGGNWKKVELKFTTGDDVSKFNTVRVKNDRNDETRQVYFDNIAITKLGKAEKKFDGVSEDYIKEAHTFKSVHSDKKNGTNYINSINLNVNKPIKWKYKVKMNGKEVGDLKNISEPDANGVIKINFLDLNNGSGFLSTDHIEVYAVKEGLRPVKIAENHKYNMEAILKFKNAGESGMIEPYGDIRFINNGEVFEIWKDAIENSSREYTQDQPYKKDITFRTFTPITEESNIRFIANVKEEDYLANQDDILAYGENDPKDSKGLNGNIYFTGDVADDSVNIEYKITK

SEQ ID NO: 26625 - protein, 268 aa, Bacillus cereus 03BB108
MIKGKISRIVLVAVTFFCMFAFASPVQIWAADSDEIVSNDIDSLIDFEGNLEEAGKWGENKYKEWQESLTLYEKDLIKLYTDNMFLKLNAYLRETKGILKDTPLYDKKNEVVKVMDKVLKKTKTETPIIVYRKVEDKEFGIDVIETEMLKLAETMAKDNEDLPHEIYNKLYISEIKEKLKGKVITNYGYTSTSLGTGFYSKAFRDHNIIMKIKLPEGTHVAYVAQLSRYSGEYEMLVARGFKYKIEDIYWTVREGIRMLEIVATGIKK

SEQ ID NO: 26626 - protein, 249 aa, Bacillus cereus 03BB108
MIFLKVFSISGGLISICTPTYADGENSVIHVQSRDVKAFKDREKAEAWGRERYAGWYNNLTIVEQKSLTDYTTEKGYQINKYLRQNKGNINIPENSFLNRNIINLDSAIEKAKMKESIKVYRRVGENAFGMEADSLRNKNTINREKYRELAERFMNKEIKEYGYLSTTLVRGISDEAKIKSPEIALMPIILELNIPKGTKAAYINDLSDKPWELELLVGRGSTFKIHGMSIIVENGRERLKVTADLLKK

SEQ ID NO: 26627 - protein, 163 aa, Bacillus cereus 172560W
MLKKVSRIFLISGIAFSLSACTETKDSNESKQEDVQDKVYKIGETVDVDGLQVTIDSVKLGYPNYDEDKKKEEILGIIFKVENNSEKEMPFAFYEFEITDKKGTRFKEYNNPDSFISKKLAPEEKIQDIMLFDVAKENTYIATYRPEFTHENRTIKFELKPNK

SEQ ID NO: 26628 - protein, 72 aa, Bacillus cereus 172560W
MDQEPKGNNQVVENEGRKADTLNKQHTNKPEEGKKFLPSTGGEASTSTLLSGITLVLSALSMFVFRKRLFKK

SEQ ID NO: 26629 - protein, 956 aa, Bacillus cereus 172560W
MMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTVARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNKEYQEYMQQLIDNQDKYNVPEVADDYLAEHATKSLAAVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSAEVNPAHVYEREGSYKVSLRVKDDKGKESRSETTVTIKDGSLTESEPNNRPEEANRIGLNSTIKGSLIGGDHTDVYTFNVASAKDIDISVLNEYGIGMTWVLHHESDMQNYAAYGQANGNHIEAKMNAKPGKYYLYVYKYDNGDGTYKLSIK

SEQ ID NO: 26630 - protein, 176 aa, Bacillus cereus 172560W
MYKKLGTIALTGALAFSLSACGETEVKEVSKNDAPKQAEKKDKKEKAESKIYKIGDTVEVNGLQLTFSSAKFVEPNEYVKAEKGKVLEIAFNAKNNGKKDIYFGTSELKIADTNGNQFKEYFGGENTFINENIAPGNQITNKMLFDVPEGDKFVGTFKPTFTFDEKSVKFEFEVAK

SEQ ID NO: 26631 - protein, 333 aa, Bacillus cereus 172560W
MKGKLLKGVLSLGVGLGALYSGTSAQAEASTNQNDTLKVMTHNVYMLSTNLYPNWGQTERADLIGAADYIKNQDVIILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDHFVHVIGTHLQAEDSMCGKTSPASVRTDQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPQSPQWTVTSWFQKYTYNDYSDHYPVEATISMK

SEQ ID NO: 26632 - protein, 183 aa, Bacillus cereus 172560W
MRKLSILLTFILVLVSITAACTQDKTDSAVENGPIEEPTAKNENEELINFEEKEEISRLEQGILLVGESVKGGYYLTAVQSAYLNASNDSVIVNVSVKNVRGQTIGLSELKYNLKDEKDGKIYKGKVLDQNPSDIQVKPNETVELKIAFEVPRTADEYMFYIESSLDPLQTYWKIDKLQSQTN

SEQ ID NO: 26633 - protein, 336 aa, Bacillus cereus 172560W
MKRSKTYLKCLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKLFTLDWKNKKLVEKK

SEQ ID NO: 26634 - protein, 503 aa, Bacillus cereus 172560W
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26635 - protein, 893 aa, Bacillus cereus 172560W
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDIKFISEPEVKAVIFVDENHGQASNAYQVTFAATTPNYVSGTYLVNAHNGDMLKDMVQESSLKISEEYVESVKENKTSNFTSLTGTGKDDLGVTRTFGISKQTSGNYALADYTRGQGIETYDVNYRDITNEESYYPGILATSASTTFNDPKAVSAHFLATKVYDFYKEKYNRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDNYSKYNDLNGEDYGGVHFNSSIINKVAYLIAQGGTHNGVNVNGIGEDKMFGIFYYANTDELNMTSDFSELKLACLKVAANKYGTNSIEVQAVQNAFDAAKITGTVKENEKTAENQAPELTVPFTITLRVGDTFDPMRNVKAVDKEDGDLTNKVKHKGDVDTSKPGTYIVEYLVVDSQGGNATATQTVIVEGNGETSDLEPKLTVPVGATIHVGDSFVPMAEVLAIDKEDGDLTSKIKVDGEVDTNKAGTYVLKYTVTDSKGHEVTAKQTVTVKVREEVKNDKPILKVPATTSITEGDQFDPLVGVSATDKEDGDLTSKVAYEGTIDTNKAGIYEIIYSVRDSVGNEVNTIQKVLVKDKETSKPNGLANKANKSNISNNSNSDKKEYTYKELPKTGVSTTNSAAIGILMIITGTVLTFVRKFRKIQK

SEQ ID NO: 26636 - protein, 563 aa, Bacillus cereus 172560W
MIEVVKGIREMKKIFSVLLVLFLTFSTWSSVLVKADSSSKGTLTIHKYEQEKDGAQGLEGDGSANQEVPKDVKPLKGVTFEVKRVASFEKISNDGKIVKEDVKPVMGATPNQVVTDDNGQVVLKDLPLGRYEVKEVAGPPHVNLNPNTYTVDIPLTNKEGKVLNYDVHMYPKNEIKRGAVDLIKTGVNEKALAGAVFSLFKKDGTEVKKELATDANGHIRVQGLEYGEYYFQETKAPKGYVIDPTKREFFVKNSGTINEDGTITSGTVVKLEVKNYEEPTIDKKINGKLEALPINPLTNYHYDIKTLIPEDIKEYKKYVVTDTLDNRLVIQGKPIVKIDGAEVNASIVEVAIEGQKVTATVKDFTKLDGKKEFHLQIKSQVKEGVPSGSEILNTAKIDFTNKNDVIGEKESKPVVVIPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKSANN

SEQ ID NO: 26637 - protein, 455 aa, Bacillus cereus 172560W
MNNRFLKQLQNMKMNKKSLGIVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVPGTHFIDKKLQPSTEYSYTVKAIDAAGNVSTESTALTVKTTVETPDTEAPTQPKGLHSMGTTASSVDLMWSPSDDNIGVDHYDIYRETEGSMKKIATSNTTSYLDKNLLANTTYKYVVKAVDVAGNESVQSDIFTITTKTESASYEAWDAKKAYKKGDRVLYEGKVYEAVQSYQGNGDPNWIYALSLWKTV

SEQ ID NO: 26638 - protein, 878 aa, Bacillus cereus 172560W
MVKYSKISKWILGVGLVTITCNGLQIQAETKEKNVKNVLQMEPVGIQKSVDELAHPSKVQENESFTKRLKLADLSQRPLAPTDNIKPLAEEKKYSMAELNQLNNKQLTDLLVTIKWYQIPELFQFNSDSLKFYQDDSRMQAIINKLAEQGQAYTQDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDEYRATLSKDNKLNEEYQSYMQMLIDNRDKYTIPQVSDEYLTQHDPKSLSDVTSDITNEAKLKDVKVTKNKSQFFNTFTLQGTYTGSAAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 26639 - protein, 974 aa, Bacillus cereus 172560W
MLYFWVEYINGGNVMNKNLKFTQMMIGISTMALSFGSIQTQVSAEEKAPYNLLQMKPIGTETSKDEMAHATKADETLNFEERLKVGDFSQRPTSVMKHDERQLKQSYTLAELNKMSDSEFIDTLSRVSWNQITDLFQFNQDTKAFYQNKERMNVIIDELGQRGTSFTKEDSKGIETFVEVLRSAFYVGYFNNEVGYLNERSFHDKCLPALKAIAKNPNFTLGTAEQDRVVVAYGKLISNASSDAETVQYAANILKQFNDNLSMYAKNYTKEQAVYEIVKGIDYDLQSYLQETNKKPNATMWYGKIDNFINEISRIALIRNLTTENSWLINNGIYYAGRLGKFHSNSNKGLEVITQAMNIYPRLSGPYFIAVEQIKTNYGGKDYDGNTVDLQKIREEGKLQYLPKTYTFDDGSIVFKTGDKVTEEKIKRLYWAAKEVKAQYHRVIGNDKALEPGNADDVLTVVIYNNPDDYQLNRQLYGYETNNGGIYIEEKGTFFTYERTPKQSIYSLEELFRHEFTHYLQGRYEVPGLFGSGELYQNERLTWFQEGNAEFFAGSTRTNNVVPRKSIISGLSSDPASRYTAKQTLFAKYGSWDFYNYSFALQSYLYNHHFETFDKIQDLIRANDVKNYDAYREALSKDAQLNTEYQTYMQQLIDNQDKYNVPQVTNDYLIQHAPKPLAEVKKEIVDVTNIKDAKITKHESQFFNTFTVEGKYIGSTSKGESEDWKTMSKQVNQTLEQLSQTGWSGYKTVTAYFVNYRVNAANQFEYDIVFHGVATEEKEKTTTIVNMNGPYSGIVNEGIQFHSDGTESENGKIISYLWNFGDGTTSTEVSPTHVYGEKGAYTVELTVKDSRGKESKEQTKVTVKQDPQTGGSLEEEKVLPFNKLVKGNLIAPDQTDVYTFDVTVPKEVDISVVNEQNIGMTWVLYHESDMQNYVACGEDEGNAIKGKFVAKPGKYYLNVYKFDDNTGEYSLLIK

SEQ ID NO: 26640 - protein, 380 aa, Bacillus cereus 172560W
MHMKEKRYKNMKTKQTIAASTLALAMIAGANSAHAEVNDATPQQSTGDRLAEIKQHKQELDAKLQQHKENVDQTLNELNKVKENVDTKVNELHERKQVADEKINEVKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAVLQEARQDLINKINEIKQSKQTVSDDLSKKKQDLDIKINDFKHTEKKIDDKLAELHTTKQNVDNKINEVSQSKQTQADNGTKNNNAKELPNAGSEQSNNMALGMLSVLGGVLLLTRNKIKTLFSK

SEQ ID NO: 26641 - protein, 338 aa, Bacillus cereus 172560W
MTGCSSSQSSTTVKNGKASSSSKNVEVEVENAEYVLPLSGTMGGINKDTVLKFKVSLKNKGDEMLEISPYLFTLYQGDEKMKKYDKADSDKLRLIELEPGKKTSGILYYEVNKASSYELVYSNEETKKRDDETEKVSFKIDSQEIEKNTKDLNKPAEALKSYINAIYYDKDINKINKLSGEDGKQFTQNIQQEFKKDALSSTHNGISDQEFENYYKQLKSVLQEKVTFKVKSVGSSPEEDKVEVELKVKPLLLSELQPKLHKENERLLKENPGIEQPKLFSQSFGYFISILPEAKVSDKEKVIKVEMERYGKEQWRFSKDKVNDSEDVMEIMGEFLKQ

SEQ ID NO: 26642 - protein, 837 aa, Bacillus cereus 172560W
MLVKNQDKCSKFQAPIPFPPPGITGPTGPTGPTGALGGPTGPQGIQGVQGPIGPTGPQGIQGVQGVQGENGPTGPTGLTGPQGSQGNQGPMGERGPQGIQGVQGIQGERGPTGPTGIQGIQGIPGPIGPTGPTGIQGIQGMQGEIGPTGPTGVQGIQGVQGEIGPTGPTGNTGIQGVQGNLGGSGLQGVTGIQGIQGPIGPIGPTGSQGIQGEQGPMGPQGETGVQGLQGPQGEMGQVGPTGIQGIQGVQGVIGPTGPTGLQGDPGPTGPAGATGITGPTGSATGPTGATGPTGPPGGPTGPTGPAGSPGGPTGPTGATGATGATGATGATGIQGVQGIQGPTGATGVTGLQGVQGPMGATGPTGDQGIQGPQGIQGVTGPTGPQGLQGIQGPVGATGPTGPQGVQGAQGPIGPTGPQGIQGIQGEQGVRGATGPTGLQGLQGIQGSLGPTGPQGLQGVQGISGITGPTGPQGIQGIQGPQGDIGPTGATGIQGVQGPEGPTGPTGATGPQGIQGIQGIQGPTGPQGIQGLQGIQGPIGPTGPTGPQGIQGITGSTGPTGATGATGPTGVTGPQGPQGIQGPQGVTGPTGATGSTGVTGPQGIQGIQGSQGITGPTGATGVTGITGPQGIQGIQGPQGVTGATGATGATGVTGATGPTGIQGIQGITGATGGTGVTGPTGATGPTGLTGATGSSAISTGGGYFFSTSTSTIAASANIPINSGSTVYGTGVSLTSATTVTVTTPGIYLVSYYFQGDANGGNETVSVRLLLNGTQLTGSFIQNVTTSTVVIEPAISNTLLVNVTSANSTLILQNGPLGVGHVTTIAGAITASLNVVRIL

SEQ ID NO: 26643 - protein, 752 aa, Bacillus cereus 172560W
MALPLPLLGATGPTGNSGPIGPTGGHEGPVGPTGVTGPTGATGPQGPQGIRGIQGPRGTTGAQGIQGVIGDTGEQGITGPTGLQGAQGLIGNQGLIGDIGVKGLEGIQGATGPAGSQGIQGIQGIQGEIGERGQTGAQGMQGERGITGVSGITGPQGPQGVQGIQGEQGAIGIQGEDGFQGIQGITGEEGPQGAQGIQGEVGPTGSTGMQGAQGISGIKGITGVIGLQGPQGVQGIQGITGATGFQGIKGIRGITGATGSIGAQGSEGPPGGPTGVTGPIGPSSGVTGPAGPPGPPGGPTGPTGATGSTGVSGGIGPIGAQGVEGITGPTGSQGVRGAQGSQGVVGAVGVQGAQGPQGNQGITGPTGAEGSQGIQGPLGVTGPTGAEGPKGIQGIQGVIGPTGAQGMVGIQGIAGPVGVTGAEGAQGIQGIRGATGPAGAQGIQGVQGIQGETGAAGTQGPQGVQGIQGTTGLTGTQGAQGPQGVQGIIGPTGAIGLQGPQGLQGITGPTGAQGVQGIQGVQGIIGPTGAQGIRGPQGNTGEVGITGSQGVQGAQGSQGPQGPQGNVGITGATGETGATGATGATGLQGVQGVQGITGIQGITGTTGATGLPSGGGYFFSTSTSIIAANALIPINSGSTVFGSDVSLTNATTVTLSTPGIYLVSYYFQGDPTAGNETISVRLTLNGIQVAGSFIFYVTGGTFILEPAVSNTMVIEVTSSNATLSLQNGPLAIGHVTTLSGVITASLNVLKIV

SEQ ID NO: 26644 - protein, 1062 aa, Bacillus cereus 172560W
MTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKPQTIEVKTGETGAVQIVNNKVKGNIEIKKLSDSGKILPNVEFTVFTEDGKEVKKVVTKENGIANVEDLTYGKYYFLETKTPNGYIGNKTKYPFEIKEHNKTLNFTVENTEVKGSVKLLKVDNEDISKKLEGAAFELKDASGKVVGEYKTDKNGEINVKDLAYGKYSFVEKASPNGYVLVKEPIMFEIKEHGKVIELLAVNHLIKGDLEITKVDVADGNNKLSNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYNLKGKLMNKETNKPLVVNGKEVTVETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKALLIDGKEVTAETKFTAKEKNGFVTLDFTFVGAEQQGREVVVFEDLLHEGQVIATHADINDVGQTVRFVEPSIKTTATNKADGSKELDASKTVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEQPNSGKNTPTPEQPNEQVKEQPQLKKEIESKIGWLPQTGTNLTSWISMAAGALLLIVGGVIFLKRKNA

SEQ ID NO: 26645 - protein, 971 aa, Bacillus cereus 172560W
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNTSGQFEYDVVFHGINTEEGAENKAPVAVINGPYSGNVNEAISFTSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 26646 - protein, 43 aa, Bacillus cereus 172560W
MIVALNDVVATAGALIVPASAPPLIVIRELTNNEAVILIVYEI

SEQ ID NO: 26647 - protein, 1325 aa, Bacillus cereus 172560W
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGPQGVQGLQGPIGPTGATGAQGIQGIQGLQGPIGATGPEGPQGIQGVQGLPGVTGPQGIQGAQGIQGTQGPSGNTGATGATGQGITGPTGITGPTGITGPSGGPPGPTGPTGATGPGGGPSGSTGATGATGNTGATGSTGVTGATGSTGPTGSTGAQGLQGIQGIQGPIGPTGPEGPQGIQGIPGPTGVTGEQGIQGVQGIQGAKGATGDQGPQGIQGAIGPQGATGATGDQGPQGIQGVPGPSGATGPQGVQGIQGPMGDIGPTGPEGPEGLQGPQGIQGVPGPVGATGPEGSQGIQGIQGPVGTTGPQGPQGIQGIQGVQGITGATGVQGVTGIQGIQGEIGATGPEGPQGVQGAQGEIGPTGPMGPQGVQGVQGIQGATGAQGVQGPQGIQGIQGPTGATGDTGATGATGEGTTGPTGVTGPTGVTGPSGGPAGPTGPTGPSGPAGVTGPSGGPPGPTGVTGATGVTGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGPQGPTGIQGIQGEIGPTGPEGPEGLQGPQGIQGVQGPVGATGPEGPQGIQGIQGPVGATGPQGPQGIQGIQGVQGITGATGAQGATGIQGIQGEIGATGPEGPQGVQGIQGVIGPTGPMGTQGVQGIQGIQGATGAQGVQGPQGIQGIQGPTGATGDTGATGATGEGTTGPTGVTGPTGVTGPSGGPAGPTGPTGPSGPSGGPAGPTGPTGPSGPTGVTGPSGGPPGPTGATGATGVTGDTGATGSTGVTGATGATGATGVTGLQGPQGIQGVQGEIGPTGPQGIQGPQGIQGVTGATGAQGPQGIQGPQGDIGPTGPQGIQGPQGPQGIQGATGPTGAQGPQGIQGLQGDIGPTGPQGPQGIQGPQGIQGPTGATGATGATGPQGIQGPQGIQGPQGIQGPTGATGATGATGPQGIQGPQGIQGPQGIQGPTGATGATGATGLQGIQGPQGIQGPQGIQGPTGATGATGSQGPTGDTGPTGAGATGATGATGVSTTATYAFANNTSGTAISVLLGGTNVPLPNNQNIGPGITVSGGNTVFTVANAGNYYIAYTINLTAGLLVSSRITVNGSPLAGTINAPTVATGSFSATIIANLPAGAAVSLQLFGVVAIATLSTATPGATLTIIRLS

SEQ ID NO: 26648 - protein, 134 aa, Bacillus cereus 172560W
MKPEEPKEPKEPEVKPEEPKEPKEPEVKPEEPKEPKEPEVKPEEPKEPKEPEVKPEEPKEPKEPEVKPEEPKDLKKPEVKPEVRLEKLIKEPQAKVEKELPKTGAAHSWMMSVGAGISFLVGGVLFVLGRRRKQ

SEQ ID NO: 26649 - protein, 431 aa, Bacillus cereus 172560W; identical to SEQ ID NO: 26534

SEQ ID NO: 26650 - protein, 746 aa, Bacillus cereus 172560W
MGNNSKHKTRKILAATATVTMLATGMISSSDVFAEQKEQQKNLSTSPQSEKSVKSENRIFTVPGKGDVEVLKQQERKSMAFSPYEPTGLYAKPNEQITINVEGNQDIQVYIGTYSYDASWREDSKIKSFTLKPGVNTIQSPNGGLIYFYNKQQGGSIRTTITTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYATSYRTAYVGDAIQYVLDINKFITDGWGPWHEAGHLRQQSPWKFYNMTEVQNNIYSLSVEKAFNQPSNLEKSGIYPKAFQYIEQVNKNYDEISDVFVKLVMLWQLQLAYGEDFYPKLHQLYRDMPSSELPQTDENKKQLFMISASKVAKQNLIPFFEKWGLRPNNDTIQKVAALGYPILTAEIWKGTDSNPIKPDMPNVNNILEGNQFAWSLKGISDFEFAKINFNKSTEEMQIDLKAGVPHHYFNETYASIKVQNASGKVMYNKDIYGNKQQNAESQQVSVKVGDYIELTHLEGVHRATLTNVDNSKQESFGKKAMYEVTKEGLKKVNQIVNPKPDTEAPTQPQGLYASNLTSNSVELKWNPSTDNVGVKEYQVLRDGQLIQTVQGTTFTDQNLTVNKEYKYAVKAVDAAGNTSIQSEILLVKTKDQNVSYEKWDPKKAYTKGDKVEHQGTVYEAVQSHQGNGDPNWIFALSLWKLITIK

SEQ ID NO: 26651 - protein, 55 aa, Bacillus cereus 172560W
MENEKYLQVVEDEELEQLVGGIGPGYIETLTKDCPRVTPQICVPINGIWTCKRCY

SEQ ID NO: 26652 - protein, 162 aa, Bacillus cereus 172560W
MVHFKSQQDAQAFWDQNGYGVGNDPHRLDNDKDGIPCEDYKYPKSTNTTTENKETTKPQEQPKQENTKQENTKQEPVKQENTKQENSKQNNQTTNNKQEQTKPQTTAKETKKNTNTVVKKETKKQGEKLPNTASNGVTMMLASLGLALAGSVLMFRRKKTNA

SEQ ID NO: 26653 - protein, 738 aa, Bacillus cereus 172560W
MKQLKPAISVLGSVSMALTLVSPALADVKQPNPGGTVEIFKENANAKKEDKNFTLGSDGEIGSLITQNIEMANNDWDKDGISNDLEINGYKIEFNSQTGKNEAKAWDPEKDKGKPKFISNPMNANTDGDPFTDMYEVENYNNDSDTNFNPIVANIPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRIYTPKDKSLADKPVLSYNEVFQHVNIDTKKVNHIVNKAKSTNNVSVVSANNGTDALNDLKAGQGDGGYLHKDSVHGAFAKLQQPTLVEGSYDSVTQKIRATVLPGLFGVSKEIPTTYNKKWNAPSQTVTLVKRENGFTYESRENIHPIKSEIAAHRKVTFEINDAHNLTPIQKIDTEIKANKEFEDYVVDNSGEFVTEGVPYTVASYGNTAYWGSHHAGNKWEYLWSEKSSDEKVNVIIERVGQPKPGKPIKKDEEVLIKFQNPIYSDYAYLKLQDSYIHLDQKQNASTFKFNHAYPKNFTGHHKQWNILSNGNKLKVGYLIDYMKYGNGENGTDTIAWNLSRVQ

SEQ ID NO: 26654 - protein, 458 aa, Bacillus cereus 172560W
MNLKLTSKLERLRKSKKGIGACVLAAGVTAITMIPQSAYAHGFVEKPSSRAALCSQNYGALNLNCGNIMYEPQSLEAPKGFPDGGPIDGKIASAGGLFGGILDQQTSNRWFKNTIKGGANTFTWKYTAAHPTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDIEAPTQPKGLHSMGTTATTVDLMWSPSEDNVGVDHYIVYRESAGVMNKIGTAANTSFMDKDLKANTSYKYVVTAVDLAGNESSRSDVLTVTTKSEDSTYEKWDARKAYTKGDRVVHEGKVYEAVQDHQGNGDSNWIFALSLWKPVLNK

SEQ ID NO: 26655 - protein, 172 aa, Bacillus cereus 172560W
MGKIFKFGCLGIIALFVIGIIAMVAGGGDSTEKTSTDTKAVSKEGVSSDVKIAVGSMETVDSVGNEYTKEQAQGVFKILEVTLTNNQKDAITVDANSFKLVDSKGREFTYSTQGQTSFDLANGGKTDFFLKQLNPGLTQTGKIVFDIPKDAEGLFLKASGGMTGKEINLKVE

SEQ ID NO: 26656 - protein, 1019 aa, Bacillus cereus 95/8201
MITFRIIYFGGDVRLKQNKRKRINAMVIAAALSLPFAVYSTPALAAVAIEANKTGHVLEDGTYDAVIKAYKDKTNEESMAAVYIKNPKLTIENGKKIVTATLSDSDFFQYLKTEDIHTPGVFHDVKVISEDKKKNGTKVIQFEVGELGKRYNMRMHIYIPTMAYDNKYQVQFEVNTLNLDKDVPEEQKENKEDKLDQQDANVIIDKQLQRHINKYNLNRENLNAPITKEDLLKVKSLIVVEAKSKGIKDVSGLEYMTNLENLTLEEVKLENIKFISNLRQLKSVSITYAELEDIGPLAELEHIESLSLRNNKISDLSPLSQMKKIKLLDLNSNYIKDIKPLFTVKSLRTLTVANNQISNAGLEGVHQLKNLKTFEISNNGLSNVEHINGMNKLIELGLSKNELVDLTPLSKLSGLQKLNLEENFISDITPLSQLTSLYDLKLGSNEIRDVRPVQELGKRMYIDIQRQKIFLDDVEKDKEVKIPIYNLQGEPIDTIQLNSEDGIVNNGSVKWGTTGEKTYEFMLDIKPEENRIKFNGTVIQNVVERLDEIKEDNEQKESVILDKTLQQHINKENLGRENLNAPITKEDLLQIKKLEILKEKGKEIKDITGLEYMTNLEKLTLEGVGLKNLEFISNLEKLNDVNVSHNQIEDITPLSALKNLQWLNLADNHIKDVSVLGSMLDLLSLKLSGNEIRDVRPLIQLGQWFSIDVGRQKIVLSEAKVNEEIQVPVYDLEGESIENIKLISEGGTFNNGVIKWNTPGEKVYKFDLDSDGISIRFNGTVIQSIVEKEEVKEPVKEVEEAKEEVKEPVKEVEETKEEVKEPVKEVEETKEEVKEPVKEVEETKEEVKEPVKEVEEAKEEVKEPVKEVEEAKEEVKEPVKEVEETKEEIKEPVEEVEGTKEEVEGTKEEVKGPVKEVEGTKEEVKEPIKEVEEAKEPKKEVKESATGLDQEPKGKNQVVENEGRKADTLNKQYTNKPEEGKKSLPSTGGEASTSTLLSGITLVLSALSMFVFRKRLFKK

SEQ ID NO: 26657 - protein, 949 aa, Bacillus cereus 95/8201
MALSLGALQAPASAEEKVPYNVLKTKPVGIEKPVDEIGHVSKAEETLSFQERLKVGDFSQRPASITNKATVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTTEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLAQKEWSGYKTVTAYFVNYRINSSNQFEYDVVFHGIAKDDGENKAPTVNINGPYNGLVKEGIQFKSDGSKDEDGKIVSYLWDFGDGSTSAEVNPVHVYEREGSYKVALIVKDDKGKESKSETTVTVKDGSLTELEPNNRPEEANRIGLNNTIKGSLIGGDHTDVYTFNVASAKNIDISVLNEYGIGMTWVLHHESDMQNYAAYGQINGNHIEANFNAKPGKYYLYVYKYDNGEGTYELSVK

SEQ ID NO: 26658 - protein, 333 aa, Bacillus cereus 95/8201; identical to SEQ ID NO: 26112

SEQ ID NO: 26659 - protein, 55 aa, Bacillus cereus 95/8201
MENPEKENPTLPEKGQGTSHAQQLPATGHDMNYLPFIGFALVLLGIRLRFMTKNN

SEQ ID NO: 26660 - protein, 337 aa, Bacillus cereus 95/8201; identical to SEQ ID NO: 26438

SEQ ID NO: 26661 - protein, 503 aa, Bacillus cereus 95/8201
MFNKKMVAMAMTVPLVMGTLSTVSAVETKKQVKVEAYSPQKKAIEYLKGNANQYGLKPDLSDLQYISTTETSVASYVRFQQVVNGAPVFSNQITVTLNGEGKGVLAVSDYQPIKAVKQVTEKISEKDAIQKSMAYVGEASEQNLWAPTEKEFGYIIEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAAAYSSSDPTCLRRLDTNKVYPKDIKNQVHADGEIWSQGQYEMAQAFGRDVATKIILQSHWSLTPNSKFSDGAKAIKQADALLYGGQHAADIDRIWAARGISTN

SEQ ID NO: 26662 - protein, 412 aa, Bacillus cereus 95/8201
MKKAKGIAKSVAVASVIMSGSLGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKAPEEQMIGINNVNNQLNKGKGKLSFSMNGNQLKATSSNAGYGISYEDKNWGIFVNGEKVYTFNEKTTVGNISNDINKLNIKGPYIEIKKN

SEQ ID NO: 26663 - protein, 455 aa, Bacillus cereus 95/8201; identical to SEQ ID NO: 26452

SEQ ID NO: 26664 - protein, 372 aa, Bacillus cereus 95/8201
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKSNLDSLSANLELAKQDVKNKLAALQEARQDLINKINEIKQSKQTVSDDLSKKKQDLDIKINDFKHTEKKIDDKLAEIHTTKQNVDNKINEVSQSKQTETKTGTTNANNNARELPNAGSEQSNNMALGMLSVLGGILLVTRNKIKTLFSK

SEQ ID NO: 26665 - protein, 39 aa, Bacillus cereus 95/8201
MASLIRTRRTSPWFKDNRSVLADVALTPGPPPIRDSIAN

SEQ ID NO: 26666 - protein, 971 aa, Bacillus cereus 95/8201
MKGYSKKVLVGVSFASLMLGSFQGGALAEGTKGEQASYRNVLKMEPVGVQLPVQELAHSSKVLENKSFEKRLQFADLSQRPPELKKESKQLATAKTYTIAELNQLSNQQLVDLLVTIDWEQITGLFQFNKDSLAFYQNDSRIQAIIDKLKQQGQDYTKDDSKGIETLVEVLRSGFYLGFYHTELSKLNERSYHDKCLPALKTIANNANFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKAPVAVINGPYSGNVNEAISFKSDGSKDEDGKIVAYKWEFGDGTVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 26667 - protein, 774 aa, Bacillus cereus 95/8201; identical to SEQ ID NO: 26100

SEQ ID NO: 26668 - protein, 261 aa, Bacillus cereus 95/8201
MSSWRNNINGYCSCNNQNGVHVDSCCFSCDGTVPKLGPTGPTGATGATGATGVTGVTGVTGATGITGATGITGATGITGVTGPTGATGITGATGPTGATGITGATGPTGATGPTGEIGPTGVTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 26669 - protein, 329 aa, Bacillus cereus 95/8201
MTGPTGSTGVTGSTGPTGSTGATGNTGPTGETGPTGSTGVTGNTGATGSTGVTGNTGPTGNTGATGATGATGSTGPTGSTGVTGSTGATGSTGVTGNTGATGPTGSIGATGATGSTGPTGSTGATGVTGNTGPTGSTGATGVTGVTGVTGSTGPTGSTGATGVTGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26670 - protein, 148 aa, Bacillus cereus 95/8201
MKKKLLPICAIALLTVGYSSVASADTGTVTKEEATQLQQDKAKKEAAIKEQQKIEEEKKRIAQEQLKNDMAKKEEAIKAQQKSEEGKKEAAQVQQKNAATKKEVAKPAVQGEKLPNTASNNVAMMALSACLVGIGTLFGLKRRNKVKA

SEQ ID NO: 26671 - protein, 431 aa, Bacillus cereus 95/8201; identical to SEQ ID NO: 26576

SEQ ID NO: 26672 - protein, 376 aa, Bacillus cereus 95/8201
MELSKVDDIDGSTLKDAVFKIVDMNGNDVRTDLTTNKDGKISVSDLRPGDYQFIETKAPTHYDLNQTPINFTVEKSQTATASVTATNSLTKGAVELTKVDDIDGTTLEGAIFKIVDQNGNDVRADLTTDKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPETHGKETSEELENGNPKTQTNKQQDDRNTGKELPNTGHKNDSTQTVGIILLLAGLLSVLATKRKKYY

SEQ ID NO: 26673 - protein, 163 aa, Bacillus cereus AH1134; identical to SEQ ID NO: 26501

SEQ ID NO: 26674 - protein, 336 aa, Bacillus cereus AH1134; identical to SEQ ID NO: 26633

SEQ ID NO: 26675 - protein, 965 aa, Bacillus cereus AH1134
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTVARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNKEYQEYMQQLIDNQDKYNVPEVADDYLAEHETKSLAAVKKEISDTLPMKDTKMTKHNSQFFNTFTLEGTYTGSVTKGESEDWKAMSKRVNESLEQLAQKEWSGYKTVTAYFVNYRVNSSNQFEYDVVFHGIAKDDGENKAPTVNINGPYSGLVKEGIQFKSDGSNDEDGKIVSYLWEFGDGSTSAEVNPVHVYEREGSYKVSLRVKDDKGKESRSEATVTIKDGSLTESEPNNRPEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYSLSVK

SEQ ID NO: 26676 - protein, 333 aa, Bacillus cereus AH1134
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDHFVHVIGTHLQAEDSMCGKTSPASVRTDQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPQSPQWTVTSWFQKYTYNDYSDHYPVEATISMK

SEQ ID NO: 26677 - protein, 209 aa, Bacillus cereus AH1134
MLKKFTTCILGGALVFNLSGCSNTSDKTSSESKETNSKQEEKKVQTTDEAKTKENTRQKNTEQTKEKSKIKEKEYAVNKDFHTPKFDVTVKRVVERDKVGKESIGFQKPEDGHVFIVVEAEGKNITNEPMKLAVLPSVDLVDENDNAYQSDVWAASSYAVEKGETSTITKGLKPGEVMRESKVYVINKEKFDTGKWYVVVNHEYKEQIK

SEQ ID NO: 26678 - protein, 183 aa, Bacillus cereus AH1134; identical to SEQ ID NO: 26632

SEQ ID NO: 26679 - protein, 1961 aa, Bacillus cereus AH1134
MQMKSTKRHISMVSLVFLVLFSVLNVWAPVIQAAVMKSPVDEINISRTDGTTSEPYQASDGMKVEVKWSAKEKIKSGDQFTIDMPKEFRKDLMNMSFPLKDAEGKTVGTCEMKKGLLTCTMGDYVEGKNNIKGSLFVEFYFGLEAYDGVKEIPLEFNVDGQIVNKEVNVSNTTERPKPQPNTENLLKWGSYNQEDPSIADWLVYVNATGTEMQDLKLTDTLGPGHELITDSVLLEEAVFEDGYAPTNIKPANLSNIKINATKTGFTIEFPDSSKGYILRYKTKVTNPAAKPHKNTVKLEGKNIKTEEKVGQVFVSGGGGSGSGDDNPPSIEKNIVDENGKLVENEQLTQMNQVIQYQVGTHIPNDPPKYTSMVISDDLEDVLEVLEAKVYDQNGQDITSKGTLKIDKQRSEVTFTFDENFDYKSYEDQIINLSIKAKIKNNADLSSYVDKKIPNKAELHFDDKTLTSKEVTITPPEAPKDGTVSLHKIDSENPNKGLKGAEFEVRNSANEVVAKLTTDEKGFSVPQTLAPGTYKVYETVAPEGYQKLTSPVEVTLQAGETKTIEIKNTVQKGQIEIKKIDSENGEKPLANAEFDIVKDGVVVEHIVTDKDGKATSKPLALGKYILKETKAPEGYQLKETEFEVNVTGDGIFPIQVENAMVDKGNIEITKVDKENGAVLAGVEFEVQDEKDGVVRKVVTDKDGKANVSDLSVGKYKLVETKSLPGYKKLTEPVPFEITKGMTKALAIKVENEQLDKGSVEITKIDKDSQKVLEGVVFEVQDEQGKVVTEVKTDKDGKAKISDLSVGKYKLVETKSLPGYKKLTEPVSFEITKGMTTVLSLKVENEQLDKGSVEITKVDKDNKKALKGVVFEVQDEAGTVVKEVKTDKDGKAKISDLSVGKYKLVEKESLPGYKKLTDPVLFEIKKGMTEVLSLKIENEMVDTGNVEITKIDKDNKAPLAGVTFIVQDEKGNEVTKVTTDKDGKANVSDLLVGKYELVEVESLPGYKKLEKPVSFEIKKGMTEVLSLKVENEMVDTGNVEITKIDKDSKAPLENVVFEVRDLKGKVVAKVTTDKEGKANVSDLSIGKYELVEVETPAGYKPLEKPISFEIEKGRVTALKLKVENELVDTGNVEITKVDKENKDALADAVFEIQDEAGQVVAKITTDKKGQAQVTNLSVGTYKLVEVKAPKGYKQLVDPITFQIEKGMTKSLALTVENEMLDKGNVEITKVDKESQKVLEGVVFEVQDEQGKVVTEVKTDKNGKAKISDLSVGKYKLVEKESLPGYKQLTEPVSFEIKKGMTKVLSLKVENELLDKGSVEITKVDKESGAVLAGVTFEVQDEKDKVVTKVTTDKEGKAKIADLSVGKYKLVEVESLPGYKKLAKPVSFEITKGMTEVLSIKVENEQLDKGSVEITKVDKESGAVLAGVTFEVQDEKDKVVTKVTTDKNGKAKIADLSVGKYKLVEVESLPGYKKLAKPVSFEITKGMTEVLSLKVENEQLDKGSVEITKVDKDSQKVLEDVVFEVQDEQGKVVTEVKTDKNGKAKISDLSVGKYKLVEKESLPGYKQLTEPVPFEIKKGMTEVLSLKIENEMVDTGNVEITKIDKDNKAPLAGVVFEVQDDKGKVVTKVTTDKGGKATVADLSVGKYKLVEVESLPGYKKLEKPVPFEITKGMTKSLAFTVENEMVDTGNVAITKIDKDSKAPLENVVFEVRDSKGKVVAKVTTDKEGKADVSDLSIGKYELVEVETPAGYKPLEKPVSFEITKGMTKVLSLQVENEQLDKGSVEITKMAAESKEVLSGAVFEVHDEKGKVVVKVTTDKDGKAKITDLSVGNYTLVEVEAPKGYEKLTNPIPFEITNGMINAVQLEVLNKLNHLAPPGPETPDPEKPGTPDPEKPGTPNPEKPGTPDPEKPGTPDPEKPGTPNPEKPEKELPKTGQKMPVEPYMGALLVMMSFGLLILGRKQQR

SEQ ID NO: 26680 - protein, 1262 aa, Bacillus cereus AH1134
MSRYNDNQNKFSKPCFPSSAGRIPNTPSIPITKAQLRTFRAIIIDLTKIIPKLFANPSPQNIEDLIDTLNLLSKFICSLDATSSLKAQGLAIIKNLITILRNPTFVASAVFIELQNLINYLLYITKLFRIDPCTLQELLKLIAALQTALVNSASFIQGPTGPTGPAGATGATGPRGNTGATGATGATGPRGNTGATGATGPQGNTGATGATGPQGNTGATGATGPRGNTGATGATGPQGNTGATGATGPQGNTGATGATGPQGNTGATGATGATGPRGNTGATGATGPRGNTGATGATGPRGNTGATGATGATGPQGNTGATGATGATGPQGNTGATGIGVTGPTGPSGGPPGPTGPTGPQGPQGNTGATGATGPQGVQGNTGATGATGPQGVQGNTGATGATGPQGVQGNTGATGATGPQGAQGNTGATGPQGAQGNTGATGATGPQGAQGNTGATGATGATGPQGAQGNTGATGATGPQGVQGNTGATGATGPQGVQGNTGATGATGPQGAQGNTGATGATGPQGVQGNTGATGATGPQGAQGNTGATGATGATGPQGVQGNTGATGATGPQGVQGNTGATGPQGVQGNTGATGPQGVQGNTGATGATGPQGPQGNTGATGPQGVQGNTGATGATGPQGVQGNTGATGPQGAQGNTGATGATGPQGVQGNTGATGPQGVQGNTGATGPQGAQGNTGATGATGPQGVQGNTGATGATGPQGVQGNTGATGATGPQGVQGNTGATGATGPQGVQGNTGATGPQGVQGNTGATGATGPQGVQGNTGATGATGPQGVQGNTGATGATGPQGVQGNTGATGATGPQGVQGNTGATGATGATGPQGIQGNTGATGATGPQGAQGNTGATGATGPQGVQGNTGATGATGATGPQGVQGNTGATGATGPQGVQGNTGATGATGPQGAQGNTGATGATGPQGVQGNTGATGATGPQGVQGNTGATGATGPQGVQGNTGATGATGPQGVQGNTGATGATGPQGVQGNTGATGATGPQGVQGNTGATGATGPQGAQGNTGATGATGPQGVQGNTGATGATGPQGVQGNTGATGATGPQGAQGNTGATGATGPQGVQGNTGATGPQGIQGPTGATGATGIGVTGPTGPSGGPTGPTGPTGPSFPIATIVVTNNIQQTVLQFNNFIFSTAINVNNIIFNGTDTVTVINGGIYVISVSISTTAPGCAPLGVGISINGAVATDNFSSNLIGDSLSFTTIETLAAGARISVQSTLNEITIPATGNTNIRLTVFRIA

SEQ ID NO: 26681 - protein, 971 aa, Bacillus cereus AH1134
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNASGQFEYDVVFHGINTEEGAENKAPAAVINGPYSGNVNEAISFKSDGSKDEDGKITLYRWEFGDGAVSNEQNPTHVYTKEGTYTTKLTVTDDKGATNTATATVTVQKKEDNSVEKEPNNSFQTANKLQLNQVLRASLGNGDTSDFFEINMENAKNLQINVTNENNIGMNWVLYSEADLNNYVTYAQQQGNKLVGSYYTYPGKYYLHVYQYGGGTGNYTVEVK

SEQ ID NO: 26682 - protein, 458 aa, Bacillus cereus AH1134
MKNFKGMLISSLAITTFAGVGTTFVTNTVYAANDNSSKILVRSNKSINTTTSSRLPVLSVNPYDEPRFSRQGYLEEAPLGINAPYAWGIKGGDGQGATFVDLEEGWLLNHEDLVGQNIEFMSGKMSNDLSHGTSVLGVVSAADNRIGNIGIAPKAKAKVISVIRDNGRIDVRDAILSAVDSLQAGDVLLIEESFKYDGYGDDPLPVEVYPSIFNAIRKGTDKGIIIVEAAGNGGIDLDEFKDRNGKQILNRNSPDFKDSGAIIVGASTARVPHKRLGFSNYGSRIDVYGWGEYVDTLDTYQNQNSKGQKVTDQSIMNRYTSNFRGTSSASPIIAGAAVSIQGIAKEHLGKAYTPKELRAILSNPNTGTKSNNPSSDKIGVLPDLKAILSNLGFHSDLTTNDSMVFPDNVEKNEGKENSTFVFPGEETKKTGDKNSTVTFPEEDLKQEEKEEGLIVFPD

SEQ ID NO: 26683 - protein, 370 aa, Bacillus cereus AH1134
MKTKQTIAASTLALAMIAGANPAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNSTKNNNAKELPNAGSEQSNNMALGMLSVLGGILLITRNKIKTLFSK

SEQ ID NO: 26684 - protein, 738 aa, Bacillus cereus AH1134; identical to SEQ ID NO: 26653

SEQ ID NO: 26685 - protein, 878 aa, Bacillus cereus AH1134
MVKYSKISKWILGVGLVTITCNGLQIQAETKEKNVKNVLQMEPVGIQKSVDELAHPSKVQENESFTKRLKLADLSQRPLAPTDNIKPLAEEKKYSMAELNQLNNKQLTDLLVTIKWYQIPELFQFNSDSLKFYQDDSRMQAIINKLAEQGQAYTQDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDEYRATLSKDNKLNEEYQSYMQMLIDNRDKYTIPQVSDEYLTQHDPKSLSDVTSDITNEAKLKDVKVTKNKSQFFNTFTLQGTYTGSAAKGEVEDWKVMNEATNDMLKRLLGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 26686 - protein, 372 aa, Bacillus cereus AH1134
MSSWSNNVNGYCGCNNQNGVHVDSCCFSCDGTVPKVGPTGPTGATGATGPTGATGVTGPTGATGITGATGPTGATGITGATGPTGATGITGATGPTGATGSTGATGSTGATGATGSTGATGATGATGPTGATGATGPTGATGSTGPTGVTGSTGPTGVTGSTGATGSTGATGATGATGSTGPTGATGSTGATGATGATGPTGATGATGPTGVTGSTGATGSTGPTGSTGPTGATGTSITATYAFANNTSGTAISVLLGGTNVPLPNNQNIGPGITVSGGNTVFTVANAGNYYISYSINITASLLVSSRITINGAPLAGTINSPALATTSFSATIITNLAAGDAISLQLFGLLAVATLSTTTPGAVLTIIRLS

SEQ ID NO: 26687 - protein, 1309 aa, Bacillus cereus AH1134
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGPQGVQGLQGPIGPTGATGAQGIQGIQGLQGPIGATGPEGPQGIQGVQGLPGATGPQGIQGAQGIQGTQGPSGNTGATGATGQGITGPTGITGPTGITGPSGGPPGPTGPTGATGPGGGPSGSTGATGATGNTGATGSTGVTGATGSTGPTGSTGAQGLQGIQGIQGPIGPTGPEGPQGIQGIPGPTGVTGEQGIQGVQGIQGAKGATGDQGPQGIQGAIGPQGATGATGDQGPQGIQGVPGPLGATGPQGVQGIQGPMGDIGPTGPEGPEGLQGPQGIQGVPGPVGATGPEGSQGIQGIQGTVGTTGPQGPQGIQGIQGVQGITGATGVQGVTGIQGIQGEIGATGPEGPQGVQGAQGEIGPTGPMGPQGVQGVQGIQGATGAQGVQGPQGIQGIQGPTGATGDTGATGATGEGTTGPTGVTGPTGVTGPSGGPAGPTGPTGPSGPAGVTGPSGGPPGPTGATGATGVTGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGPQGPTGIQGIQGEIGPTGPEGPEGLQGPQGIQGVQGPVGATGPEGPQGIQGIQGPVGATGPQGPQGIQGIQGVQGITGATGAQGATGIQGIQGEIGATGPEGPQGVQGIQGAIGPTGPMGAQGVQGIQGIQGATGAQGVQGPQGIQGIQGPTGATGDTGATGATGEGTTGPTGVTGPTGVTGPSGGPAGPTGPTGPSGPAGVTGPSGGPPGPTGATGATGVTGDTGATGSTGVTGATGATGATGVTGLQGPQGIQGVQGEIGPTGPQGIQGPQGIQGVTGATGAQGPQGIQGPQGDIGPTGPQGIQGPQGPQGIQGATGATGAQGPQGIQGPQGDIGPTGPQGPQGIQGPQGIQGPTGATGATGATGPQGIQGPQGIQGPQGIQGPTGATGATGATGPQGIQGPQGIQGPQGIQGPTGATGATGATGLQGIQGPQGIQGPQGIQGPTGATGATGSQGPTGDTGPTGAGATGATGATGVSTTATYAFANNTSGTAISVLLGGTNVPLPNNQNIGPGITVSGGNTVFTVANAGNYYIAYTINLTAGLLVSSRITVNGSPLAGTINAPTVATGSFSATIIANLPAGAAVSLQLFGVVAIATLSTATPGATLTIIRLS

SEQ ID NO: 26688 - protein, 3373 aa, Bacillus cereus AH1134
MKQVLKCFNVVTMITLLLSIILPSPSAFATEINKKSWDELQGNDVKIKAEQVNAEMYKGEVAEREHVFQYKIENTGDTPIRELVIKQNNDNGIEFLSQSVKVNGEKLLENKVADFYVEEKDNGGKVLSSNLKIQDLKSHEKMTVLIKARRAQHFNKEYKQKISVQKDQLQIGNMSVDVEGLPSEEKLEGNTDDEADSSKKAIGSTTDSKTKEVDGKLKVSVEDKNTSTQKTEIEKVKQPEAEKQLEKEEKQSPLAVKQSDAEVQAASENASKVQIQTGDKQGFGDPLYSTIAPGNLVQTGNVTLGLTSDHYGRQSMGYKTNKMPVDVDNDDSTFNSSTGAFPNIPAGSKVKKAYLFWTAAMGLPGNIADRKVTEDQVRQPVKMRMGNKEYAEVTADSIRKADYLPYISNYSGSGAGYVAYAEVTNIIAQQGISQTLTVANVPQIKDVTGGGYYWGNWNLILVYENYKETVKDMKIWEGLVSQKSTAWTDISVNKINTPKEGAFKAKFSYFSSQGDPADNDGYAYDYGEYDFGLGYQKFKNIKGKDNDVNDSSMTEVQVDGTNEFVTKKYPGYNPDWTNSFSTDIHTYHLEGPTQVKNDLKEAKMRFRAYGGGGDIYVLNNATFVTEHNAPNLQVDKKALDSAGKEIKDVKAGEEFTYQIEVKNDTKNNQAPVSNVKGFDKLDDRLEYVPGSIQYVSGSNKGNKTDNASDDEAEFVNNQIDFRVGEGADAKNGGVLKPGESTVITFKVKVKDSVQSDTTVKNVVVVKGQDSAEIKYETEDDANVTVTIPKEVPGEIEARKIASNKTPKLGDEVEYRITFKNKIKDGRLDVLTIEDELPSSLEYVKDSLKAEGVKPEPVELKFENGKVIAKYPEIMDMEERSIVFKTKVKETAKIGEEIVNKATVSDKTNPPKDLEEKITPQHKAGKIDAKKKATNKKPKLGEEFEYQISFKNTVENGKLDAITIEDEIPANLEFVQGSERAEGTEPNPVELKVENGKVIAKYPEITDTKERSIAFKVKVKEEAKAGETIVNKAVVSEPNGQSEHPEEKITPDYKYGKVDVEKNVTNQTPKLGEEVEYRITFYNTVENGKLETVLVEDTLPKGVEYVKDSLKAEGIKPEPVELKVEDGKVMAKYPEIMDTEKRSIVFKVKVKDSAKVGEAIVNKAIAKDPKNEPVESKVVITPQSKKGEIAATKVVNNKKPKLGEEIEYRISFHNTVENGKLETVRVEDTIPKGLEYVENSIKAEGEAPGPVELAVENGIVKAKYIDIMDMKERSIVFKVKVKEEVKVDKEIVNKAIVDDTKNPPIEPEERITPQHKDGIIDSKKTVDNPSPKLGEEVEYRISFKNTVENGKLEKVIIEDTIPNGLEYVKGSEKAEGDKPAPLKLSVKDGKVIAEYDNITDMKERSIVFKVKVKEEAEVGKEIINKAIVDDMKDPKEPEAKITPLHKDGKIKAKKIVNNETPKLGEEVEYRISMKNTVKNGKLTDVTVEDTLPEGLEYVENSLKAEGAGIDSVELKFENGKVMAKYPEITDTEERSIVFKVKVKEEVKVGKKIINKATIDDSQNKPVNPTAEITPQYKDGKLEAKKIVNNETPKLGEEVEYRISFKNTVEHGKLTEVKIEDDLPNGLEYVKDSLKVEGSKPDPVELKFENGKVMAKYPEITDTKERSITFKVKVKGKVSDSIVNEAIVSDTKHPPETPTAEIIPQHKDGKVKAKKTVNNETPKLGEEVEYRISFKNTVEDGKLAEVKIEDTLPEGLEYVENSVKAEGTKPDPVELKMENGKVMAKYPEITDTEERSITFKVKVKEEVKVGKKIVNKAIVDDTKNEPETPTAEITPQHKDGKVEAKKTVNNETPKLGEEVEYRISFKNTVENGKLAEVKIEDDLPNGLEYVKDSLRAEGTKPDPVELKVKDGKVIAKYPEITDTEERSIVFKAKVKEEFKVGEGLVNKVVVDDTKDPTTSEVTIMPEYKDGKLKAEKFVNNKKPKLGEEIEYRISFKNTVENGKLVEVKVEDEIPAGLEYVENSLQAEGSKPSPVELKFENGKVMAKYLEITDTKERSIIFKVRVKEEAEIGKEIVNKAIVVDTKNEPEEPHVEITPQYKDGKIAAQKVANNHKPKLGEEVEYRISFKNTVENGKLAEVNIKDALPNGLEYVEGSITAEGSKPKPVELHVKNNKVMAKYPEITDTEERSIVFKAKVKESVKVGEEIVNEAIVDDTKNLPEEPYVPITPQYKDGKIEARKEVSNHEPKLGEEIEYRIIFNNTVKDGKLAEVKIEDKIPAGLEFVEGSEKAEGEEPKPVELKVENGKVMAKYSEIMDTQERSIVFKVKVKDSVTIGKDITNKAIIHVDDPNHPVIDPTAKITPQYKDGKIAAHKKVNNHKPKLGEEIEYRISFNNTVKDGKLAEVKIEDEIPFGLEYVKDSLKAEGDKPAPVELKEEAGKVSAKYENITDMKERSIIFKVKVKDSVEVDKAIVNKAIVDDTKNPPERPEVDITPQHKDGKFKADKKVSKKDPKLGEEVEYRISFKNTVENGKLAEVKIEDQLPNGLEYVKDSLKAEGNEPNPVELKEEAGKITAKYENITDTAERSIIFKVKVTEAVKVGKKIVNTAIVDDDNPKNPPQKPEAIITPEYKNGKIKAEKTVNNPAPKLGEEVEYRITFRNVVEHGKLAKVKIKDELPNSLEFVEGSERAEGDNPKPLHVKVKNGIVLAEYPEITDTKERSIVFKAKVKEKAKIGEAIVNTAVVEDTINPPEKPNVAIQPQHKEGVLQAEKTVSNHEPKLGEEVEYRISFENTVENGKLTEVKVEDEIPAGLEYVQDSIKSDGPEPNPVELKVENGKVTAKYPEITDTKKRSIIFKVKVQETVQVGKEIINKAVVDDNNPTNPPVESLIPITPQYKDGKLEARKEVSNHEPKLGEEIEYRITFNGTVDGGKLVDVKIEDEIPSGLEYVKESLEAVGDKPVPTELKVENGKVTVKYPEITDTKERSIIFKVKVKESVKVGEEITNKAIIHVDDPDHPVMEPTATIKPEYKDGKLKATKTVNNKEPKLGEEVEYRISFKNTVENGKLAEVKVEDEIPAGLEYVQDSIRFEGAEPNPIELKMEFGKVIAKYLEITDTKERSIIFKVKVKAAPSKGITNRAVVDDKINPPLEPTVTILPKTKEDLKIPEEPKEPEVKPEDPKEPKEPEVKPEEPKEPKEPEVKPEEPKEPKEPEVKPEDPKEPKEPEVKPEEPKEPKEPEVKPEEPKEPEVKPEEPKEPKEPEVKPEDPKEPKEPEVKPEDPKEPKEPEVKPEDPKEPKEPEVKPEEPKEPKEPEVKPEEPKDLKKPEVKPEVRLEKLIKEPQAKVEKELPKTGAAHSWMMSVGAGISFLVGGVLFVLGRRRKQ

SEQ ID NO: 26689 - protein, 306 aa, Bacillus cereus AH1134; identical to SEQ ID NO: 26520

SEQ ID NO: 26690 - protein, 431 aa, Bacillus cereus AH1134; identical to SEQ ID NO: 26534

SEQ ID NO: 26691 - protein, 893 aa, Bacillus cereus AH1134
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDIKFISEPEVKAVIFVDENHGQASNAYQVTFAATTPNYVSGTYLVNAHNGDMLKDMVQESSLKISEEYVESVKENKTSNFTSLTGTGKDDLGVTRTFGISKQTSGNYALADYTRGQGIETYDVNYRDITNEESYYPGILATSASTTFNDPKAVSAHFLATKVYDFYKEKYNRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANTDELNMTSNFSELKLACLKVATNKYGTSSIEVQAVQNAFDAAKITGTVKENEKTAENQAPELTVPFTITLRVGDTFDPMRNVKAVDKEDGDLTNKVKHKGDVDTSKPGTYIVEYLVVDSQGRTTTATQTVIVEGNGEILDLEPKLTVPVGATIHVGDSFDPMIKVKAIDKEDGDLTSKVKIAGGVDTSKVGTYVLTYTVTDSKGHEVTAKQAVTVKVREEVTNEKPILKVPATTSITEGDQFDPLIGVSATDKEDGDLTSKVAYEGTIDTNKAGIYEIIYSVRDSVGNEVNTIQKVLVKDKETSKPNGLANKTNNNNISNNSNTDKKEYTYKELPKTGVSTTNSAAIGILMIIAGTVLTLIRKFRKIQK

SEQ ID NO: 26692 - protein, 438 aa, Bacillus cereus AH1134
MSKFKKHCCHIPFPLPQIGPTGLTGATGPSGPSGPTGATGPSGGPRGPTGPTGPQGNLGPTGPQGISGPQGIPGISGSIGPTGPSGIQGIQGIQGVPGIQGPIGPTGITGVTGIQGIPGIQGIPGIQGIQGIPGPTGPQGIPGIPGSVGPTGPSGAVGPTGPSGGPPGPTGPTGPSGGPPGPTGVTGPTGPTGSPGPTGLQGIQGIQGIPGPTGPQGSQGIQGIQGDPGPIGPIGPTGITGATGIQGIQGIQGNPGLIGPIGPTGPTGLQGIQGIQGIPGPTGLPGTAGATGPTGPAGLTVSGLSQYAYVFNTAAQVVALEAPILFNSHGRITSGFTHTLGTSQMTVINAGDYKISFSVSGVEPNQFALFLNGAPVTNSIYGSGAGTQQNNGQTILTLAAGDIITLNNHTSAAAVTLQTLAGGTQTNINASIVIEKLN

SEQ ID NO: 26693 - protein, 321 aa, Bacillus cereus AH1134
MKRNDKLSLNKGMIGPENIGPTFPILPPIYIPTGATGPTGITGPTGATGITGATGITGPTGITGATGVTGLTGITGATGATGPTGITGPTGITGPTGITGPTGETGPTGITGPTGETGSTGATGPTGITGPTGETGPTGATGPTGITGPTGETGPTGATGPTGITGPTGETGPTGITGPTGETGPTGETGPIGITGPTGETGPTGITGPTGVTGLTGLTGETGPTGATGPTGGIGPITTTNLLYYTFADGEKLIYTDADGIPQYGTTNILSPSEVSYINLFINGIMQPQPLYEVSTGKLTLLDTQPPSQGSSIILQFIIIN

SEQ ID NO: 26694 - protein, 455 aa, Bacillus cereus AH1134
MNNRFLKQLQNMKMNKKSLGIVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVPGTHFIDKKLQPSTEYSYTVKAIDAAGNVSTESTALTVKTTAETPDTEAPTQPKGLHSMGTTASSVDLMWSPSDDNIGVDHYDIYRETEGSMKKIATSNTTSYLDKNLLANTTYKYVVKAVDVAGNESVQSDIFTITTKTESASHEAWDAKKAYKKGDRVLHEGKVYEAVQSYQGNGDPNWIYALSLWKTV

SEQ ID NO: 26695 - protein, 503 aa, Bacillus cereus AH1134
MFNKKMVAMAMTVPLVMGTITTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKAEGTGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26696 - protein, 840 aa, Bacillus cereus AH1134
MVGAFKRSRTLSTIFSILSVLVLTISMFLPQTRVQAEVMDRETYKMDWSYSEQFGKYIRTELIKTANGQIAYCLTHGLKSPNGQDLPEMGKTDDIVYRVLLNGYPQKSPSELGVSNWEEAHYATQLAVWNALGQVSVADLQHHNGNVEKAAKAIITAADHGQETQEIYMNVVPTEEQKAELKGDFFETSLYTVETNAKQGTFKVQTNNAPQGIKIVNENGEVKEQLNVGEKFRIQIPKNTNSGKFNLKVISNLSKLQAIAYKGTNTIQDATVLLERGEEKISGDLSVNWESIGNLKLKKIGENNEALSGAVFDVFNSNNQKVGTMTTDKNGIGTLTNLPIGSYTVKETKAPEGHILKENNQTIEIKTGETATIEVKNESIKGNIEIKKLSDNGKILPGVEFTVFTSEGKEITKVNTDKNGIAKVDNLKFGKYYIQETKALDGYVINTTKYPFEIKEHGKTLTFEVKNQGITGSLEITKVDVADGNNKLPNAEFTIFNEEGKEVIKGKTNTEGIAKFEKLPFGKYTYRETLAPEGYVLNEETFSFEIKENGQIIKHIVEDKKIEGSLEITKVDVADGNNKLPNAEFTIFNEEGKEVVKGKTNTEGIAKFEKLPFGKYTYRETLAPEGYVLNEETFSFEIKENGQIIKHIVEDKKIEGSLEITKVDVADGNNKLPNAEFTIFNEEGKEVVKGKTNTEGIAKFEKLPFGKYTYRETLAPEGYVLNEETFSFEIKENGQIIKHIVENQKKPEQPTNPETPTKPEQPTKQPEQPQVEQKPHQEQKPQPEQHKIQTNQPTKVKETQSNPLPQTGGTDNRMKYTILGLTIILLSGLIFVLARRKKHN

SEQ ID NO: 26697 - protein, 491 aa, Bacillus cereus AH1134
MSNIGTPGPTGATGPRGIPGPRGAQGSQGVQGIQGLEGPEGPEGPQGVQGIQGPEGPQGPEGPQGVEGIQGPEGPEGPQGPQGVQGIQGPPGPPGPTGSGTGMGIPGPPGPTGPQGIQGIQGPEGPEGPTGPQGVQGIQGPEGLEGPTGPQGVQGIQGPEGPPGPTGDCECPPGPTGPTGPTGPTGPGCNFLVYVTNAGAIDDPADDTVSVINTATNTVVATITVDNAPLEVTVSPNGARAYVTNIFSDTVSVIDTATNIVIATIPVGADPIGVAVSPNNTTVYVGNHASNDVSVINAATNTVITTIPVGIAPQGITVSPNGAFAYVANELSNTISVINTATNTVTATIPVGIRPRIIVFTLDGTRAYVTNQNSNTVSIINTATNSVINTINVGTEPVGIDITPGGNLIYVVNKVSNNVSVINVATNTVIDTIPVALSPDQVTIIPDGTRAYVTNQGSNTVSVIDIATNTVITNVPVGFAPTGIATGTICE

SEQ ID NO: 26698 - protein, 746 aa, Bacillus cereus AH1134
MGNNSKHKTRKILAATATVTMLATGMISSSDVFAEETQQQKNLSTSLQSEKSVKSENRTFTVPGKGDVEVLKQQERKSMAFSPYEPTGLYAKPNEQITINVEGNQDIQVYIGTYSYDASWREDSKIKSFTLKPGINTIQSPNGGMIYFYNKQQGGSIRTTITTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYATSYRTAYVGDAIQYVLDINKFITDGWGPWHEAGHLRQQSPWKFYNMTEVQNNIYSLSVEKAFNQPSNLEKSGIYPKAFQYLEQVNKNYDEISDVFVKLVMLWQLQLAYGEDFYPKLHQLYRDMPSSELPQTDENKKQLFMISASKVAKQNLIPFFENWGLRPNNDTIQKVAALGYPILTAEIWKGTDSNPIKPDMPNVNNILEGNQFAWSLKGISDFEFAKINFNKSTEEMQIDLKAGVPHHYFNETYASIKVQNASGKVMYNKDIYGNKQQNAESQKVSVKVGDYIELTHLEGVHRATLTNVDNSKQESFGKKAMYEVTKEGLKKVNQIVNPKPDTESPTQPQGLYASNLTSNSVELKWNPSTDNVGVKEYQVLRDGQLIQTVQGTTFTDQNLTVNKEYKYAVKAVDAAGNTSIQSEILLVKTKDQNVSYEKWDPKKAYTKGDKVEHQGTVYEAVQSHQGNGDPNWIFALSLWKPITIK

SEQ ID NO: 26699 - protein, 458 aa, Bacillus cereus AH1134
MNLKFTSKLERLRKSKKGIGACVLAAGVTAITMIPQSAYAHGFVEKPSSRAALCSQNYGALNLNCGNIMYEPQSLEAPKGFPDGGPIDGKIASAGGLFGGILDQQTSNRWFKNTIKGGANTFTWKYTAAHPTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDIEAPTQPKGLHSMGTTATTVDLMWSPSEDNVGVDHYIVYRESAGVMNKIGTAANTSFMDKDLKANTSYKYVVTAVDLAGNESSRSDVLTVTTKSEDSTYEKWDARKAYTKGDRVVHEGKVYEAVQDHQGNGDSNWIFALSLWKPVLNK

SEQ ID NO: 26700 - protein, 51 aa, Bacillus cereus AH1134
MNVGEHELNLALGLSHSNVRDALMFSSYSMALRSLNKVDIGRIQYIYCLNT

SEQ ID NO: 26701 - protein, 368 aa, Bacillus cereus AH1134
MFLNKGMEGFQVKLRKIFMICFLFIFTLTIVTGCSSSQSSTTVKNGKASSSSKNVEIEVENAEYVLPLSGSIGGINKDKVLKFKVSLKNKGDEMLEISPYLFTLYQGDEKMKKYDKADSDKLRLIELEPGKKTSGILYYEVNKASSYELVYSNEETKKRDDETEKVSFKIDTQEIEKNTKDLNKPAEALKTYINAVYYDKDIDKINELSGEDGKQFTQNIHQEFKKDAMSSTHNGISDQEFESYYKKLKSVLQEKVTFTVKSVGSSPEEDKVEVELKVKPLLLSELQPKLNKENEKLLKENPGIEQPKLFSQSFSYFISILPEAKVSDKEKVIKVEMERYGKEQWRFSKGKVTDSEDVMEIMGEFLKQ

SEQ ID NO: 26702 - protein, 174 aa, Bacillus cereus AH1134
MYKKLGTIALTGALAFSLTACGETEVKEVSKNEAPKQEQKKEDKATSKVYKTGETVEVNGLQITFNSAKFVEANEYSKAEKGKVLEIDFSAKNNGKKDAYIGTEELKIADANGNQFKEYFGADNAFMNENVAPGNQVTGKMYFDVAESDKYTGTYKPNFTFDEKSVKFEFTPGK

SEQ ID NO: 26703 - protein, 965 aa, Bacillus cereus AH1271
MNKKSKINKVMLSISTMALSLGALQTHASAEEKVPYNVLKTKPVGIEKPVDEVGHISKVDETLSFQERLKVGDFSQRPASIMKSSEVKQMKESYSMADLNKMNDQELVETLGSIKWNQITDLFQFNEDAKAFYKDKGKMQVVIDELAHRGSTFTKDDSKGIQTFTEVLRSAFYLAFYNNELSDLNERSFQDKCLPALKAIATNPNFKLGTYEQDSVVSAYGKLISNASSDVETVQYAANILKQYNDNLRTYVDDRMKGQAVYDLMQGIDYDMQSYLIEARKEANETMWYGKVDGFINEINRIALLNEVTPENKWLVNNGIYFASRLGKFHSNPSKGLEVVTQAMHMYPRLSEPYFVAVEQITTNYNGKDYSGNAVDLEKIRKEGKEQYLPKTYTFDDGSIVFKTGDKVSEEKIKRLYWAAKEVKAQYHRVIGNDKALEPGNADDVLTIVIYNSPEEYQLNRQLYGYETNNGGIYIEETGTFFTYERTPEQSIYSLEELFRHEFTHYLQGRFEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDVYREELSKDSKLNKEYQDYMQQLIDNQDKYNVPEVANDYLAEHTQKSLAAVEKEISNTLPMKDTKMTKHSSQFFNTFTLEGTYTGSVTKGESEDWNAMSKKVNEALEQLAQKEWSGYKTVTAYFVNYRVNSSNEFEYDVVFHGIAKDDGENKAPTVNKNGPYNGLVKEGIQFKSDGSNDEDGKIVSYLWEFGDGSTSAEVNPIHAYEREGIYKVALRVKDDKGKESRNETTVTIKDGSLTESEPNNRPEEANRIGLNTTIKGSLIGGDHTDVYTFNVASTKNIDISVLNEYGIGMTWVLHHESDMKNYAAYGQANGNHIEAKCNAKPGKYYLYVYKYDNGDGTYELSVK

SEQ ID NO: 26704 - protein, 333 aa, Bacillus cereus AH1271
MKGKLLKGVLSFGIGLGVLYGGSSAQAETSTNQNNTLKVMTHNVYMLSTNLYPNWGQSERADLIGAADYIKNQDVVILNEVFDNSASDRLLGNLKKEYPNQTAVLGRSNGNEWDKTLGSYSSSTPEDGGVAIVSKWPIVEKIQYVFAKGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 26705 - protein, 183 aa, Bacillus cereus AH1271
MRKSFILLTFILVLVGVTAACTQDKKDSAVENGPIEEPTAKNENEELINFEEKEDMSRLEQGILLVGESVKGGYYLTAVQNAYLNASNDSVVVNVSVKNVRGQTIGLSELKYNLKDEKDGKAYEGKVLDQNPSDIQVKPNETVELKIAFEVPSTADEYMLYIESSLDPLGARWKIDKLQSQKN

SEQ ID NO: 26706 - protein, 553 aa, Bacillus cereus AH1271
MKRIFSLLLICVLAFSALMNMTVSAESKSTGTLTIHKFEQSKGSKTTTEGNGKEGQTVPEDAKPLEGVTFEIKRIESFEKISNDGTVIKEEAKPVKDATITKVTDAKGEAVFKDLPLGRYEVKAIEGPKHIALDKTTFIVDIPMTSADGKDLNYDVHIYPKNETKRGSVEFVKKGEAGQVLKDAEFHLFKKNKDGTSTQVKTPSSLVTGEDGKVRVDSLEYGDYYYFIEHKAPTGYLTSKEERPFSINESGEVVKLDDIKNYKEPTITKSINNGSKVAGINKETDYTYDVKTLLPEDIKSYKKYVVTDILDDRLEIKGQPIAMVDGKKVEDGIVKVVVEGQKVTATIEDFSKINGKELHLQITAKIKSDVQAGVEIPNKAVLDFVNKDDVSSEKDGKPSNEVVVTPTMGNIKIEKVDGKDKSLKLEGARFELRDKKGNVVTVNKKKMDDITDANGIIIWNEIPYGEYQIVETVAPKYKDEDGAVEQYQKLRDPIDIKIDKDHKVIELQVENNKSGWIIPATGGMGTILFTVVGLMLMVTAMFIFFRKKPEKNS

SEQ ID NO: 26707 - protein, 503 aa, Bacillus cereus AH1271
MFNKKMVAMVMTVPLVMGTISTVSALEKQQQVKLEAYSPQKKATEYLKENAAQYGLKADLSDLQYISTTETSVASYVRFQQVVNGAPVFSKQITVTLNGEGKGVLAVSDYQSVKGVKEVTTKISEKDAIQKSMAYVGEASEQNLWAPTEKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQGLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDNNKVYPKDIKNEVHDDGEIWAQGQYEMAQAFGRDVATKIILQSHWSLTPNSKFSDGAKAIKQADALLYGGQHAADIDRIWAARGISTN

SEQ ID NO: 26708 - protein, 387 aa, Bacillus cereus AH1271
MYEPQSLEAPKGFPQGGPVDGQIASAGGKFGGILDQQTENRWFKNTITGGENSFTWKYTAPHLTSKWHYYITKKGWNSNKSLTRADFEPIGTVQHDGSAASNHLTHKVNVPTDRSGYHVILAVWDVADTANAFYNVIDVNLINDVKPDIEAPSSPNGIQAQKVTANSIELTWNSSTDNVGVKGYQIFRNGEMIDTVPGTHFIDKKLQASTEYSYIVKAIDAAGNVSKESQSLTVKTTVETPDTEAPTQPKGLHSMGTTASSVDLMWSPSDDNIGVDHYDIYRETEGSMKKIATSNATSYMDKNLLPNTTYKYVVKAVDVAGNESVQSDIFVITTKTESASYEEWDAKKAYEKGDRVLHEGKVYEAVQGYKGNGDPNWIYALSLWKTV

SEQ ID NO: 26709 - protein, 384 aa, Bacillus cereus AH1271
MHMKEKRYKNMKTKQTIAASTLALAMIAGANSAHAEVTDATPQQSTGDRLAEIKQHRQELDAKLQQHKENVDQTLNELNQVKENVDTKVNELHERKQVADEKINEMKQRKEELDAKLQQDKQIAEDKIAEMKEHKKQVEDKVAEVKEHKQNIDNKVNEIKEHKQTIDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQAKQTVSDDLTKKKQDLDIKINDFKHTEKKIDDKLAEVHTTKQNVDNKINEVSQSKQTQTDNNNTTVPAKNNARELPNAGSEQSNNMALGMLSVLGGVLLVTRNKIKALFSK

SEQ ID NO: 26710 - protein, 412 aa, Bacillus cereus AH1271
MRKANGIAKSVAVASVIMSGSLGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNYPEWGIYNRDSFNNFYGNQLFMKSRSYNEGTNNFVSKDTVPALTGYGFSPNVVAVITVDKTESTSDLKITNRRISDQYNIEWVSSKWWGTNNKDTYNEFFTNNYKLDWKNHQVTLDNQKALEEQISSIKNVNNQLNKGKGKLSFSMNGNQLKATSSNAGYGISYEDKNWGIFVNGEKIYTFNEKTTVGNISNDINKLNIKGPYIEIKQI

SEQ ID NO: 26711 - protein, 971 aa, Bacillus cereus AH1271
MKGYSKKVLVGVSFASLMLGSFQGSTLAESKKGEQVSYRNVLKMEPVGVQLPVQELAHSSKVLENKSFEKRLQFADLSQRPPEVKKESKQLAAAKTYTIAELNQLSNQQLVDLLVTIDWEQITGLFQFNKDSLAFYQNDSRMQAIIDKLKQQGQAYTKDDSKGIETLVEVLRSGFYLGFYHTELSKLNERSYHDKCLPALKTIANNPDFKLGTLEQNRVVSSYGKLIGNASSDVETITSAAKIFKQYNDNFSTVVDNLSAGNAIYDIMQGVDYDIQSYLYDTRKAPKDTVWYQKIDSYINELSRFALIGTVTAKNGWLINNGIYYTGRLGTFHSTGTKGLQVVTDAMKMYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPSERYTAERTLNAKYGTWDFYNYSFALQSYMYNKRYDMFDKIHDIIRKNDVTAYDAYRSALSKDANLNKEYQDYMQMLVDNREKYNVPLVSNDYLATHAPKPVSDIAAEITAEAKLSNVSVKKNKSQFFNTFTLQGTYTGTTAKGEYEDWKTITQNVNDTLKRLSAKEWTGYKTVTAYFVNYRVNASGQFEYDVVFHGINTEEGAVNKAPVAVINGPYSGNINEAISFKSDGSKDEDGKIVAYKWEFGDGTVSNEQNPTHVYTKEGTYTAKLTVTDDKGLTNTVTTNVTVQKKEDNSVEKEPNNSFQTANKLQLNQVLRASLGNGDTSDFFEINVETAKNLQINVTKENNIGVNWVLYSEADLNNYVTYAQQEGNKLVGSYYTYPGKYYLHVYQYGGGTGNYTVEVK

SEQ ID NO: 26712 - protein, 774 aa, Bacillus cereus AH1271
MLAGATLAIGVIAPQVLPTTAHADENNGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGMIDMQLKKVNGKWEVQKEQSKPQLRPIADSKGNPLVKSDEKLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWTFKPIVADKLNTTFDSSPNAQKYIKKDGKISYVGPSENEFAKYAIDITKKNDDDKETGGENPTTPPTGEGNNGGNPTTPPTGEGNNGGNPTTPPTGEGNNGGNPTTPPTDEGNNAGSGQTTTDNQNSKETTTVSENKEERDLPKTGTSVASTIGAGLAFIGAGLLLLFRRKKANR

SEQ ID NO: 26713 - protein, 43 aa, Bacillus cereus AH1271
MIVALNDVVANAGELIVPASGVPLIVIRELTNNEAVILIVYEI

SEQ ID NO: 26714 - protein, 924 aa, Bacillus cereus AH1271
MKGRDKQNSLNSNFRISPNLIGPTFPPVPTGFTGIGITGPTGPQGPTGPQGSRGLQGPMGEKGPTGPQGVQGIQGLAGQMGATGPEGQQGPQGLRGPQGATGATGPEGVQGLQGPIGPTGATGAQGIQGIQGIQGPIGATGPEGPQGIQGVQGVPGATGSQGIQGPQGIQGPQGPSGNTGATGATGQGITGPTGITGPTGITGPSGGPPGPTGATGATGPGGGPSGSTGATGATGNTGATGSTGITGAAGTTGPTGSTGAQGLQGIQGVQGPIGPTGPEGPQGIQGIPGPTGVTGEQGIQGVQGIQGVTGATGDQGPQGIQGAIGPQGVTGATGDQGPQGIQGVPGPTGETGPQGVQGIQGPMGDIGPTGPEGPEGLQGPQGIQGVPGPAGATGPEGPQGIQGIQGPVGATGPEGPQGIQGIQGIQGVTGATGAQGTTGIQGVQGIQGATGPEGPQGVQGTQGEIGPTGPMGAQGVQGIQGIQGPTGAQGVQGPQGIQGIQGPTGVTGDTGVTGATGEGTTGPTGVTGPTGITGPSGGPAGPTGPTGPSGPAGVTGPSGGPPGPTGATGVTGATGDTGATGLTGVTGATGETGATGVTGLQGPQGIQGVQGIQGPTGPQGVQGPQGIQGVTGATGDQGPQGIQGPQGIQGPTGPQGIQGDQGPQGIQGVTGTTGAQGPQGIQGIQGVQGPTGPQGPTGVQGVQGEIGPTGPQGVQGLQGPQGPTGDTGATGAQGPQGVQGPQGIQGPTGVTGSQGPTGSTGPTGSQGIQGPTGPTGAGATGATGVTGVSTTATYSFANNTSGSAISVLLGGTNVPLPNNQNIGPGITVSGGNTVFTVANAGNYYIAYTINLTASLLVSSRITVNGSPLAGTINSPAVATGSFNATIIANLPAGAAISLQLFGLVAIATLSTTTPGATLTIIRLS

SEQ ID NO: 26715 - protein, 431 aa, Bacillus cereus AH1271
MSTIIDVYAREVLDSRGNPTVEVEVYTESGAFGRAIVPSGASTGEHEAVELRDGDKSRYLGKGVLNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 26716 - protein, 563 aa, Bacillus cereus AH1271
MIEVVKGIREMKKIFSVLLVFFLTFSTWSSVLVKAASPSKGTLTIHKYEQEKDGAPGLEGDGSANQEVPTNAKPLKGVTFEVKRVASFEKISNDGKIVKEDVKPVMGETSTQVVTDDNGQAVLKDLPLGRYEVKEVAGPPHVNLNPNTYTVDIPLTNKEGKVLNYDVHMYPKNEIKRGAVDLVKTGANEKALAGAVFSLFKKDGTEVKKELATDGNGHIRVQGLEYGEYYFQETKAPKGYVLDPTKHEFFIKTSGTINEDGTITSGTVVKVEVQNYAEPNIDKKINGNLEALPINPLTNYNYDIKTLIPEDIKEYKKYVVTDTLDNRLMIQGKPVVKIDGAEVNASIVDVAVEGQKVTATVKDFTKLDGKKEFHLQIKSQVKDGVLSGSEILNTAKIDSINKNDVIGEKESKPVVVVPTTGIIELTKVDGADKKKLKGAEFVLKDKNGKIVVVAGKEVTGVSDENGVIKWTNIPYGDYQIFETKAPTYTKEDGTTASYQLLKDPIDVKISENNQTVKLSIENNKSGWILPVTGGIGTTLFTVLGLALMATAAFVFFRKKFANN

SEQ ID NO: 26717 - protein, 965 aa, Bacillus cereus AH1272
MNKKSKINKVMLSISTMALSLGALQTHASAEEKVPYNVLKTKPVGIEKPVDEVGHISKVDETLSFQERLQVGDFSQRPASIMKSSEVKQVKESYSMADLNKMNNQELVETLGSIKWNQIADLFQFNEDAKAFYKDKGKMQAVIDELAHRGSTFTKEDSKGIQTFTEVLRSAFYLAFYNNELGELNERSFQDKCLPALKAIATNPNFKLGTYEQDSVVSAYGKLISNASSDVETVQYAANILKQYNDNFHTYVDDRMKGQAVYDMMQGIDYDMQSYLFETRKEAKDTMWYGKVDGLINEINRIALLNQVTSENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLVEHAPKALTEVKKEISDTLSMKDTKMTKHTPQFFNTFTLEGTFTGSVTKGESADWKTMSKRVNEALEQLTQKEWSGYKTVTAYFVNYRVNSLNEFEYDVVFHGIAKDDGENKAPTVNVNGPYNGGVKEGIQFKSDGSNDEDGKIVSYLWDFGDGRTSKEVNPVHAYEREGTYKVALRVKDDKGKESRSETTVTIKDGSLTESEPNNRPEEANHIGLNTTIKGSLIGGDHTDTYTFNVASAKDIDISVLNEYRIGMTWVLHHESDMQNYAAYGQANGNHIEAKFNAKPGKYYLYVYKYDNGDGTYALSVK

SEQ ID NO: 26718 - protein, 333 aa, Bacillus cereus AH1272
MKSKLLKVVLSFGMSLAALYSGSSVQAEMSTNQNDTLKVMTHNVYMLSTNLYPNWGQSQRADLIGAADYIKNQDVVILNEVFDNSASNRLLGNLKKEYPNQTAVLGRSSGSEWDKTLGNYSSSTPEDGGVAIVSKWPIVEKIQYVFEKGCGPDNLSNKGFVYTKVKKNDRFVHVIGTHLQAEDSMCGNTSPASVRTKQLQEIQEFIKNKNIPNNEYVLIGGDMNVNKINAENNSDSEYASMFKTLHASIPSYTGHTATWDATTNSIAKYNFPDSPAEYLDYIIASKDHANPSHIENKVLQPKSPQWTVTSWFKKYTYDDYSDHYPVESTISMK

SEQ ID NO: 26719 - protein, 183 aa, Bacillus cereus AH1272
MRKSFILLTLILVLVSVTAACTQDKKDSTVENGPIEEPTAKNENEELINFEEKENMSRLEQGILLVGESVKGGYYLATVQSAYLNANNDSVVVNVSVKNVRGQTIGLSELKYNLKDEKDGKAYEGKVLDQNPSDIQVKPNETVELQIAFEVPGTADEYMFYIESSLESLEAHWKIDKLQSQKN

SEQ ID NO: 26720 - protein, 503 aa, Bacillus cereus AH1272
MLNKKMVAMAMTVPLVMGTISTVSALEKQQQVKLEAYSPQKKAIEYLKGHATEYGLKADLSDLQYISTTETSVASYVRFQQVVNGAPVFSKQITVTINGQGQGLLAVSDYQAVQSVKEIANKISEKDAEQKSMAYVGGESEQNLWAPTEKEFGYIIEDGVAIPVYKVLVHSNKPFGAWETFIDAENGKLIKKVDINRKAEGSGKVFLPNPVVSSGSKVGLKDNNDADSTALTNQLKTVTLKGLDGSGSLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACVGEWDATAYSSSDPTCLRRLDTNKVYPKDVTNEVHDDGEIWAQGQYEMAQAFGRDVATKIILQSHWSLTPNAKFRDGAKAIKQADALLYGGQHAAEIDRIWAARGISTN

SEQ ID NO: 26721 - protein, 458 aa, Bacillus cereus AH1272
MNLKLTSKLEKLRKSKKGIGACVLAAGVAAITMIPQSTYAHGFVEKPSSRAALCSQNYGALNLNCGNVMYEPQSLEAPKGFPEGGPINGKIASAGGLFGGILDQQTSNRWFKNTIKGGANTFTWKYTAAHSTSKWHYYITKKGWDPNKPLTRADLEPIGTVKHDGSAASNNVTHTINVPTDRNGYHVILAVWDVADTSNAFYNVIDVNLVNNETPDTVAPSQPTGLNASKVSANSVALTWKASTDNIGVKEYQVLRNGEVIDTVPGTTFIDKKLKANTEYTYTIKALDSAGNISKESEKLKVKTTNGIPDIEAPTQPKGLHSMGTTATTVDLMWSPSEDNVGVDHYVVYRENAGVMNKIGTTDNTSFVDKNLKANTSYKYVVTAVDLAGNESSRSNVLAVTTKLEDSTYEKWDARKAYTKGDRVVYEGKVYEAVQSYQGNGDPNWIFALSLWKPVLNK

SEQ ID NO: 26722 - protein, 378 aa, Bacillus cereus AH1272
MKTKQTIAASTLALAMIAGSTPTHAEVNDATPQQSTGDRLAEIKQHRQELDAKLQQHKENVDQTLNELNQVKENVDTKVNELHERKQVADEKIGEIKQHKQELDAKLQQDKQIAEDKIAEIKEHKKQVDDKVAEIKEHKQNIDNKVTEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQEARQDLLNKINEMKQAKQTVSDDLSKKKQDLDIKINDFKHTEKKIDDKLAELHTTKQNVDNKINEVSQPKQTTVNSNTTTTPSTVPAKNNAKELPNAGSEQSNNMALGMLSILGGILLVTRNKIKTLFSK

SEQ ID NO: 26723 - protein, 410 aa, Bacillus cereus AH1272
MALPLPLVGAIGPAGNSGPTGPTGGHEGPVGPPGITGPRGATGPQGPQGIQGIQGPRGTTGAQGIQGAVGDTGAQGVTGPIGLQGSQGLIGNQGPTGPQGIQGLQGIQGPIGPTGPTGPQGIQGITGSTGPTGLTGATGPTGATGPQGIQGIQGPQGVTGQAGATGPTGATGPQGVQGIQGPQGITGQAGATGATGVTGPQGIQGIQGPQGVTGSTGATGATGVTGATGPTGLQGIRGATGATGQAGVTGPTGATGPTGLTGATGSSAISTGGGYFFSTSTSAIAANANIPINSGSTVYGAGVSLTSATTVTVSTPGIYLVSYYFQGDASAGNETVSVRLLLNGSQLTGSFIQNVTTSTVVIEPAISNTLLVNVASANSTLILQNGPLGVGHVTTIAGAITASLNVVRIL

SEQ ID NO: 26724 - protein, 166 aa, Bacillus cereus AH1272
MNEQYIILHGPALEPNLIGPTLPPIPPFTFPTGPTGITGPTGATGFTGIGITGPTGFTGPTGIGITGPIGITGPTGIGITGPTGVTGPTGTTGLGILPVFGAITSEIGIGFSVVVNTNINFTVPGPVSGTTLNLVDNSITINTTGVYSVSFSIVFAIQAISSSLVY

SEQ ID NO: 26725 - protein, 39 aa, Bacillus cereus AH1272
MASLIRTRRTSPWFKGNRSVLADVALTPDPPPTRDSIAN

SEQ ID NO: 26726 - protein, 971 aa, Bacillus cereus AH1272
MKGYSKKVLVGVSFASLMLGSFQGSILAEDTKGEQVSYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTKDDSKGIETLVEVLRSGFYLGFYNAELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTVWYQRIDSYINELSRFALMGTITEKNGWLINNGIYYTGRLGIFHSTGTKGLQVATDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKLYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSALSQDANLNKEYQDYMQMLIDNREKYNVPLVSDDYLATHAPKPVSDIAAEITAEAKLSNVSVKKNKSQFFNTFTLQGTYTGTSAKGENEDWKTITQNVNDTLKRLSAKEWTGYKTVTAYFVNYRVNASGQFEYDVVFHGINTEEGAVNKAPIAVINGPYNGNVNEAISFKSDGSKDEDGKIASYKWEFGDGAVSNEQNPTHVFTKEGTYTAKLTVTDDKGLTNTATASVTVQKKEDNSVEKEPNNSFQTANKLQLNQLLRASLGNGDTSDYFEINVETARNLQINVTKENNIGVNWVLYSAADLNNYVTYAQTQGNKLVGSYNAHPGKYYLHVYQYGGGTGNYTVEVK

SEQ ID NO: 26727 - protein, 790 aa, Bacillus cereus AH1272
MLAGATLAIGVIAPQVLPTTAQAEEKAGESTVNLRILETSDIHVNLMNYDYYQTKTDNKVGLVQTATLVNKAREEAKNSVLFDDGDALQGTPLGDYVANKINDPKKPVDPSYVHPLYRVMNLMKYDVISLGNHEFNYGLDYLNKVISKTEFPVINSNVYKDDKDNNEENDQNYFKPYHIFEKEVEDESGQKQKVKIGVMGFVPPQVMNWDKANLEGKVKAKDIVQTAKKMVPKMKEEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQKLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPAKTEEQPLVNIGYPTYNFDILDGLKYEIDVTQPAKYDKDGKVVNGNTNRIVNMTYEGKPVADNQEFIVATNNYRGSSQTFPGVSKGEVVYQSQDETRQIIVKYMQETPIIDPAADQNWTFKPIVADKLNTTFDSSPNAQNHIKKDGKISYVGPSENEFAKYAIDITKKNDDKETGGENPTTPPTGEGNNGENPTTPPTGEGNNGENPTTPPTGEGNNGENPTTPPTGEGNNGENPTTPPTGEGNNGNNAGSGQTTTDNQNSKETTTVSENKEERDLPKTGTSVVSTIGAGLAFIGAGLLLLFRRKKANR

SEQ ID NO: 26728 - protein, 955 aa, Bacillus cereus AH1272
MVKSVKERDDKRKLHSLNSNFRISPELIGPTFPPAPTGFTGIGITGPTGPQGPTGPQGPRGLQGPMGEIGPTGPQGVQGIQGPAGQMGATGPEGQQGPQGLRGPQGETGATGPQGVQGLQGPIGPTGAIGAQGIQGIQGLQGPIGATGPEGPQGIQGVQGVPGATGSQGIQGAQGFQGPQGPSGSTGPTGATGQGVTGSTGITGPTGVTGPSGGPPGPTGATGATGPGGGPSGSTGATGATGNTGVTGSAGETGNTGPTGSIGETGAQGPQGIQGIQGPIGPTGPEGPQGIQGIPGPTGLTGEQGIQGIQGIQGITGATGDQGPQGIQGAIGPQGVTGATGDQGPQGIQGVPGPTGETGPQGVQGIQGPMGDIGPTGPEGPEGLQGPQGIQGVPGPAGATGPEGPQGIQGIQGPIGVTGPEGPQGIQGIQGIQGVTGATGAQGPQGVQGIQGDIGATGPEGPQGVQGAQGDIGPTGPMGPQGVQGIQGIQGPTGAQGVQGPQGIQGIQGPTGVTGDTGTTGATGEGTTGATGVTGPTGVTGPSGGPAGPTGPTGPSGPTGVTGPSGGPPGPTGVTGVTGELGDTGVTGATGVTGATGETGATGATGLQGPQGIQGVQGDIGPTGPQGVQGPQGIQGVTGSTGNQGPQGNQGPQGIQGPTGPQGIQGDQGPQGIQGATGATGAQGPQGIQGIQGVQGPTGPQGPTGIQGVQGDIGPTGPQGVQGLQGPQGPTGDTGPTGAQGPQGIQGPTGVTGATGSQGIQGPTGVTGATGSQGIQGPTGATGSQGPTGSQGIQGPTGPTGPTGAGATGSTGATGVTGVSTTATYAFANNTSGTAISVLLGGTNIPLPNNQNIGPGITVSGGNTVFTVANAGNYYIAYTINLTAGLLVSSRITVNGSPLAGTINSPAVATGSFSAPIIANLPAGAAVSLQLFGLVAIATLSTTTPGATLTIIRLS

SEQ ID NO: 26729 - protein, 154 aa, Bacillus cereus AH1272
MIFQGTNAGFQRIAGSPGIDSNVIPYVTAGAGNIVGFAASININNLPAAVYTIDICKNVPTNLSAPTSGYILSTITLTTTDKITGTMTFSIKPTDIGSRQPQVYNPTPAPGPATVTWTSITTGNPVSRGDAISLYITPGITASAVYSIFLITDI

SEQ ID NO: 26730 - protein, 95 aa, Bacillus cereus AH1272
MAKKEEAIKAGQKNDTAKKEVTPQVQEKEALAKKEEAIKAGQKNDAAKKEVAKPAVQGEKLPNTASNNVAMMALSACLVGIGTLFGLKRRNKVKA

SEQ ID NO: 26731 - protein, 80 aa, Bacillus cereus AH1272
MKNKKEEKASLPSKPNKPTPSGEVKPSTDVKPVKQPNTHNEVRLPATGGVGNEFTSLFVLGISFIIAGAYVLRMKNRKEM

SEQ ID NO: 26732 - protein, 431 aa, Bacillus cereus AH1272; identical to SEQ ID NO: 26106

SEQ ID NO: 26733 - protein, 399 aa, Bacillus cereus AH1272
MDEFLSFSSVNPNLVGPTLPPIPPFTLPTGPTGNTGPTGPTGSTGDTGPTGPTGPTGPTGSTGSTGPTGPGCIEPLPIFTQIVYVNKAGNDVTADGSECAPFLTVTAAMASITDAIAPFPDPLNITKRYAIKIGPGTYIEPLIHLKANIQLIGTSTLLTRLQIPFDINDPTWFDLNFSQDPRSGFVNLSLISGPLDFNFQTAQSVSGKLFFVSVNITPTPIFTALSTSVNQVNIRDSMLSAGYTQNGINMVMFASFVSNGNITINSQATTDTQVNLVGGGINGNVIINVQSGHIPIDPLNLTSFAITENIFNPSPNSGNLNVNGVNNVITRVRATVDSLPIRSRITLIGTNTSLIRVDDAFDLAYAPINPINWAAPPPTTVQEALDRIASLLAGTIGTP

SEQ ID NO: 26734 - protein, 182 aa, Bacillus cereus AH1272
MNKKLVASLLCSTFLFGLSACGSHDTSSSNTKNEQETSKETKNDELSDKDPQKEFPTSGNSSDVYISIGPVDSLDVIGNGEVQAQGVFKVLDVRVHNDKEEPITLHSDNFTLIDGTGREYHISNEYQLVLKAANTATFKFGVLNPHENSEGNIVFDVPKNTQGLTLKVSGDMLGKGIELKVE

SEQ ID NO: 26735 - protein, 314 aa, Bacillus cereus AH1272
MEIEVENAEYVLPLNGLTGGISKDKVLKSKVSVKTKGDEMLEISPYLFTLYQGDEKMKKYDKADLDKLRLIELEPGKKVSGTLYYEVNKASSYELVYSNEETKKRDEETEKVSFKIDTKEIEKNTKDLNKPAEALKAYINAIYYDKDIDKINKLSGENGKQFTENILKEFKKDATSSTHNEISDQEFESYYKKLKSVLQEKVTFKVKSAGSSPEEDKVEVELKVKPLLLSELQPKLNKENERLLRENPGIEQSKLFSQSFDYFISILPEAKVSDKEKVIKVEMERYGKDQWRFSKDKVSDAEDIMEIMGEFLKQ

SEQ ID NO: 26736 - protein, 456 aa, Bacillus cereus AH1272; identical to SEQ ID NO: 26566

SEQ ID NO: 26737 - protein, 965 aa, Bacillus cereus AH1273; identical to SEQ ID NO: 26717

SEQ ID NO: 26738 - protein, 333 aa, Bacillus cereus AH1273; identical to SEQ ID NO: 26718

SEQ ID NO: 26739 - protein, 182 aa, Bacillus cereus AH1273; identical to SEQ ID NO: 26734

SEQ ID NO: 26740 - protein, 183 aa, Bacillus cereus AH1273; identical to SEQ ID NO: 26719

SEQ ID NO: 26741 - protein, 503 aa, Bacillus cereus AH1273; identical to SEQ ID NO: 26720

SEQ ID NO: 26742 - protein, 439 aa, Bacillus cereus AH1273
MDEFLSFSSVNPNLVGPTLPPIPPFTLPTGPTGNTGPTGPTGSTGDTGPTGPTGPTGPPDGPTGSTGPTGPTGPTGPTGPTGSTGDTGPTGPTGPTGPTGSTGSTGPTGPGCIEPLPIFTQIVYVNKAGNDVTADGSECAPFLTVTAAMASITDAIAPFPDPLNITKRYAIKIGPGTYIEPLIHLKANIQLIGTSTLLTRLQIPFDINDPTWFDLNFSQDPRSGFVNLSLISGPLDFNFQTAQSVSGKLFFVSVNITPTPIFTALSTSVNQVNIRDSMLSAGYTQNGINMVMFASFVSNGNITINSQATTDTQVNLVGGGINGNVIINVQSGHIPIDPLNLTSFAITENIFNPSPNSGNLNVNGVNNVITRVRATVDSLPIRSRITLIGTNTSLIRVDDAFDLAYAPINPINWAAPPPTTVQEALDRIASLLAGTIGTP

SEQ ID NO: 26743 - protein, 458 aa, Bacillus cereus AH1273; identical to SEQ ID NO: 26721

SEQ ID NO: 26744 - protein, 378 aa, Bacillus cereus AH1273; identical to SEQ ID NO: 26722

SEQ ID NO: 26745 - protein, 410 aa, Bacillus cereus AH1273; identical to SEQ ID NO: 26723

SEQ ID NO: 26746 - protein, 166 aa, Bacillus cereus AH1273; identical to SEQ ID NO: 26724

SEQ ID NO: 26747 - protein, 39 aa, Bacillus cereus AH1273; identical to SEQ ID NO: 26725

SEQ ID NO: 26748 - protein, 971 aa, Bacillus cereus AH1273; identical to SEQ ID NO: 26726

SEQ ID NO: 26749 - protein, 790 aa, Bacillus cereus AH1273; identical to SEQ ID NO: 26727

SEQ ID NO: 26750 - protein, 955 aa, Bacillus cereus AH1273; identical to SEQ ID NO: 26728

SEQ ID NO: 26751 - protein, 380 aa, Bacillus cereus AH1273
MYQRNCFSCDGRRNGGSIGITGPTGATGSTGSTGSTGSTGSTGSTGSTGATGPTGTAGAGLQSTTAFSLAAAPNYKTGQVVTYTSSGYVVKKDAPQGFPNVSPDYIVLVEAGPTGSTGTTGPTGSIGITGPIGATGSIGITGPTGVTGSTGTTGPTGVTGSTGTTGPTGVTGSTGTTGPTGVTGSTGTTGPTGVTGSTGTTGPTGVTGSTGTTGPTGTAGSSSAKSMIFQGTNAGFQRIAGSPGIDSNVIPYVTAGAGNIVGFAASININNLPAAVYTIDICKNVPTNLSAPTSGYILSTITLTTTDKITGTMTFSIKPTDIGSRQPQVYNPTPAPGPATVTWTSITTGNPVSRGDAISLYITPGITASAVYSIFLITDI

SEQ ID NO: 26752 - protein, 154 aa, Bacillus cereus AH1273
MALLTVGYSSVASASTGTLTKEESAQMQQDKAKKEEAIKEQQKSEVEKKEAAQVQEKSDMAKKEEAIKAGQKNDTAKKEVTPQVQEKEALAKKEEAIKAGQKNDAAKKEVAKPAVQGEKLPNTASNNVAMMALSACLVGIGTLFGLKRRNKVKA

SEQ ID NO: 26753 - protein, 80 aa, Bacillus cereus AH1273; identical to SEQ ID NO: 26731

SEQ ID NO: 26754 - protein, 431 aa, Bacillus cereus AH1273; identical to SEQ ID NO: 26106

SEQ ID NO: 26755 - protein, 456 aa, Bacillus cereus AH1273; identical to SEQ ID NO: 26566

SEQ ID NO: 26756 - protein, 120 aa, Bacillus cereus AH1273
MEIEVENAEYVLPLNGLTGGISKDKVLKSKVSVKTKGDEMLEISPYLFTLYQGDEKMKKYDKADLDKLRLIELEPGKKVSGTLYYEVNKASSYELVYSNEETKKETRKQKKFLSKLIRRK

SEQ ID NO: 26757 - protein, 949 aa, Bacillus cereus AH603
MALSLGAIQTNVSAEEKVPYNVLHSKPVGIEKPVDEIGHASKAEETLSFQERLKVGDFSQRPASIMKSSEVKQIKESYSMADLNKMNDQELVETLGSIKWHQITDLFQFNEDAKAFYKDKGKMQVIIDELAHRGNSFTKDDSKGIQTFTEVLRSAFYLAFYNNELSDLNERSFQDKCLPALKAIAKNPNFKLGTVEQDTVVSAYGKLISNASSDVETVQYASNILKQYNDNFNAYVDDRMKGQAVYDMMQGIDYDIQSYLNEARKEANETMWYGKVDGFINEINRIALLNEVTPENKWLVNNGIYFASRLGKFHSNPNKGLEVVTQAMHMYPRLSEPYFVAVEQITTNYNGKDYSGNMVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDTYRETLSKDPKLNKEYQAYMQQLIDNQDKYNVPEVADDYLTEHAPKSLTEVKKEISETLSMKDTKMTKHESQFFNTFTLEGTFTGSVTKGESEDWNAMSKRVNEALEQLAQKEWSGYKTVTAYFVNYRVNSSNQFEYDVVFHGIAKDDGENKAPTVNINGPYNGLVKEGIQFKSDGSNDEDGKIVSYSWEFGDGRTSTEVNPVHAYEREGTYKVALRVKDDKGKESRSETTVTIKDGSLTESEPNNRPEEANRIGLNTTIKGSLIGGDHTDVYTFNVASAKDIDISVLNEHGIGMTWVLHHESDMQNYVAYGQANGNRIEAKFNAKPGKYYLYVYKYDNGDGTYALSVK

SEQ ID NO: 26758 - protein, 333 aa, Bacillus cereus AH603
MKGKLLKGALSFGIGLGALYSGSSAQAETSVNQNNTLKVMTHNVYMLSTNLYPNWGQNERADLIGAADYIKNQDVVILNEVFDNSASDRLLGNLKREYPNQTAVLGRSSGNEWDKTLGNYSSSTPEDGGVAIVSKWPIVEKIQYVFEKGCGPDNLSNKGFVYTKVKKNDRFVHVIGTHLQAEDSMCGNTSPASVRTKQLQEIQEFIKNKNIPNNEYVLIGGDMNVNKINAENNSNSEYASMFKTLHASVPSYTGHTATWDATTNSIAKYNFPDSPAEYLDYIIASKDHANPSYIENNVLQPKSPEWSVTSWFQKYTYNDYSDHYPVEATISMK

SEQ ID NO: 26759 - protein, 371 aa, Bacillus cereus AH603
MAYVGGESEQNLWAPTEKEFGYIVEEGVAIPVYKVVVHSNNPFGAWETFIDAENGKLIKKVDINRKAEGTGKVFLPNPVVSSGSLAGLKDNNDADSTALTNQLKTVTLKGLDGTGFLIGEYVTISSKAKTKSTNLQFNYTRANDSFEDVMSYYHIDTLQRYIQGLGFQNINKRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDATAYSSSDPTCLRRLDTNKVYPKDITNEVHNDGEIWAQGQYEMAQSFGRDVATKIILQSHWSLTPNAKFRDGAKAIKQADALLYGGQHATEIDRIWAARGISTN

SEQ ID NO: 26760 - protein, 458 aa, Bacillus cereus AH603
MNLKLTSKLERLRKSKKGIGACVLAAGVTAITMIPQSAYAHGFVEKPSSRAALCSQNYGALNLNCGNVMYEPQSLEASKGFPEGGPIDGEIASAGGLFGGILDQQTSNRWFKNTIKGGENTFTWKYTAAHSTSKWHYYITKKGWDPNKPLTRAELEPIGTVKHDGSAASNNLTHIINVPTDRNGYHVILAVWDIADTSNAFYNVIDVNLVNNEIPDTVAPSQPIGLNASKVTANGIELTWKASTDNVGVKEYQVLRNGEVINTVPGTTFTDKKLKANTEYTYTIKALDAAGNISKESEKLKAKTTNEIPDKEAPTQPKGLHSMGTTATTVDLMWSPSEDNVGVDHYIVYRESAGVMNKIGAADNTSFMDKDLKANTSYKYVVTAVDLAGNESSRSNVLAVTTKLEDSTYEKWDARKAYNKGDKVVHEGKVYEAVQSYQGNGDPNWIFALSLWKPVLNK

SEQ ID NO: 26761 - protein, 553 aa, Bacillus cereus AH603
MKKILSVLLVVFLTFSAWSSVLVKAASPTKGSLTIHKYEQEKDGTTGVEGDGSANQEVPTNAKPLKGVTFEVKRVVSFEKISNDGKIVKEDVKPVTGATPSKVVTDDNGQAVLKDLPLGRYEVKEVAGPPHVNLNPNTYTVDIPLTNKEGKVLNYDVHMYPKNEIKRGAVDLIKTGANDKGLAGAAFSVFKKDGTEVKKELVTDANGHIRVQGLEYGEYYFQETKAPKGYVIDPTKREFFIKNSGTINEDGTITSGTVVKVEVKNYEEPTIDKKINGNLEALPINPLTNYNYDIKTLIPEDIKEYKKYVVTDTLDNRLVIQGKPIVKIDGAEVNASIVDVAVEGQKVIATVKDFTKLDGKKEFHLQIKSQVKEGVPSSSEILNTAKIDFTNKNDVIGEKESKPVVVVPTTGIIELTKIDGDDKKKLKGAEFVLKDKNGKIVVVAGKEVIGVSDENGVIKWSNIPYGDYQIFETKAPTYTKEDGTTASYQLLKDPINVKISENNQSVKLAIENNKSGWILPVTGGIGTTLFTVLGLALMVTAAFVFFRKKFANK

SEQ ID NO: 26762 - protein, 455 aa, Bacillus cereus AH603
MNNRILKHLQNMKMNKKSLGAVVLTAGIIGTTLIPQNAYAHGFVEKPGSRSALCSPTYGALNVNCGSVMYEPQSLEAPKGFPQAGPVDGQIASAGGKFGGILDQQTADRWFKNTITGGENTFTWKFTAPHLTSKWHYYITKIGWNPNKALTRADFEPIGTVQHDGSAASNNVAHKINVPTDRNGYHVILAVWDVADTANAFYNVIDVNLINNVKPDTEAPSIPNGLQAQKVTANSIELTWNTSTDNVGVKGYQVFRNGEMIDTVLGTHFINKQLKPSTEYTYTVKAIDAAGNLSKESTALTVKTTVEAPDTEAPTQPKGLHSMGTTASSVDLMWSPSDDNVGVDYYDIYREIEGTMKKIATSNTTSYMDKNLLANTTYKYAVKAVDVVGNESVQSDTFTITTKTESASYEAWDAKKAYKKGDRVLHEGKVYEAVQNYEGHGDPNWIFALSLWKTV

SEQ ID NO: 26763 - protein, 362 aa, Bacillus cereus AH603
MKTKQTIAASTLALAMIAGSTPTHAEVNEATPQQSTGDRLAEIKQHRQELDAKLQQHKENVDQTLNELNQVKQTVDEKANELHQHKQELDAKLQQDKQIADEKTAEIKEHKKHVDEKVAEIKEHKQTVDEKVNEIKEHKQTVDEKVNEIKQHKENIDQKVNELKEVKKQVDVKLAELKKAKQTAEDRLAEIKENKPNTGNTLEELKKIKGNLDSLSSNLELAKQDVKNKLAELQEARQNLENKLNELKQSKQTVSDDLTKKKQDLDIKINDFKHTEKKIDDKLAELHTTQQNVDNKITEVSQPKQTTANNNNTTVPAKNNARELPNAGSEQSSNMALGMLSVLGGVLLLTRNKIKKVFIKQL

SEQ ID NO: 26764 - protein, 971 aa, Bacillus cereus AH603
MKGYSKKVLVGVSFASLMLGSFQGSILAEDTKGEQVSYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTKDDSKGIETLVEVLRSGFYLGFYNAELSKLNERSYHDKCLPALKTIANNPNFKLGTLEQNKVVSSYGKLIGNASSDVETITSAAKIFKQYNDNFSTLVDNLSAGNAIYDIMQGVDYDIQSYFYDTRKAPKDTVWYQRIDSYINELSRFALMGTITEKNGWLINNGIYYTGRLGTFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSDIAAEITAEAKLSNVSVKKNKSQFFNTFTLQGTYTGTSAKGEYEDWKTITQNVNDTLKRLSAKEWTGYKTVTAYFVNYRVNASGKFEYDVVFHGINTEEGAVNKAPVAVINGPYSGHTNEAISFKSDGSKDEDGKIASYNWEFGDGAVSNEQNPTHVYTKEGTYTAKLTVTDDKGLTNTATTSVTVQKKEDNSVEKELNNSFQTANKLQLNQVLRASLGNGDTSDYFEINVETAKNLQINVTKENNIGVNWVLYSEADLNNYVTYAQQQGNKLVGSYYTYPGKYYLHVYQYGGGTGNYTVEVK

SEQ ID NO: 26765 - protein, 97 aa, Bacillus cereus AH603
MSGGNTVFTAANAGNYYISYTINITASLLVSSRITINGAPLAGTINSPALATTSFSATIITTLAAGSAISLQLFGLLAVATLSTTTPGAVLTIIRLS

SEQ ID NO: 26766 - protein, 900 aa, Bacillus cereus AH603
MGEMGPTGPQGVQGIQGPAGQMGATGPEGQQGPQGLRGPQGETGATGPQGVQGLQGPIGPTGATGAQGIQGIQGLQGPIGATGPEGPQGIQGVQGVPGATGSQGIQGTQGIQGPQGPNGNTGATGATGQGISGPTGITGPTGITGPSGGPPGPTGATGATGPGGGPSGSTGATGATGNTGVTGSAGVTGNTGPTGSTGETGAQGLQGIQGVQGPIGPTGPEGPQGIQGIPGPTGVTGEQGIQGVQGIQGITGATGDQGPQGIQGAIGPQGITGATGDQGPQGIQGVPGPTGDTGSQGVQGIQGPMGDIGPTGPEGPEGLQGPQGIQGVPGPAGATGPEGPQGIQGIQGPIGVTGPEGPQGIQGIQGIQGITGATGAQGAAGVQGVQGNIGATGPEGPQGVQGTQGDIGPTGPMGPQGVQGIQGIQGPTGAQGVQGPQGIQGIQGPTGVTGDTGTTGVTGEGTTGATGVTGPTGVTGPSGGPAGPTGPTGPSGPTGVTGPSGGPPGPTGATGVTGGVGDTGATGATGVTGATGVTGATGATGLQGPQGIQGVQGDIGPTGPQGVQGPQGIQGITGATGDQGPQGIQGPQGIQGPTGPQGIQGGQGPQGIQGATGATGAQGPQGIQGIQGVQGPTGPQGPTGIQGVQGEIGPTGPQGVQGLQGPQGPTGDTGPTGAQGQQGIQGPTGATGAQGPQGPQGIQGPTGATGATGPQGIQGPTGATGATGSQGIQGPTGVTGATGSQGIQGPTGATGATGATGVTGVTGVSTTATYAFANNTSGTAISVLLGGTNIPLPNNQNIGPGITVSGGNTVFTVANAGNYYIAYTINLTAGLLVSSRITVNGSPLAGTINSPAVATGSFSAPIIANLPAGAAISLQLFGLVAIATLSTTTPGATLTIIRLS

SEQ ID NO: 26767 - protein, 431 aa, Bacillus cereus AH603
MSTIIDVYAREVLDSRGNPTVEVEVYTESGAFGRAIVPSGASTGEHEAVELRDGDKSRYLGKGVLNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYAGLQSFYNIKR

SEQ ID NO: 26768 - protein, 787 aa, Bacillus cereus AH603
MKFIKGIFVSTIALTAFTGLELIKLHENPNVVYADSKGPVKNISQSEADIKEEDQIIVKFKSEVNFPYKDGLEKQIKNEDSDLELVKIFSEFPQLTLKRLFTSVDPKEIENIDKDTRETENNSSSNLLDYYIVEVPNKVTAETLMDKFKKSYLVEEVYMQEKPTLLPEVQLPTVSLNPYDDPRFLNQGYLKEAPYGINASYAWSIKGGDGKGTTFVDMEYGWLLDHEDLVNQKVELISGRNIDQHVGHGTSVLGIVSAEDNKIGNIGIAPKAKVKVVSQIRGDGSYNTADAIINAVHNLQAGDILLLEAQASYDGYGDKYLPVEVQPDIFDAIRAGTDKGIIVIEAGANGSNDLDQFRDRNGKQVLNRNSPDFKDSGAIMIGAASSTVPHKRLWFSNYGSRIDVYGWGENVDTTRAEPNRITKNLYTTGFSGTSSASPIIAGAATSIQGVAKEHLGRPYKPAELRNILSNQNTGTKSQNPLTDKIGVLPDLKSILSNLGYSPDISNNVLEGNQFVWSMKGIGDFEFAKLDFNKTKEEMQIQLKAGVPHHYFDSTYASVKVQNSSGKVVYNKDIYGNRQQNAETQKIPMKVGDYIEFTHLEGGNRATLINVDKNTQESFGKKIVYQVTVNGLKKVDQIINPSPDTEAPTWPEGLQAANITANSVELKWNSSTDNVGVKEYQVLRDGRFIQTVQGTTFTDSKLIANMEYKYTVKAIDAAGNQSIQSSVLSIKTKEQNTSYEKWDPRKAYTKGDRVEYQGKIYEAVQSYQGNGDSNWIFSLSLWKPISIS

SEQ ID NO: 26769 - protein, 209 aa, Bacillus cereus AH603
MLKKFTTCILGGALVFNLSGCGNTSDKTSSESKETNSKQEEKKVQTTDEAKTKENTKQKNTEQTKEKSKIKEKEYAVNKDFHTPKFDVTVKRVVERDKVGKESIGFQKPEDGHVFIVVEAEGKNITNEPMKLAVLPSVDLVDENDNAYQSDVWAASSYGVEKGETSTITKELKPGEVRRESKVYVINKEKFDTGKWYVLVNHEYKEQIK

SEQ ID NO: 26770 - protein, 183 aa, Bacillus cereus AH603
MRKLFILLTLILVLASVTDACTQDKKDSAVENGPIEEPTAKNENEELINFEEKEDMSRLEQGILLVGESVKGGYYLATVQSAYLNANNDSVVVNVSVKNVRGQTIGLSELKYNLKDEKDGKAYEGKVLDQNPSDIQVKPNETVELKIAFEVPSTADEYMFYIESSLDPLGAHWKIDKLQSQKN

SEQ ID NO: 26771 - protein, 456 aa, Bacillus cereus AH603
MNKKILKQLRKMTTNKKGLSAAVVAVGIMSTTLIPQNAYAHGFVEKPGSRAALCSQNYGALNLNCGNVMYEPQSLEAPKGFPQGGPVDGKIASAGGLFGGILDQQTADRWFKNTIKGGENTFTWKYTAPHLTSQWHYYITKKGWDPNKPLTRADFEPIGTVKHDGSAASNNLSHKINVPTDRSGYHVILAVWDVADTVNAFYNVIDVNLVNNEKPDTEAPTQPSGLQVVKATSNSVELNWKPATDNVGVKEYQVLRNGEVINTVAGTSLVDKKLSPNTDYTYTVKAVDAVGNISKESEALVIKTTVEKPDTEAPTQPKGLHSMGIAANTVDLMWSPSEDNIDVDHYIVYREIAGVTKEIGTVNTTSFIDKNLQANTTYKYVVSAVDTAGNESMKSDILTVTTKEQENAYEKWDSYKAYKKGDRVVHEGKEYEAAQSYQGNGDPNWIFALSLWNEIK

SEQ ID NO: 26772 - protein, 748 aa, Bacillus cereus AH603
MKRGQQQKTKNLVMITATLSMFATGITPSLEVFAEEQAQQKKVSTTLQNENSVNVENGVFAVPGKGDVSQLQNIERRERNFSAYEPTGLYAKLNEQITIQVQGNQSIQAYIGTFSFDASWREDSKIKSFTLNPGTNTIQSPNGGMIYFYNKQQGGTIQTTVITGGTATPLFELGKHTKQDLINMLNQYPNAHAVELKGERVLITASPVRVKKYLIDSNTDPVQLLKKMDEATRIQDKISGLSEEQVDKHYLHYVEDNHSLDYYMYAYPHRTAYVGDAIQHVLDINKFTNDGWGPWHEAGHMRQQTPWNFKNMTEVQVNLYSLAVEKAFTSNQPFRLQQEGAYTKAFQYLEQPNKNYDDISDLFVKVVMLWQLQLAYGEDFYPKLHQLYRDMPSNEIPQTDETKKQLFMISASKAAKQNLIPFFEKWGLRPNNDTIQKVAALGYPNLTAEIWKSTDSNPVKPDTPNFSNILEGNQFAWSLKGIGDFEFAKVNLNKSTEEMQIDLKAGVPHNYFDSTYASIKVQNTSGKVVYNKEIYGNKQQNAEQAKVPVKVGNFIEFTHLEGANRATITNMEKNIQESFGNKAVYEITKEGLKKVDKIVNPKPDTEAPTQPQGLYASNVTSNSVELKWNSSTDNVGVKEYQVLREGQLIQTVQGTMFTDQNLTANKEYKYAVKAVDAAGNTSIQSNILPIKTKDQNVSYEKWNPKKAYTKGDKVEHQGKVYEAVQNHQGNGDPNWIFALSLWKPLTIN

SEQ ID NO: 26773 - protein, 639 aa, Bacillus cereus AH603
MFSMFGTSISHTKAVTRSAAPSVYVSPQNTASSDIISIDWSPVQTAPYTYWAVHNWNAGGEAGGYAGFQQQSGSDEKGKRTLHFALWDPIASKEAIKAEYLSPNSQAGLFGGEGTGLKVQTTYGWKDHNWYRMTMRSWQENGHTKFGQWMKDVTKNKWHLIAIMDFPVANVAFNHGLGMFQEDWAGNGQDVREARLKNGYSRKLLDKQWNSWNNQSISGQHDTSYQYDGGATSEYVWVKAGGNTQSTIGTGKIFTLNQPTQPEIGKLDFDIQSIYYENEKLNVSWKLKENSTPQFKGKIEIYNDENMTGQPIEIIDNIKSYQSEISQSILLSTNAYAKIILTDLFDQTVEKKVQIKNESPNILEGNEFAWSLKGIGDFEFAKVNLNKSTEEMQIDLKAGVPHHYFDSTYASIKVQNTSGKVVYNKEVYGNKQQNAESKTVPVKVGDFIELTHLEGEERATLINLDNNKHESFDKKVMYEVTKDGLKKVNQIVNPKPDTEAPTQPQGLYASNVTSNSVELKWNPSSDNVGVKEYQVLRDGQLIQTVQGTTFTDQNLKVNKEYKYAVKAVDTAGNTSNQSNILLIKTKDQNVSYEKWDPRKAYTKGDKVEHQGKVYEAVQNHQGNGDPNWIFALALWKPLT

SEQ ID NO: 26774 - protein, 949 aa, Bacillus cereus AH621
MALSLGAIQTNVSAEEKVPYNVLHSKPVGIEKPVDEIGHASKAEETLSFQERLKVGDFSQRPASITKKSAVKQAKESYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNEVTPENKWLVNNGIYFASRLGKFHSNPNKGLEVVTQAMHMYPRLSESYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHTSQFFNTFTLEGTFTGSVTKGESEDWKAMSKRVNEALEQLTQKEWSGYKTVTAYFVNYRVNSSNKFEYDVVFHGIAKDDGENKAPTVNVNGPYNGFVKEGIQFKSDGSKDEDGKIVSYLWDFGDGRTSKEVNPVHAYEREGTYKVALVVKDDKGKESRSETTVTIKDGSVTESEPNNRPEEANRIGLNTTIKGSLIGGDHTDVYTFNVASAKDIDISVLNEYGIGMTWVLHHESDMQNYAAYGQANGNHIEAKFNAKPGKYYLYVYKYDNGDGAYALSVK

SEQ ID NO: 26775 - protein, 333 aa, Bacillus cereus AH621
MKGKLLKGVLSFGIGLGVLYGGSSAQAETSTNQNNTLKVMTHNVYMLSTNLYPNWGQSERADLIGAADYIKNQDVVILNEVFDNSASNRLLGNLKKEYPNQTAVLGRSSGSEWDKTLGSYSSSTPEDGGVAIVSKWPIVEKIQYVFAKGCGPDNLSNKGFVYTKIKKDDRFVHVIGTHLQAEDSMCGKNSPASVRTNQLKEIQDFIKNKNIPNDEYVLFGGDMNVNRINAENNSDSEYASMFKTLHASIPSYTGHTATWDATTNSIAKYNYPDAPAEHLDYIIASKDHANPSFVENNVLQVKSPKWSVTSWFKKYTYDDYSDHYPVEATISMK

SEQ ID NO: 26776 - protein, 209 aa, Bacillus cereus AH621
MLKKFTTCILGGALVFNLSGCGNTSDKTSSESKETNSKQEEKKVQTTDEAKTKENTKQKNTEQTKEKSKIKEKEYAVNKDFHTPKFDVTVKRVVERDKVGKESIGFQKPEDGHVFIVVEAEGKNITNEPMKLAVLPSVDLVDENDNAYQSDVWAASSYEVEKGETSTITKELKPGEVRRQNKVYVINKEKFDTGKWYVLVNHEYKEQIK

SEQ ID NO: 26777 - protein, 212 aa, Bacillus cereus AH621
MQHLIHIKKNIDLLNHYGTHESTFILEEQTMNKKLLTSLLCSTFLFGLSACSSHDTSSSNTKNEQETSKETKNDELSNKDPQKELPTHGDSSDVYISIHSADSLDVIGNGEVKAQGVFKVLDVAVYNRQEEPITLNNNNFKLIDGTGREYHISNESQLVLKAANTATFKFGVLNPNENSEGNIVFDVPKNTQGLTLKINGDMLDEGIELKVE

SEQ ID NO: 26778 - protein, 1111 aa, Bacillus cereus AH621
MTSLHNKIKENKKILNVFVVVMSLFLLLSQLQFFKPMDRVRAEVTDEEGFDTPTYQSIHKGDMYSTGNVNLGIKATEAQKQTALYSDITYTYGTTPNSYTRELIDVDDDPTTTNSSKAYIPVPEDAEIEWAGLYWSSTRYELTQQQYVAPVKFTTPAGKSFQVSPSNTYYGSGLLYGFGIDGTYYSNYTDVTGLLKSSSAKGGSYTVANIPYPNTKLAYNSGYYSFAGWYMLVITKDKSKTRKAFTVYDGGLKRATGSGEKEFTMKNFIASKTGDLDPKVSVFAVQGDRYWQGDKLFVHTDNTWKEVTDKLNPTGNIFNSTISEYEEHMRDKYPGTFNPDYKNNLGVDADLIKLPAGYIKPNQKEIRLKAATSGDDYVLNTLAFAVNATAPELVIDKEVIDTKEKYDPGDEVTYRLRVKNIEPNSSSVDTKIEDVLDSRLEFVPDSVKIISGPNAGDQTEQVDYNAKTRKLTIRIGEGANATKGGIYTDKTPETTVEFKAKLRGEKVETEIPNIAVVQGIDELTGSQVEANDSNKVVVKVLPEREEKHGKLIATKLAKDINGGTLKVGDKLEYTIHTKNSVPDSLLKSVKITDKLPEGVEYVPNTLKINGKEQTDVEDEDHAHIKNGTIYAHFGDLKGEEEKAITFEIVVKPEMANKKVKNIAIVETDSSADKEKPEVETPVDPLSGQLESKKEIIDMRQEKVHVNDEFEYQIKVRNKVENGLIKDMRLMDKLPEGVEYVAGSMKVNGNLLTDAVDEDAGAYEDNTIKVNFGDVLDTEERMVTFKVKVTQDALKTKEIENIAVVEGKTPDNEDLPPQKPNVKTHVEAKEPKVSKMVSDADEIEVEKATLQSVGEEFTWHVNYNFGNDVMNLEKVVLQDDLEDILTILQVQLVNSDGEAIEVIPQIDEQLKNVSIELPKRDGNYNYLANQSYTMHIKSMLNANVNADIVTKYNANGGIPNKAELLFDQKKSVSNEVFVVPPTLGGFEIEKVDANDENLKLEGAVFEVISKGGNIVCKLTTDKDGLATSTPLIVGKYTLKEVQAPKGYMLMREPVEIEMKPGMNSQKIRVVNKKSEFVIPETGGTGTIIYYVMGGILMFVTLFLFVRKRNSER

SEQ ID NO: 26779 - protein, 553 aa, Bacillus cereus AH621
MKKIFSLFLIGMLAFSTLSNMIVSAESRSTGTLTIHKFEQSKDAKTTSEGNGKEGQIVPEDAKPLEGVTFEIKRIESFEKISNDGTVIKEEENPVKDAAITKITDAKGEAVFKDLPLGRYEVKAIEGPKHIALDKTTFIVDIPMTSADGKDLNYDVHIYPKNETKRGSVELMKKGEGDKVLPDAEFHLFEKNKDGTSTQVKTPKPLVTGTDGKIRVESLEYGDYYFIEEKAPKGYLTSKEEYPFAIKETGKLVKLEKDVKNYKEPTIEKTINDSSKNAGINRETEYTYDIKTLLPEDIQTYKNYVVTDVLDDRLEVVGTPIVMIDGKKVDESIVNVIVAGQKVIASVEDFSKVTGKELHLQITAKMKSDVQSGVEIPNKAVLDFVNKDDISSEKDGKPSNEVLVTPTMGNITIEKIDGKNKNLKLEGARFELRDKKGNVVTVNKKKIDDITDANGIITWNEIPYGEYQIVETVAPKYKDEDGSVEQYQKLRDPIEIKIDEKHPKIELQVENNKSGWIIPATGGIGTIFFTVVGLLLMVTAAFIFFRKKPVKNS

SEQ ID NO: 26780 - protein, 503 aa, Bacillus cereus AH621
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGEGKGLLAVSDYQPVTGVKEVTKKISEKDAEQKSMAYVGGESEQNLWAPTEKEFGYIVEEGVAIPVYKVVVHSNNPFGAWETFIDAENGKLIKKVDINRKAEGTGKVFLPNPVVSSGNLAGLKDNNDADSTALTNQLKTVTLKGLDGTGFLIGEYVTISSKAKTKSTNLQFNYTRANDSFEDVMSYYHIDTLQRYIQGLGFQNINKRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDATAYSSSDPTCLRRLDTNKVYPKDITNEVHNDGEIWAQGQYEMAQSFGRDVATKIILQSHWSLTPNAKFRDGAKAIKQADALLYGGQHATEIDRIWAARGISTN

SEQ ID NO: 26781 - protein, 444 aa, Bacillus cereus AH621
MKMNKKSLGAVALTAGIIGTTLIPQNAYAHGFVEKPGSRSALCSPTYGALNVNCGSIMYEPQSLEAPKGFPQVGPVDGQIASAGGKFGGILDQQTTERWFKNTITGGENTFTWKYTAPHLTSKWHYYITKKGWNPNKALTRANFEPIGTVQHDGSAALNNLNHKINVPTDRSGYHVILAVWDVADTANAFYNVIDVNLVNNEKPDTEVPSNPNGLEATKVTANSVELAWTASTDNVGVKGYQVLRNGEIIDTVPGTHFIDKQLQPSTEYSYTVKAIDAAGNVSKESTAVKVKTSVAILDTKAPTQPKGLHSMGTTASSVDLMWSPSDDNDGVDHYDIYREISGVMKKIGTSNTTSHMDKNLLANTTYKYAVKVVDVAGNESIQSDVFTVTTKTESASYEAWNSKKAYKKGDRVVHEGKVYEAVQNYQGNGDPNWIYALSLWKTV

SEQ ID NO: 26782 - protein, 455 aa, Bacillus cereus AH621
MNNRFLKQLQNLKMNKKSIGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINNVKPDTEAPSIPNGIQAQKVTANSIELTWNTSTDNVGVKGYQVFRNGEMIDTVLGTHFINKQLKPSTEYTYTVKAIDAAGNVSKESTALTVKTTVEAPDTEAPTQPKGLHSMGTTASSVDLMWSPSDDNVGVDYYDIYREIEGTMKRIATSNTTSYMDKNLLANTTYKYAVKAVDVVGNESVQSDTFTITTKSESASYEAWDAKKAYKKGDRVLHERKVYEAVQNYEGHGDPNWIFALSLWKTV

SEQ ID NO: 26783 - protein, 384 aa, Bacillus cereus AH621
MYMKEKRYKNMKTKQTIAASTLALAMIAGANSAHAEVTDATPQQSTGDRLAEIKQHKQELDAKLQQHKENVDQTLNELNQVKENVDTKVNELHERKQVADEKIGEIKQHKQELDAKLQQDKQIAEDKIAEIKEHKKQVDEKVAEIKEHKQTVDEKVNEIKEHKQTVDEKVNEIKQHKENIDAKVNELKEVKKQVDDKLAELKKAKQTAEDKLAEIKENKPNTGNTLEELKKIKGNLDSLSSNLELAKQDVKNKLAELQEARQDLLNKINEMKQAKQTVSDDLTKKKQDLDIKINDFKHTEKKIDDKLAELHTTKQNVDNKINEVSQSKQTQTDNNNTTVPANNNARELPNAGSEQSNNMTLGMLSVLGGILLVTRNKIKTFFSK

SEQ ID NO: 26784 - protein, 311 aa, Bacillus cereus AH621
MALPLPLEGATGPTGNSGPTGPTGGHEGPVGPPGITGPRGATGPQGPQGIQGIQGPQGITGQAGATGSTGVTGPQGIQGPQGATGATGTTGATGVTGSQGIQGVQGPQGVTGSTGATGSTGSTGATGPTGIQGIRGVTGVTGATGSTGVTGPTGATGLTGSTGATGSSAISTGGGYFFSTSTSTIVANANIPINSGSTVYGTGVSLTSATTVTVSTPGIYLVSYYFQGDASGGNETVSVRLLLNGTQVTGSFIQNVTTSTVVIEPAISNTLLVNVASANSTLILQNGPLGVGHVTTIAGTITASLNVVRIL

SEQ ID NO: 26785 - protein, 971 aa, Bacillus cereus AH621
MKGYSKKVLVGVSFASLLLGSFQGNISAEDTKGEKVSYRNVLKMEPVGVQLPVQELAHSSKVLESKSFEKRLQFADLSQRPPEVKKESKQLAVAKTYTIAELNQLSNQQLVDLLVTINWEQITGLFQFNKDSLAFYQNDSRMQAIIDKLKQQGQAYTKDDSKGIETLVEVLRSGFYLGFYNAELSKLNERSYHDKCLPALKSISQNQNFKLGTLEQNKVVSSYGKLIGNASSDAETISSTANIFKQYNDNLSTFIDNRSAGNAVYDIMQGVDYDIQSYLYDTNKAPKDTMWYQKIDSYINELSRFALMGTITAKNGWLINNGIYYTGRLGMFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSDIAAEITAEAKLSNVSVKKNKSQFFNTFTLQGTYTGTAAKGENEDWKTITQNVNDTLKRLSAKEWTGYKTVTAYFVNYRVNASGQFEYDVVFHGINTEEGAVNKAPVAVINGPYSGHTNEAISFKSDGSKDEDGKIISYKWELGDGTVSNEQNPTHVYTKEGTYTAKLTVTDDKGLTNTATTSVTVQKKEENSVEKEPNNSFQTANKLQLNQVLRASLGNGDTSDFFEINVETAKNLQINVTKENNIGVNWVLYSEADLNNYVTYAQQQGNKLVGSYYTYPGKYYLHVYQYGGGTGNYTVEVK

SEQ ID NO: 26786 - protein, 118 aa, Bacillus cereus AH621
MLLGGTNVPLPNNQNIGPGITVSGGNTVFTAANAGNYYISYTINITASLLVSSRITINGAPLAGTINSPALATTSFSATIITTLAAGSAISLQLFGLLAVATLSTTTPGAVLTIIRLS

SEQ ID NO: 26787 - protein, 928 aa, Bacillus cereus AH621
MKERDRQNSLNSNFRISPNLIGPTFPPVPTGFTGIGITGPTGPQGPTGPQGPRGFQGPMGEMGPTGPQGVQGIQGPAGQMGATGPEGQQGPQGLRGTQGETGATGPQGVQGLQGSIGPTGATGAQGIQGIQGLQGPIGATGPEGPQGIQGVQGGPGATGSQGIQGAQGIQGPQGPSGNTGATGATGQGISGPTGITGPTGITGPSGGPPGPTGATGATGPGGGPSGSTGATGATGNTGVTGSAGVTGNTGPTGSTGETGAQGLQGIQGVQGPIGPTGPEGPQGIQGIPGPTGVTGEQGIQGVQGIQGITGATGDQGPQGIQGAIGPQGITGATGDQGPQGIQGVPGPTGDTGSQGIQGIQGPMGDIGPTGPEGPEGLQGPQGIQGVPGPAGATGPEGPQGIQGIQGPIGVTGPEGPQGIQGIQGIQGITGATGAQGATGVQGVQGNIGATGPEGPQGVQGTQGDIGPTGPMGPQGIQGIQGIQGPTGTQGVQGPQGIQGIQGPTGVTGDTGTTGATGEGTTGATGVTGPSGVTGPSGGPAGPTGPTGPSGPTGVTGPSGGPSGPTGATGVTGGVGDTGATGATGVTGATGVTGATGATGLQGPQGIQGVQGDIGPTGPQGVQGPQGIQGITGATGDQGPQGIQGPQGIQGPQGIQGPTGPQGIQGGQGPQGIQGATGATGAQGPQGIQGIQGVQGPTGPQGPTGIQGVQGEIGPTGPQGVQGLQGPQGPTGDTGPTGAQGPQGIQGPTGATGSQGPTGGTGPTGSQGIQGPTGATGATGATGATGATGVTGVSTTATYSFANNTSGSAISVLLGGTNIPLPNNQNIGPGITVSGGNTVFTVTNAGNYYIAYTINITAALLVSSRITVNGSPLAGTINSPAVATGSFSAPIIANLPAGAAISLQLFGLVAIATLSTTTPGATLTIIRLS

SEQ ID NO: 26788 - protein, 164 aa, Bacillus cereus AH621
MKKKLLPICAMALLTVGYSSVASASTGTLTKEESAQMQQDKAKKEEAIKEQQKSEVEKKEAAQVQEKSDMAKKEEAIKAGQKNDTAKQEVTPQVQEKEALAKKEAVIKAGQKNDAAKQEVAKQAVQGEKLPNTASNNVAMMALSACLVAIGTLFGLNRRNKIKA

SEQ ID NO: 26789 - protein, 431 aa, Bacillus cereus AH621; identical to SEQ ID NO: 26715

SEQ ID NO: 26790 - protein, 456 aa, Bacillus cereus AH621
MNKKILKQLRKMTTNKKGLSAAVVAVGIMSTTLIPQNAYAHGFVEKPGSRAALCSQNYGALNLNCGNVMYEPQSLEAPKGFPQGGPVDGKIASAGGLFGGILDQQTADRWFKNTIKGGENTFTWKYTAPHLTSQWHYYITKKGWDPNKPLTRADFEPIGTVKHDGSAASNNLSHKINVPTDRSGYHVILAVWDVADTVNAFYNVIDVNLVNNEKPDTEAPTQPSGLQVVKATSNSVELNWKPATDNVGVKEYQVLRNGEVINTVAGTSLVDKKLSPNTDYTYTVKAVDAVGNISKESGALVIKTTVEKPDTEAPTQPKGLHSMGITANTVDLMWSPSEDNIDVDHYIVYREIAGVTKEIGTVNTTSFIDKNLQANTTYKYAVSAVDTAGNESMKSDILTVTTKEQENAYEKWDSYKAYKKGDRVVHEGKEYEAAQSYQGNGDPNWIFALSLWNEIK

SEQ ID NO: 26791 - protein, 795 aa, Bacillus cereus AH621
MANEKKVQAGSVDSYVQADAIMTEDKNSVRKQNGLMGNFYGDNDFKNLLLIRGNSCVNEQVTSNEIRDLRLKSSQKIQSVRWQGFIQPKEDGVYTFSTGKHDQVMIQVDNCIVVDNIGRETEIKLQKDKLYKIIVEYQVNPDVEDAFTLLWGTEEKKEVVPHEVLYAPSLAQKDQPTVIGSLHQLKYAVNDFIREEKDTDGDNIPDSWEYEGYTVVDGEFGVKDLVKWDDKIHQGLVKYTSSPMKWSTSDDPDSDYEKVTGLQMDTRVTKEAHHPLVAAYPDVHINMEKYLLIPNTNFQAGEGGSSSKQVTRGTSNTVSNTESWGVTVTANASLLDFGGSVSASYESSTTTSTTKDESVSDSTTKDWNEVLGINTAEAGKILPNVRYVNTGTAPVFKVKPQFTLHFPKTTNGDAISLISSLIGETHKGLEVLPGNTYPDKSKPPLAFDKPTHFGESLMLDQGNVSRLQKNDILKLETNGIESNVVLIDTQGQDYESSLEWTNVISKIKANTAEIVFTTVGGPVTKRNVAARGTTPVEQTVPEMTFKEALKLSYSAIEKNGKLCINDREITKDNVSLIVDQATEAEMKKQGVTSIFNVKLKARMHFEMTEKVNVTIETDSNQTNFNIKIPSGLFEGSTLEMFMNGAKKGEQKLEKGATTWSGPVSNYGIHADEVKEQTNTFELKIKGRTVATLKGLYEGYKETQVAHKFSDWNYIGSWSKNGLYFQTITSNILNKITHYKYKLEDGPTNTIPKPAPQADGRLLISFGGSTLRSGKLLQIYAINKNGVEITVIEIRG

SEQ ID NO: 26792 - protein, 746 aa, Bacillus cereus AH621
MGDNSKNKTRKMLAATATVTMLATGMISSSDVFAEERQQQKKLSTSLQEEKSVKSENRTYTVPGKGDVEVLKQQERKSMAFSPYEPTGLYAKPNEQITINVEGNQDIQAYIGTYSYDASWREDSKIKSFTLKPGINTIQSPNGGMIYFYNKQQGGTIRTTVTTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYAYPYRTAYVGDAIQYVLDINKFVKDGWGPWHEAGHLRQQWPWNFYNMTEVQNNIYSLSVEKAFNQPSNLEKSGIYPKAFQYLEQTNKNYDEISDVFVKLVMLWQLQLAYGEDFYPNLHQLYRDMPSNELPQTDENKKQLFMISASKVVKQNLIPFFEKWGLRPNNDTIQKVTALGYPILTAEIWKGTDSNPIKPDMPNGNNILEGKQFAWSLKGISDFEFAKINFNKSTEEMQIDLKAGIPHHYFNETYASIKVQSASGKVVYNKDIYGNEQQNAESQKVPVKVGDFIELTHLEGVHRATFMNVDNSKQESFGKKAIYEVTKDGLKKVNQIVNPKPDTEAPTQPQELYASNLTSNSVELKWNPSTDNVGVKEYQILRDGQLIQTVQGTTFTDQNLTANKEYKYAVKAVDAAGNTSIQSNILSVKTKDQNVSYEKWDPKKAYTKGDKVEHQGKVYEAVQNHQGNGDQNWIFALSLWKPITIK

SEQ ID NO: 26793 - protein, 458 aa, Bacillus cereus AH621
MNLKLTSKLERLRKSKKGIGACVLAVGVTAITMIPQSAYAHGFVEKPSSRAALCSQNYGALNLNCGNVMYEPQSLEAPKGFPDGGPIDGKIASAGGLFGGILDQQTSNRWFKNTIKGGANTFTWKYTAAHSTSKWHYYITKKGWDPNKPLTRAELEPIGTVKHDGSAASNNLTHTINVPTDRNGYHVILAVWDVADTSNAFYNVIDVNLVNNEAPDTVAPSQPTGLNASKVSANSVELTWKASNDNIGVKEYQVLRNGEVIGTVPGTTFTDKKLKANTEYTYTIKALDAAGNISKESEKLKVKTTNETPDKEAPTQPKGLHSMGTTATTVDLMWSASEDNVGVDHYVVYRESTGVMNKIGTADNTSFMDKDLKTNTSYKYVVTAVDLAGNESSRSDVLTVATKLEDSTYEKWDARKAYNKGDKVVHEGKVYEAIQSYQGNGDPNWIFALSLWKPVLNK

SEQ ID NO: 26794 - protein, 397 aa, Bacillus cereus AH621
MDEFLSFSSVNPNLVGPTLPPIPPFTPPTGPTGNTGPTGPPDGPTGSTGPTGDTGPTGPTGSTGPTGPGCIEPLPIFTQIVYANKAGNDVTADGSECAPFLTVTAAMASITDAIAPFPDPLNITKRYAIKIGPGTYIEPLIHLKANLQLIGTSTLLTRLQIPFDINDPTWFDLNFSQDPRSGFVNLSLISGPLDFNFQTAQSVSGKLFFVSINITPTPIFTALSTSVNQVNIRDSMLSAGYTQNGIIMVMFASFVSNGNITINSQATTDTQVNLVGGGINGNVIINVQSGHIPIDPLNLTSFAITENIFNPSPNSGNLNVNGVNNVITRVRATVDSLPIRSRITLIGTNTSLIRVDDAFDLAYAPINPINWAAPPPTTVQEALDRIASLLAGTIGTP

SEQ ID NO: 26795 - protein, 738 aa, Bacillus cereus AH621
MKQLKPAISVLGSVSMALTLASPALADVKQPNKGGTVEIFKENANVKKEDKNFTLGSDGEIGSLITQNIEMANNDWDKDGISNDLEINGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRVYTPKDKSLADNPVLSYNEVFQQVNIDTKKVNHIVNKAKSTNNVSVVSANNGTDALNDLKAGQGDRGYLHKDSVHGAFAKLQQPTLVEGSYDSVTQKIRATILPGLFGVSKDIPTTYSKKWNAPSQTVTLVKRENGFTYESRENIHPIKSEIAAHRKVTFEINDAHNLTPTQKIDTEIKANKEFEDYVVDNSGEFVTEGVPYTVASYGNTAYLGSHHAGNKWEYLWAEKSSDEKVNVIIERVGQPKPGKPIKKDEEVLIKFQNPIYSDYAYLKLQDSYIHLDQKQNASTFKFNHAYPKNFTGHHKQWNILSNGNKLKVGYLIDYMKYGNGENGTDTIAWNLSRVQ

SEQ ID NO: 26796 - protein, 163 aa, Bacillus cereus AH676; identical to SEQ ID NO: 26509

SEQ ID NO: 26797 - protein, 949 aa, Bacillus cereus AH676
MALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDMQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDTYTVPEVADDYLAEHETKSLAAVKKEISDTLPMKDTKMTKHNSQFFNTFTLEGTYTGSVTKGESEDWKEMSKRVNESLEQLAQKEWSGYKTVTAYFVNYRVNSSNEFEYDVVFHGIAKDDGENKAPTVNINGPYSGLVKEGIQFKSDGSNDEDGKIASYLWEFGDGSTSAEVNPVHVYEREGSYKVSLRVKDDKGKESRSETTVTIKDGSLTESEPNNRPEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYSLSVK

SEQ ID NO: 26798 - protein, 333 aa, Bacillus cereus AH676; identical to SEQ ID NO: 26499

SEQ ID NO: 26799 - protein, 181 aa, Bacillus cereus AH676
MNKKLLASLLCSTFLFGVSACSSHDAPAKNEQATSKKTENDKLSNKDSQKELPTNVDSSDVYMSMGSAESLDVLGTGEVKAQGVFKVLDIAVYNRKEEPITLDINNFKLIDGFGREYHISNEHQSVLKAANTSTFKFGIVNPDEHSDGNIVFDVPKNTRGLTLKFNNDKLDKELQLKVELE

SEQ ID NO: 26800 - protein, 361 aa, Bacillus cereus AH676
MPEVLSLKIENEMVDTGNVEITKIDKDNKAPLAGVVFEVQDDKGKVVTKVTTDKAGKATVSDLSVGKYKLVEVESLPGYKKLEKPVPFEITKGMSKSLAFTVENEMVDTGNVEITKIDKDSKAPLENVVFEVRDSKGKVVAKVTTDKEGKANVSDLSVGKYKLVETKSLPGYKKLTEPVSFEITKGMTKVLSLKVENEQLDKGAVEITKMAAESKEVLSGAVFEVHDEKGKVVVKVTTDKDGKAKITDLSVGNYTLVEVEAPKGYEKLTNPIPFEITNGMINAVQLEVLNKLNHLAPPGPETPDPEKPGTPDPEKQGTPNPEKPEKELPKTGQKMPVEPYMGALLVMMSFGLLVLGRKQQR

SEQ ID NO: 26801 - protein, 336 aa, Bacillus cereus AH676; identical to SEQ ID NO: 26375

SEQ ID NO: 26802 - protein, 503 aa, Bacillus cereus AH676
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASGQNLWAPTDKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26803 - protein, 572 aa, Bacillus cereus AH676
MKKIIFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSIISGLSSDPASRYTAKQTLFAKYGSWDFYKYSFALQSYLYNHQFDTFDKLQDLIRANDVKNYDAYRELLSKNTQLNAEYQAYMQQLTDNQGKYNVPQVTNDYLIQHAPKPLAEVKNEIVDVANIKDAKITKHESQFFNTFSVEGTYVGGISKGESEDWKTMSKQVNQTLEQLSQKGWSGYKTVTAYFVNYRVNAANQFEYDIVFHGVATEEKEKTTTIVNMNGPYSGIVNEEIQFHSNGTTSENGKVISYLWNFGDGITSTKANPTHIYGEKGTYTVELTVKDSRGKESIEQTKVTVKQDPQTGGSLEEEKILPFNTLVKGNLVTPDQTDVYTFNVTDPKEVEISVVNEQNIGMTWVLYHESDMQNYVACGEDEGNTIKGKFVAKPGKYYLNVHKFDDKNGEYSLLVK

SEQ ID NO: 26804 - protein, 893 aa, Bacillus cereus AH676
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLMAQGGTHNGVNVNGIGEDRMFDIFYYANTDELNMTSNFSELKLACLKVATNKYGANSIEVQAVQNAFDAAKITGTVKENEKTAENQAPELTVPFTITLRVGDTFDPMRNVKAVDKEDGDLTNKVKHKGDVDTSKPGTYIVEYMVVDSQGRNATATQTVIVEGNGETSDLEPKLTVPVGATIHVGDSFVPMAEVLAIDKEDGDLTSKIKVDGEVDTTKAGTYVLTYTVTDSKGHEVTAKQTVTVKVREEVKNDKPILKVPATTSITEGDQFDPLVGVSATDKEDGDLISKVAYEGTIDTTKAGTYEIIYSVRDSVGNEVNAIQKVLVKDKETSKANGLANKENKSNISNNSNSDKKEYTYKELPKTGVSTTNSAAIGILMIITGTVLTFVRKFRKIQK

SEQ ID NO: 26805 - protein, 563 aa, Bacillus cereus AH676
MIEVVKGIREMKKIFSVLLVFFLTFSTWSSVLVKADSPSKGTLTIHKYEQEKDGAQGLEGDGSANQEVPKDAKPLKGVTFEVKKVASFEKISNDGKIVKEDVKPVMGATPNQVVTDDNGQAVLKDLPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPTIDKKINGKLEALLINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEVFNTAKIHFTNKNDVIGEKESKPVVVIPTTGIIELTKIDGANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 26806 - protein, 457 aa, Bacillus cereus AH676
MNMNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVLGTHFIDKKLQLSTEYSYTVKAIDAAGNVSKESAALTVKTTVETPDTEAPTQPKGLHSMGTTASSVDLMWSPSDDNIGVDHYDIYRETEGAMNKIATSNTTSYLDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 26807 - protein, 380 aa, Bacillus cereus AH676
MHMKEKRYKNMKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNDNAKELPNAGSEQSNNMALGMLSVLGGILLLTRNKIKTLFSK

SEQ ID NO: 26808 - protein, 91 aa, Bacillus cereus AH676
MDKELKANTSYKYVVTAVDLAGNESSRSDVLDVTTKAEDSTYEKWDARKAYTKGDRVVYEGKVYKAVQGYQGNGDTNWIFALSLWKPVLSK

SEQ ID NO: 26809 - protein, 837 aa, Bacillus cereus AH676
MLVKNQDKCSKFQAPIPFPPPGITGPTGPTGPTGALGGPTGPQGIQGVQGPIGPTGPQGIQGVQGVQGENGPTGPTGLTGPQGSQGNQGPMGERGPQGIQGVQGIQGERGPTGPTGIQGIQGIPGPIGPTGPTGIQGIQGMQGEIGPTGPTGIQGIQGVQGEIGPTGPTGNTGIQGVQGNLGGSGLQGVTGIQGIQGPIGPTGPTGSQGIQGEQGPIGPQGETGVQGLQGPQGEMGQVGPTGIQGIQGVQGVIGPTGPTGLQGDPGPTGPTGATGITGPTGSATGPTGATGPTGPPGGPTGPTGPAGSPGGPTGPTGATGATGATGATGATGIQGVQGIQGPTGATGVTGLQGVQGPMGATGPTGDQGIQGPQGIQGVTGPTGPQGLQGIQGPVGATGPTGPQGVQGAQGPIGPTGPQGIQGIQGEQGVRGATGPTGLQGLQGIQGPSGSTGPQGVQGIQGPSGITGPTGPQGIQGIQGPQGSIGPTGPQGIQGVQGPQGPTGEAGATGPQGIQGIQGPIGPTGPQGIQGIQGVQGPQGPTGQAGPQGLQGITGQAGPTGPTGEAGATGPQGPQGIQGPQGATGPTGATGETGATGSQGPQGIQGPQGITGPTGATGPTGATGPQGPQGIQGPQGVTGQAGATGQTGVTGATGPTGIQGIQGIQGITGATGGTGVTGPTGATGPTGLTGATGPSAISTGGGYFFSTSTSAIAANANIPINSGSTVYGTGVSLTSPTTVTVSTPGIYLVSYYFQGDASAGNETVSVRLLLNGAQLTGSFIQNVTTSTVVIEPAISNTLLVNVTSANSTLILQNGPLGVGHVTTIAGAITASLNVVRIL

SEQ ID NO: 26810 - protein, 822 aa, Bacillus cereus AH676
MALPLPLIGATGPTGNSGPIGPTGGHEGPVGLTGVTGPTGATGPQGPQGIRGIQGPRGTTGAQGIQGVIGDTGEQGITGLTGLQGAQGLIGNQGLIGDIGVQGLEGIQGATGPAGSQGIQGIQGIQGEIGERGQTGAQGMQRERGVTGVSGVTGPQGPQGVQGIQGEQGAIGIQGEDGFQGIQGITGEEGPQGAQGIQGEVGPTGSTGMQGAQGISGIKGITGVIGLQGPQGVQGIQGITGATGFQGIKGIRGITGATGSIGTQGSEGPPGGPTGVTGGPSSGVTGPAGPPGPPGGPTGPTGATGSTGVSGGIGPIGGQGVQGITGPTGHQGVRGAQGAQGVVGAVGVQGAQGPQGNQGITGPTGAEGSQGIQGPLGVTGPTGAEGPKGIQGIQGVIGPTGAQGMVGIQGVAGPVGVTGAEGAQGAQGIRGATGPAGAQGIQGVQGIQGETGAAGTQGPQGVQGIQGTTGLTGTQGAQGPQGVQGIIGPTGAIGLQGPQGLQGITGPTGAQGVQGIQGVQGIIGPTGAQGIRGPQGNTGEIGITGPQGVQGAQGSQGPQGPQGNVGITGATGETGATGATGATGPQGVQGVQGITGIQGITGTTGNTGATGPQGIQGIQGVQGLQGPTGASGVTGASGSIGPVGAQGSQGPSGVVGPTGATGSAGSIGFFGIAGATGATGLPSGGGYFFSTLTSTIAANALIPINSGSTVFGSDVSLTNATTVTLSTPGIYLVSYYFQGDPTAGNETISVRLTLNGTQVAGSFIFYVTGGTFILEPAVSNTMVIEVTSSNATLSLQNGPLAIGHVTTLSGVITASLNVLKIV

SEQ ID NO: 26811 - protein, 916 aa, Bacillus cereus AH676
MIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLIKVQAIAYRGTDTVQNATVLLERNEEKLSSDLAVNWEAAGSLKIKKVGENGEVLAGAVFEVFNVNNESVGKITTGADGMAELNNLPIGTYTLKEIKAPTGYVSDDKPQTIEVKTGETGAVQIVNNKVKGSIEIKKLSDSGKILPNVEFTVFTEDGKEVKKVVTKENGIANVEGLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIETKATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGSKELDISKSVTIQDKVEYKDLIAGKEYVVKGKLMDKATNKPLLVDGKEVTVESKFTAKEKNGSITLDFTFNASALQGKEVVVFEELYQDNILVAIHAEIEDKGQTVKFKEVKPEQPKPEQQNSDKNTPTPEQPNEQVKEQPQPKQEIQSKIGWLPQTGTNLTSWISMVAGALLLIVGGVIFLKRKNA

SEQ ID NO: 26812 - protein, 971 aa, Bacillus cereus AH676
MKGYSKKMLVGVSFASLMLGSFQGGSLAEDTKGEQVSYRNVLKMEPVGIQLPVQELAHSSKVLESESFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLENGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSVKEWTGYKTVTAYFVNYRVNASGQFEYDVVFHGIDTEEGAENKAPVAVINGPYSGNVNEAISFTSNGSKDEDGKIISYKWEFGDGAVSNEQNPTHVYTKEGAYTAKLTVTDDKGATNTATATVTVQKKEDNSVEKEPNNSFQTANKLQLNQVLRASLGNGDTSDFFEINVENAKNLQINVTNENNIGMNWVLYSEADLNNYVTYAQQQGNKLVGSYYTYPGKYYLHVYQYGGGTGNYTVEVK

SEQ ID NO: 26813 - protein, 769 aa, Bacillus cereus AH676
MLAGATLAIGVMAPQVMPATAHADENTGESTVNLRILETSDIHVNLMNYDYYQTKTDNKVGLVQTATLVNKAREEVKNSVLFDDGDALQGTPLGDYVANKIKDPKNPVDPSYTHPLYRVMNLMKYDVISLGNHEFNYGLDYLNKVIEKTDFPVINSNVYKVDHDDKEENDENYFKPYHILKKEVVDEAGQKQIVKIGVMGFVPPQIMNWDKANLEGKVKAKDIVATAKIMVKKMQDEGADIIVALAHSGVDKSEYKEANKMENASYHLATQVPGVDAVLMGHSHTEVKDVFNGVPVVMPGVFGSNLGIIDMQLKKVNGKWEVQKDQSKPQLRPIANSKGTPLVESDQKLVNEIKDEHEKTIEYVNTHVGETKAPINSYFSLVQDDPSVQIVTNAQKWYVEEELKKPEYEKIKDIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIVNMTYEGKPVADKQEFIVATNNYRGSSQTFPGVSKGEVVYQSQDETRQIIVKYMQKIKDIDPAADQNWTFKPIVADKLNTTFDSSPNAQKYIKKDGKISYVGPSENEFAKYAIDITKKNDDKETGEGNPTTPPKGDGENPTTPPKGDGENPTTPPTEEGNNGNEPKQDGNNTGSGQTTTDDQNTKETTTVSENKEAEKDERDLPKTGASIASTIGAGLAFVGAGLLLLFRRKKANR

SEQ ID NO: 26814 - protein, 351 aa, Bacillus cereus AH676
MSSWSNNVNGYCGCNNQNGVHVDSCCFSCDGTVPKVGPTGPTGATGATGGTGPTGATGATGGTGPMGATGVTGDTGPTGATGITGATGPTGATGITGATGPTGATGITGATGPTGATGITGATGPTGPTGATGSTGATGATGSTGPTGATGITGATGPTGATGSTGATGATGSTGVTGPTGATGSTGPTGTTGSTGPTGATGATGSTGSTGATGTSITATYAFANNTSGTAISVVLGGTNVPLPNNQNIGPGITVSGGNTVFTVANAGNYYISYTINITASLLVSSRITINGGALAGTINSPAVATTSFSATIITTLAAGDAISLQLFGLLAVATLSTTTPGAVLTIIRLS

SEQ ID NO: 26815 - protein, 48 aa, Bacillus cereus AH676
MATGSFSATIIANLPAGAAVSLQLFGVVAVATLSTATPGATLTIIRLS

SEQ ID NO: 26816 - protein, 68 aa, Bacillus cereus AH676
MVFSIKPTDSGAGQIQVFNPTPAVGPATVTWTSITTGNPVARGDAISLYITPGITASAVYSIFLITDI

SEQ ID NO: 26817 - protein, 3209 aa, Bacillus cereus AH676
MPSPSAFATEINKKSWDELQGNDVKIKAEQVNAEIYKGEVAEREHVFQYTIENTGATPIQELVLKQNNKNEITFPSQSVKVNGEKLPENKVADFYVEEKDKGGKVLSSNLKIKDLKSHEKMTVLIKARRAQHFNNEYKQKISVQKDQLQIGNMSVDVEGIPSEEKVAANADEEADSSKKEVGPSANNTIKKVDEKLKVSVEDKNNPTSKTEPPKQPVTEAEKLEKEAENQSDAKVQAASENASKVQMQTGDKQGFGDPLYSTITAGNLVQTGNVTLGLTTDHYGRQSLGYKTNKMTVDVDNDDSTFNSSTGAFPNIPAGSKVKKAYLFWTAAMGTPTYPSKEYRVSDAEVREPVKMKMGNKGYAEVSADSIRKADYLPYISNYSGAGAGYVAYADVTNVIAKQGISQTVTVANVPQIKFEKGSGYYWGNWNLILVYENHKETVKDMKIWEGLVAQKSAAWTTIGINKINTPKEGAFKAKFSYFSSQGDPAENDIYAYDFGQYDFGFGYKDLENINGKKNDVNDSSMTEVQVDGTNEFVTKKYPGYNPDWTNSFSTDIHTYHLEGPAKVKNDLKEGKMQFKANGATGDIYVLNNATFVTEHNAPNLQVDKKALDSAGKEIKDVKAGEEFTYQIEVKNDTKNNQAPVSNVKGFDKLDDRLEYVPGSIQYVSGSNKGNKTDNASDDEAEFVNNQIDFRIGEGANAKDGGVLKPGESAVITFKVKVKASVQSDTTVKNIVVVKGQDSSEVNYETADDADITVTTPKEIPGEIEAKKIASNKTPKLGDEVEYRITFKNKTKDGRLDVLTIEDELPSNLEYVKDSLKAEGAKPEPVELKFENGKVIAKYPEIMDMEERSIVFKTKVKETAKIGEEIVNKATVSDKTNPPKNLEEKITPQHKAGKIAAKKKATNKKPKLGEEFEYQISFQNTVENGKLDAVTIEDEIPANLEFVQGSERAEGAEPNPVELKVENGKVIAKYPEITDTKERSIAFKVKVKEEAKAGETIVNKAVVSEPNGQTEHPEEKITPDYKYGKVDVEKSVTNQTPKLGEEVEYRITFYNTVENGKLEKVLVEDTLPKGVEYVKDSLKAEGIKPEPVELKVEDGKVMAKYPEITDTEKRSIVFKVKVKDSAKVGEAIVNKAIAKDPKNEPVESKVVITPQSKKGEIAATKVVNNKKPKLGEEIEYRISFHNTVENGKLEEVRVEDTIPKGLEYVENSIKAEGEAPGPVELAVENGIVKAKYIDIMDMKERSIVFKVKVKEEAKVDKEIVNKAIVDDTKNPPIEPEERITPQHKDGIIDSKKTVDNPSPKLGEEVEYRISFKNTVENGKLEKVIIEDTIPNGLEYVKGSEKAEGDKPAPLKLSVKDGKVIAEYENITDMKERSIVFKVKVKEEAEVGKEIINKAIVDDMKHPKEPEAKITPLHKDGKIKAKKSVNNETPKLGEEVEYRISMKNTVKYGKLTDVIIEDTLPEGLEYVENSLKAEGVGTDSVELKFENGKVMAKYPEIMDTEERSIVFKVKVKEGVTVGKKIINKATIDDSQNKPVNPTAEIIPQYKDGKLEAKKMVNNETPKLGEEVEYRISFKNTVEHGKLTEVKIEDDLPNGLEYVKDSVKVEGSKPDPVELKFENGKVMAKYPEITDTKERSITFKVKVKGKVSDSIVNEAIVSDTKHPPETPTAEIIPQHKDGKVKAKKTVNNETPKLGEEVEYRISFKNTVEDGKLAEVKIEDTLPEGLEYVENSVKAEGSKPDPVELKFENGKVMAKYPEITDTEERSITFKVKVKDEVKVGKKIVNKAIIDDTKNEPETPTAEITPQHKDGKVEAKKTVNNETPKLGEEVEYRISFKNTVENGKLAEVTIKDDLPNGLEYVKDSLRAEGSKPDPVELKVKDGKVIAKYPEIMDTEERSIVFKAKVKEEFKVGEGIVNKVVVDDTKDPTTSEVTITPEYKDGKLKAEKFVNNKKPKLGEEVEYRISFKNTVENGKLVEVTVEDEIPVGLEYVENSLQAEGSKPSPVELKFENGKVMAKYLEIADTKERSIIFKVKVKEEAEIGKEIVNKAIVVDTKNEPEEPRVEITPQYKDGKIAAQKVANNHKPKLGEEVEYRISFKNTVENGKLVEVNIKDTLPNGLEYVEGSITAEGSKPKPVELQVKNNKVMAKYPEITDTEERSIVFKAKVKESVKVGEEIVNEAIIDDTKNLPEEPYVPITPQYKDGKIEARKEVSNHEPKLGEEIEYRIIFNNTVKDGKLAEVKIEDEIPAGLEFVEGSEKAEGEEPKPVELKVENGKVMAKYSEIMDTKERSIVFKVKVKDSVAIGKDITNKAIIHVDDPNHPVIDPTAKITPQYKDGKIATHKKVNNHKPKLGEEIEYRISFNNTVKDGKLAEVKIEDEIPSGLEYVKDSLKAEGDKPAPVELKEEAGKVSAKYENITDMKERSIIFKVKVKDSVEVDKAIVNKAIVDDTKNPPERPEVEITPQHKDGKVKADKKVNKKDPKLGEEVEYRIIFKNTVENGKLAEVKIEDQLPTGLEYVKDSLKSEGNEPAPVELKEEAGKITAKYENITDTAERSIIFKVKVTEVAKVGKKIVNTAIVDDDNPKNPPQKPEAIITPEYKDGKLKAEKTVNNPAPKLGEEVEYRITFRNVVEHGKVAKVKIKDELPTGLEFVEGSERAEGENPKPLYVKVKNGIVLAEYPEITDMKERSIVFKVKVKEKAKVGEEIVNKAIVEDTINPPEQPNISIQPQYKDGALQAEKTVSNHEPKLGEEVEYRISFENTVENGKLTEVKVEDEIPAGLEYVQDSIKSDGPEPNPVELKVENGKVTAKYPEITDTKKRSIIFKVRVQETVQVGKEIVNKAIVDDNNPTPPPVESLIPITPQYKDGKLEARKEVSNHEPKLGEEIEYRITFNGTVDGGKLVDVKIEDEIPSGLEYVKDSLEAVGDKPVPTELKVENGKVTVKYPEITDTKERSVIFKVKVKETAKVGGEITNKAIIEVDDPKHPVIEPTAKIKPEYKDGKLTAAKTVSNKEPKLGEEVEYRISFKNTVENGKLDVVTIEDEIPAGLEYVQGSIRFEGAELNPIELKMEFGKVIAKYLEITDPKERSIIFKAKVKEAPSKGITNKAVVDDKINPPLEPTVTILPKTKGDFKIPEDPKEPKEPEVKPEDPKEPKEPEVKPEVRLEKLIKEPQVKTERELPKTGAASPWMMSVGAGISFLVGGVLFVLGRRRKQ

SEQ ID NO: 26818 - protein, 431 aa, Bacillus cereus AH676; identical to SEQ ID NO: 26472

SEQ ID NO: 26819 - protein, 432 aa, Bacillus cereus AH676
MDFTLYVGGISMKPTIETFIAREIFDSRGNPTVEVDCILSNGVIGRATVPSGASTGEKEAVELRDRDIKRLNGNGVLNALKNVQHVIAPKLRGMTPTRQREIDELMIELDGTTNKSKLGANAMLGVSMAVSRAAAASEQVPLYRYIGGMDIGVPLPFFNVINGGRHADSGIDIQEFMITPIGAPTFRLGMESIVNVYHKLKELLSKEGYVTSVGDEGGFAPRLSSSEEAIEFLIRAMNDAGYQSGKDIAIALDPAASEFYREGKYHFEGKTLSSVEMVSYYEQLVQKYPIISIEDGLSENDWDSWNELTTKLGYTIQIVGDDIFVTNSSIFKQGIEKNIGNAILIKLNQIGTVTETIQTIQIARKAGYQTMISHRSGETEDTFISDFAVGMMVGQIKTGAVARTERVSKYNQFLRIEEELGLNHFQHPFQNK

SEQ ID NO: 26820 - protein, 216 aa, Bacillus cereus AH676
MGQLAFLLFLAAIILFVLLIIALFRKKPKKNLVIAMFACFVLSLIIAPSAKESKKSQQTVSSEVKQEPKKEEKKIESKEKIYKLNEIVKTKKIEVALTKVEEKTTVGNQYMKKDVSEGGTFLAVHYTMKNISDKPVSRFSFPSVRLIDEKDTKYDSDIDASSKYAVETKVDNSKIASDLNPDIQVTKTKVFEISKEKYNSGKWYLLIDGKYKIEIK

SEQ ID NO: 26821 - protein, 103 aa, Bacillus cereus AH676
MLRVCDNVPTNLASPGAGQIVSTITLTLTANITGTIVFSIKPTDIGAQPVKVFNPNPVVAPATVTWTSTIPGNPVARTDAISLFITPGITQSAVYSVFISTAV

SEQ ID NO: 26822 - protein, 799 aa, Bacillus cereus AH676
MGNSTNKSKKLVGFVATATLATSMIAGVGNASAQTTDTLKTAEPVQEKAKDKKEERPESLFPSMDINYDTTIYVGDPFDPMAGVSAYDSKDGDITDKINIVGEVNPFEPGGYNLDYTVTNSRGFSVIKQVHVWVNRGEKPILRLPYGVSINVGDKFDPMAGVSAIDEKDGDITSKIKVDGNVDTSKPGTYEVTYTVTNSKGLTIVRKQPVKVKETEGTKNEAPVLTVPFSTTLHVGEEFDPMDGVSATDKEDGNLTNKVKYKGNADTSKPGKYIVEYWVVDSKGVNATATRSVIVKENEETPDMEPKLTAPTKTTINVGDKFDPMAGVSATDKEDGDITDKVTVDGNVDTSKPGTYELTYTVSDSKGHNVTAKQTVTVKQTVVPKDEIPVLTAPTKTTINVGDKFDPMAGVSATDKEDGDITDKVTVDGSVDTSKPGTYELTYTVSDSKGHKVTAKQTVTVKQKVETTNEAPVLTVPFTTTLSVGEEFDPMAGVSASDKEDGNLTNKIKYKGNVDTSKPGKYIVEYSVVDSKGVNATATQSVIVKENEETPDTEPKLTVPTKTTINVGDTFNPLSGVKAIDNEDGDIINKVTVDGSVDASKPGTYELTYTVSDSKGHTVTAKQTVIVKQKVETKDEDPVLTVPTEVTIHVGDKYNPLSGVKAIDKEDGDITDKVIHMGEVDTSNAGNFEVKFLVRDASGNEVTATQKVTVKDTDTENGSDNSNNNTNSGEGPDTTTTTTTTGNVSDNNNTSSTLDNKKDTIKELPKTGASSNNSTAIGILAILAGMLITFGRKFKKAIK

SEQ ID NO: 26823 - protein, 1044 aa, Bacillus cereus AH676
MIKNSSGQIAYCLTLGLKSPNGEDLPEMGKTDNVVYRVLLNGFPQKSVQQLGVANQNEAHYATQLAVWNALGQLDVNELKHENKNVEKAAKAIINAANNSGDTQDIYMNVIPAEKQKAELKGEFFETNLYTVQTNAKSGSYKVVAKNAPNGVKIVSENGEVKDQLSVGEKFRIQIPKNTKTGEFNLSVAANLTKVQAIAYRGTDTVQNATVLLERNEEKLSSDLAVNWEAAGSLKIKKVGESGEVLAGAVFEVFNANNESVGKITTGADGTAELNNLPIGTYTVKEIKAPTGYVLGDKPQTIEVKTGETGAVQIVNNKAKGNIEIKKFSDSGKVLPNVEFTVFTEDGKEVKKAVTNENGIAKVEGLTFGKYYFLETKTPNGYIGNKTKYPFEIKEHNKTLTFTVENTEVKGSVKLLKVDNEDISKKLEGAVFELKDASGKVIGEYKTDKNGEINVKDLAYGKYSFVEKTSPNGYVLVTEPIVFEIKEHGKIIELLAVNHLIKGDLEITKVDVADGNNKLPNAEFTIYNEAGKEVVKGKTDDKGIAKFEKLPFGKYTYKETIAPNGYILNEETFSFEIKENGQIIKHIVKDEKIPSIKTTAFDKKDGTKEMHTSKSVTIQDKVEYKDLQVGKEYTLKGKLMDKKTNKPFVVNGKEVTAETKFTPKEANGSITLDFTFDATGLEEKEVVVFEELLKDGKVVTTHADINDKGQTVKFVKPSVKTTATNKADGGKEIHSKDSITIQDNVEYTNLVVGKEYTVKGKLMNKAINKPLLIDGKEVTAETKFIAKEKNGFVTLDFTFVGAEQQGREVVVFEDLLHEGQVIATHADINDVGQTVRFVEPSIKTTATNKADGSKELDASKSVTIQDKVEYKDLIVGKEYVAKGKLMDKATKKPLLVDGKEVTVESKFTPKEKNGSITLDFTFNASALQGKEVVVFEELYQDNVLVAIHVDIEDKGQTVKFKEVKPEQPKPEQPKPEQPHQDKNIPTTEQPKEQVKEQPQPKKEVQSKIGWLPQTGADLTSWISMAAGALLLIVGGVIFLKRKNA

SEQ ID NO: 26824 - protein, 456 aa, Bacillus cereus AND1407; identical to SEQ ID NO: 26352

SEQ ID NO: 26825 - protein, 431 aa, Bacillus cereus AND1407; identical to SEQ ID NO: 26428

SEQ ID NO: 26826 - protein, 971 aa, Bacillus cereus AND1407
MKGYSKKVLVGVSFASFMLGSFQGDALAEGTKGEQVSYRNVLKMEPIGLQLPVQELAHSSKVLENKSFEKRLKFADLSQRPPEVKKESKQLAVAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNSNFKLGTLEQNRVVSSYGKLIGNASSDVETITSAAKIFKQYNDNFSTLVDNLSAGNAIYDIMQGVDYDIQSYLYDTRKAPEDTIWYQKIDSYINELSRFALIGTVTAKNGWLINNGIYYTGRLGTFHSTETKGLQVVTDAMKIYPYLGEQYFVAAEQIATNYGGKDANGKVVDLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLSNVSVKKNKSQFFHTFTLQGTYTGTTAKGEYEDWKTITQNVNDTLKRLSAKEWTGYKTVTAYFVNYRVNAAGQFEYDVVFHGINTEEGAVNKAPVAVINGPYSGNVNAAISFKSDGSKDEDGKIVAYKWEFGDGTVSNEQNPTHVYTKEGTYTAKLTVTDDKGLTNTATTNVTVQKKEDNSVEKEPNNSFQTANKLQFNQVLRASLGNGDTSDYFEINVETAKNLQINVTKENNIGVNWVLYSEADLNNYVTYAQQEGNKLVGSYYTYPGKYYLHVYQYGGGTGNYTVEVK

SEQ ID NO: 26827 - protein, 147 aa, Bacillus cereus AND1407
MKKKLLPICAMALLAVGYSSVASADTGTVTKEDAAQVQQDKAKKEEAIKIQQKGEEEKKRIAQEQQKGEEEKKRIAQEQLKNDKAKKEAAQVQQKNTATKKEVAKPVVQGEKLPNTASNNVAMMALSACFVGVGTLFGLKRRNKVKA

SEQ ID NO: 26828 - protein, 965 aa, Bacillus cereus AND1407
MNKKSKINKVMLSISTMALSLGALQAPASAEEKVPYNVLKTKPVGIEKPVDEIGHVSKAEETLSFQERLKVGDFSQRPASIPNKAAVKQVKESYSMADLNKMNDQELVETLGCIKWHQITDLFQFNEDAKAFYKDKGKMQVIIDELAHRGSTFTRDDSKGIQTFTEVLRSAFYLAFYNNELSELNERSFQDKCLPALKAIAKNPNFKLGTAEQDTVVSAYGKLISNASSDVETVQYASNILKQYNDNFNTYVNDRMKGQAIYDIMQGIDYDIQSYLIEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPAVADDYLAEHAPKSLTAVEKEISDTLPMKDVKMTKHSSQFFNTFTLEGTYTGSVTKGESEDWNAMSKKVNEALEQLAQKDWSGYKTVTAYFVNYRVNSSNQFEYDVVFHGIAKDDGENKAPTININGPYNGLVKEGIQFKSDGSKDEDGKIVSYLWDFGDGSTSAEVNPVHVYERKGSYKVTLIVKDDKGRESRSETTVTVKDGSLTELEPNNRPEEANRIGLNNTIKGSLFGGDHTDVYTFNVASAKDIDISVLNEYGIGMTWVLHHESDMQNYAAYGQANGNHIEANFNAKPGKYYLYVYKYDNGDGTYELSVK

SEQ ID NO: 26829 - protein, 794 aa, Bacillus cereus AND1407; identical to SEQ ID NO: 26420

SEQ ID NO: 26830 - protein, 266 aa, Bacillus cereus AND1407
MWRNIRNIGCMGWVVISICAVPIILFLWIVISSLQYKAELEEGKRQADLKEQQQIQEAARIEKIEEKEKREENKTKKKLTKDMIHNKIGNTVDLFGVQINVSKPYETTLEEPDEETRIRVAQKKSQVVSFNVRVQNNSGTPVDLGHYKFKLERDSFSYDHKKVGVKRAYQAPKEEDAYYYRQDVFNRESSLIQPGETMEGTISYFIDSVDIPFVNANIAKGEGDFTLILDVSGMEFLHSFEENKIFFDLHIERDSYYNKLIFSEEE

SEQ ID NO: 26831 - protein, 564 aa, Bacillus cereus AND1407
MKKVFSMVLAFILMLSTLPSAFAANEVPTKGSLTIHKYAHEKDGQKGEEGTGEPGQKVPEGATPIKGVKYEVVKVATFKVIERNGEIVKEAVEKVDNATPISDVTGEDGTVTFKDLPIGRYLVKEVSGPDNVNINTEPYTIDIPMTDKEGKKLNYDVHIYPKNEIKRGAVELTKVDDAGKPLKDVEFTLYHKGTDKVVVDKAGKELKDLKTDKDGKIRVDGLLYGEYYFKESKALEGYVLDPKKYEFKVEKSGAFPKDGQAGYGEIVKLDKIINYKKPTIDKKINGNLNGLPINVDEEFTYDIKTKLPGDIHLYKKYVITDNVDPRLTIIGTPVVTIDGEKVSSDVVKVTLGEKTAAGQLVTVTVENFAALKDKKELHLQIKAKVNGDINGGTVIENIAKIDYETGDKVTPPDDETTTPPVKVIVTDGKISLKKIDGATKDALEGAKFELRKDGKVVKVKGVDVVGVSDKDRIINWNNIPYGEYEIVEIEAPKYTDKGEVKSYQKLREPIKVKIDKDNQTVKLTVENNKSGWILPATGGIGTILFTVVGLVLMGAAFMFLRRKA

SEQ ID NO: 26832 - protein, 333 aa, Bacillus cereus AND1407
MKGKLLKGVLSFGIGLGVLYGGSSVQADTSTDQNNTLKVMTHNVYMLSTNLYPNWGQSQRADLIGAADYIKNQDVVILNEVFDNSASDRLLGNLKKEYPNQTAVLGRSNGNEWDKTLGSYSSSTPEDGGVAIVSKWPIVEKIQYVFAKGCGPDNLSNKGFVYTKIKKNDRFVHVIGTHLQAEDSMCGKTSPASVRTNQLKEIQDFIENKNIPNDEYVLFGGDMNVNKINAENNSDSEYASMFKTLHASIPSYTGHTATWDATTNSIAKYNFPDSPAEYLDYIIASKDHANPSFIENKILQPKSPQWTVTSWLKKYTYDDYSDHYPVAATISMK

SEQ ID NO: 26833 - protein, 503 aa, Bacillus cereus AND1407; identical to SEQ ID NO: 26421

SEQ ID NO: 26834 - protein, 372 aa, Bacillus cereus AND1407
MKTKQTIAASTLALAMIAGANSAHAEVTDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNELKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQNVSDDLSKKKQDLDIKINDFKHTEKKIDDKLAELHTTKQNVDNKINEVSQSKQTETKTGTTNANNTARELPNAGSEQSNNMALGMLSVLGGVLLVARNKIKTLFSK

SEQ ID NO: 26835 - protein, 115 aa, Bacillus cereus AND1407
TEEPKELEKPEVTEKPEIHVKPEEEQVEEGTTEEIKEEKPEELKVTEEKLEIPNKPESQNKVEVQDKSEVPSSKESNKQSKLLPQTGGAAVEYTSILAGMFALILGAMMFRRQKN

SEQ ID NO: 26836 - protein, 455 aa, Bacillus cereus AND1407
MKNQFLKQLQNMKMNKKSLGAVALTAGIIGTTLIPQNAYAHGFVEKPSSRSALCSPTYGALNVNCGSVMYEPQSLEAPKGFPQTGPVDGQIASAGGKFGGILDQQTADRWFKNTITGGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNRIQAQKVTANSIELAWNDSTDNVGVKGYQIFRNGEMIDTVPGTHFIDKKLQPSTEYSYTIKAIDAAGNVSKESATLTVKITVEAPDTEAPTQPKGLHSMGTTASSVDLMWSPSDDNIGVDHYDIYRETKGSMEKIATSNTTSYMDKYLLSNTTYKYVVKAVDVAGNESVQSDIFIITTKTESVSYEEWDAKKAYEKGDKVLHEGKVYEAVQSYKGNGDPNWIYALSLWKTV

SEQ ID NO: 26837 - protein, 187 aa, Bacillus cereus AND1407; identical to SEQ ID NO: 26434

SEQ ID NO: 26838 - protein, 553 aa, Bacillus cereus AND1407
MKKIFSLFLICTLAFSTLSNMIVSAESKSTGTLTIHKFEQSKELKTTTEGNGKEGQTVPEDAKPLEGVTFEIKRIESFEKISNDGTVIKEDAKPVKDAAITKVTNAKGEAVFSNLPLGRYEVKAIEGPKHITLDKTTFIVDIPMTSADGKDLNYDVHIYPKNETKRGSVEFVKKGEAGKVLKDAEFHLFKKNKDGTSTQVKTPSSLVTGEDGKVRVDSLEYGDYYYFIEHKAPTGYLTSKEERPFSIKESGEVVKLDDIKNYKEPTITKSINNGSKVAGINKETDYTYDIKTLLPEDIQSYKKYVVKDILDDRLEIKGLPIVMVDGKKVEDGSVKVVVEGQKVTATIEDFSKINGKELHLQITAKIKSDVESGVKIPNKAVLDFVNKDDVSSEKDGKPSNEVVVTPTAGNIKIEKVDGKDKTLKLEGAKFQLQDKKGNVIKVNGKEMNDITDANGIITWNEIPYGEYQIVETEAPKYKDKDGAVEHYQKLRDPINITLDEKHQKIELQVENNKSGWIIPATGGMGTILFTVVGLILMAVATFIFFRKKPVKNS

SEQ ID NO: 26839 - protein, 163 aa, Bacillus cereus ATCC 10876
MLKKVSQIFLIFGIAFSLSACTETKDSNESKQEDVQDKVYKIGETVEVDGLQVTIDSVKLGYPDYDEDKKKEEILGIIFKVENNSKKEIPFAFYEFEITDKKGTRFKEYNNPDSFISKKLAPEEKIQDIMLFDVAKENTYIATYRPEFTRENRIIKFELKPNK

SEQ ID NO: 26840 - protein, 72 aa, Bacillus cereus ATCC 10876
MDQEPKGNNQVFENEGRKADTLNKQHTNKPEEGKKFLPSTGGEASTSTLLSGITLVLSALSMFVFRKRLFKK

SEQ ID NO: 26841 - protein, 949 aa, Bacillus cereus ATCC 10876
MALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTVARKEANETMWYGKVDGFINEINRIALLNEVTPENKWLVNNGIYFASRLGTFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDHKLNKEYQEYMQQLIDNQDTYTVPEVADDYLAEHATKSLAAVKKEISDTLPMKDTKMTKHNSQFFNTFTLEGTYTGSVTKGESEDWKAMSKRVNESLEQLAQKEWTGYKTVTAYFVNYRVNSSNEFEYDVVFHGIAKDDGENKAPTVNINGPYSGLVKEGIQFKSDGSNDEDGKIVSYLWEFGDGSTSAEVNPAHVYEREGSYKVSLRVKDDKGKESRSETTVTIKDGSLTESEPNNLPEEANYIGLNTTIKGSLIGGDHTDVYTFNVASAKDIDISVLNEYGIGMTWVLHHESDMQNYAAYGQANGNHIEAKMNAKPGKYYLYVYKYDNGDGTYKLSIK

SEQ ID NO: 26842 - protein, 176 aa, Bacillus cereus ATCC 10876
MYKKLGTIALTGALAFSLAACGETEVKEVSKNDAPKQAEKKDKKEKAESKIYKIGDTVEVNGLQLTFSSAKFVEPNEYIKAEKGKVLEIAFNAKNNGKKDIYFGTSELKIADTNGNQFKEYFGGENTFINENIAPGNQITNKMLFDVPEGDKFVGTFKPTFTFDEKSVKFEFEVAK

SEQ ID NO: 26843 - protein, 333 aa, Bacillus cereus ATCC 10876
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDHFVHVIGTHLQAEDSMCGKTSPASVRTDQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPQSPQWTVTSWFQKYMYNDYSDHYPVEATISMK

SEQ ID NO: 26844 - protein, 190 aa, Bacillus cereus ATCC 10876
MLLFWKEETMNKKLLASLLCSTFLFGVSACSSHDAPAKNEQATSKKTENDKLSSKDSQKELPTNVDSSDVYMSMGSAESLDVLGTGEVKAQGVFKVLDIAVYNRKEEPITLDINNFKLIDGFGREYHISNEHQSVLKAANTSTFKFGIVSPDEHSDGNIVFDVPKNTQGLTLKFNNDTLDKELQLKVELE

SEQ ID NO: 26845 - protein, 336 aa, Bacillus cereus ATCC 10876
MKRSKTYLKYLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKSFTLDWKNKKLVEKK

SEQ ID NO: 26846 - protein, 172 aa, Bacillus cereus ATCC 10876; identical to SEQ ID NO: 26655

SEQ ID NO: 26847 - protein, 179 aa, Bacillus cereus ATCC 10876
MFKKIATVTLAGTLAFSLSACDEKKEVAKTVSNNTKEEQSSAKKENTKNEDTREYNVEKTTQIRNQKLTVHKVQIAQVAEYDKLEKGNEFVIVHVTVENIGNQKVRINPLDFYLERGDGSIVDHTFSTSNKNIFKIKDVDPNGKLTGAITFEAKKGDSNLELIYRPDVMSKEEVKVELK

SEQ ID NO: 26848 - protein, 503 aa, Bacillus cereus ATCC 10876; identical to SEQ ID NO: 26695

SEQ ID NO: 26849 - protein, 887 aa, Bacillus cereus ATCC 10876
MGNKKEIAIVALTTGFVLTSVTPYGVGHAEEPGQMQVEIHEDSFRTGDLTQPSKKAPENVVKDALKENTDHALSPKQVSAETGVDYKVLQKRGSYDGTTLVRMQQIYEGKEVYGHQLTVHVDKKGIIKSISGASAQNLTQEDLKKPINLSKEEAKQYIYKKYGNDIKFISEPEVKAVIFVDENHGQASNAYQVTFAATTPNYVSGTYLVNAHNGDMLKDMVQESSLKISEEYVESVKENKTSNFTSLTGTGKDDLGVTRTFGISKQTSGNYALADYTRGQGIETYDVNYRDITNEESYYPGILATSASTTFNDPKAVSAHFLATKVYDFYKEKYNRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANTDELNMTSNFSELKLACLKVATNKYGTNSIEVQAVQNAFDAAKITGTVKENEKTAENQAPELTVPFTITLRVGDTFDPMRNVKAVDKEDGDLTNKVKHKGDVDTSKPGTYIVEYLVVDSQGRTTTATQTVIVEGNGEILDLEPKLTVPVGATIHVGDSFDPMIKVKAIDKEDGDLTSKVKIAGGVDTSKVGTYVLTYTVTDSKGHEVTAKQTVTVKVREEVKNDKPILKVPATTSITEGDQFDPLVGVSATDKEDGDLTSKVAYEGTIDTTKAGTYEIIYSVRDSMGNEVNTIQKVLVKDKETSKANGLTNKTNNNNSDKKEYTYKELPKTGVSTTNSAAIGILMIITGTVLTFVRKFRKIQK

SEQ ID NO: 26850 - protein, 563 aa, Bacillus cereus ATCC 10876
MIEVVKGIREMKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGAVFSLFKKDGTEVKKELVTDANGHIRVQGLEYGEYYFQETKAPKGYVIDPTKREFFVKNSGTINEDGTITSGTVVKIEVKNNEEPTIDKKINGKLEALPINPLTNYNYDIKTLIPEDIKEYKKYVVTDTLDNRLVIQGKPIVKIDGAEVNASIVEVAIEGQKVTATVKDFTKLDGKKEFHLQIKSQVKEGVPSGSEILNTAKIDFTNKNDVIGEKESKPVVVVPTTGIIELTKIDGANKSKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKFANN

SEQ ID NO: 26851 - protein, 455 aa, Bacillus cereus ATCC 10876
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTENRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSSPNGLQTQKVTANSVELTWNASTDNVGVKGYQIFRNGEMIDTVPGTHFIDKKLQPSTEYSYTVKAIDAAGNVSKESTALTVKTTVETPDTEAPTQPKGLHSMGTTASSVDLMWSPSDDNIGVDHYDIYRETEGSMKKIATSNTTSYLDKNLLANTTYKYVVKAVDVAGNESVQSDIFTITTKTESASHEAWDAKKAYKKGDRVLHEGKVYEAVQSYQGNGDPNWIYALSLWKTV

SEQ ID NO: 26852 - protein, 878 aa, Bacillus cereus ATCC 10876
MVKYSKISKWILGVGLVTITCNGLQIQAETKEKNVKNVLQMEPVGIQKSVNELAHPSKVQENESFTKRLKLADLSQRPLAPTDNIKPLAEEKKYSMAELNQLNNKQLTDLLVTIKWYQIPELFQFNSDSLKFYQDDSRMQAIINKLAEQGQAYTQDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVAAEQITTNYGGIDASGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDEYRATLSKDNKLNEEYQSYMQMLIDNRDKYTIPQVSDEYLTQHDPKSLSDVTSDITNEAKLKDVKVTKNKSQFFNTFTLQGTYTGSAAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 26853 - protein, 436 aa, Bacillus cereus ATCC 10876
MGRGIVVRHHRKCKKFGVALPLPLIGATGPTGNSGPTGPTGGHEGPVGPPGITGPTGATGPQGPQGIRGIQGPRGTTGAQGIQGPVGDTGEQGITGPVGLQGPQGLIGEQGPVGDIGLQGMQGIQGITGPAGSQGIQGAQGIQGEIGERGETGAQGMQGEIGVTGISGVTGPQGPQGIQGPQGVTGPTGATGSTGVTGPQGIQGIQGSQGITGPTGATGVTGITGPQGIQGIQGPQGVTGATGATGATGATGATGPTGIQGIQGITGATGGTGVTGPTGATGPTGLTGATGSSAISTGGGYFFSTSTSTIAANANIPINSGSTVYGTGVSLTSATTVTVSTPGIYLVSYYFQGDATGGNETVSVRLLLNGTQLTGSFIQNVTTSTVVIEPAISNTLLVNVTSANSTLILQNGPLGVGHVTTIAGAITASLNVVRIL

SEQ ID NO: 26854 - protein, 971 aa, Bacillus cereus ATCC 10876
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRVQAIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLADNLSAGNAIYDIMQGVDYDIQSYLYDTRKAPKDTVWYQKIDSYINELSRFALMGTITAKNGWLINNGIYYTGRLGTFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEHWKTITQNVNDTLKRLSAKEWTGYKTVTAYFVNYRVNTSGQFEYDVVFHGINTEEGAENKAPVAVINGPYSGNVNEAISFTSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGSKLVGSYYTYPGKYYLHVYQYGGGTGNYTVEVK

SEQ ID NO: 26855 - protein, 358 aa, Bacillus cereus ATCC 10876
MPKVGPTGPTGATGSTGPTGATGITGATGATGSTGPTGSTGSTGPTGATGSTGPTGATGSTGPTGATGSTGPTGATGSTGPTGAIGSTGPTGATGSTGATGSTGPTGATGPTGATGSTGATGITGSTGLTGPTGATGITGATGSTGPTGSTGATGSTGATGSTGPTGATGITGSTGPTGPTGATGITGATGPTGATGITGATGPTGATGPTGATGSTGATGTSITATYAFANNTSGTAISVLLGGTNVPLPNNQNIGPGITVSGGNTVFTVANAGNYYISYSINITASLLVSSRITINGAPLAGTINSPAVATTSFSATIITTLAAGDAISLQLFGLLAVATLSTTTPGAVLTIIRLS

SEQ ID NO: 26856 - protein, 266 aa, Bacillus cereus ATCC 10876
MLSKKVAFFSLATIVLMSGTANVASAMEQSSTLDYPISSIESTKNTDTFLDKLIDFKDKEKEAKNYGKNLPNHRDKIVVTPKAKEAFNNYEQNGTRINQALREGKVDGYPKEYVKVAKEYAAEMDKVFKQNTASVPDTIMVYRYTDEQQFGIAPGTFFPKDPKNPKETIVNKESIEKFKKKFEGKTVKDKGFTSTSLAILDKYLGEKPKTIRMDIEVPKGTHAVYMGNEYAELILPRNAPLKIKKVSGIVEKGKLIVKVDASVVNK

SEQ ID NO: 26857 - protein, 746 aa, Bacillus cereus ATCC 10876
MGNNSKHKTRKILAATATVTMLATGMISSSDVFAEETQQQKNLSTSLQSEKSVKSENRTFTVPGKGDVEVLKQQERKSMAFSPYEPTGLYAKPNEQITINVEGNQDIQVYIGTYSYDASWREDSKIKSFTLKPGINTIQSPNGGMIYFYNKQQGGSIRTTITTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYATSYRTAYVGDAIQYVLDINKFITDGWGPWHEAGHLRQQSPWKFYNMTEVQNNIYSLSVEKAFNQPSNLEKSGIYPKAFQYLEQVNKNYDEISDVFVKLVMLWQLQLAYGEDFYPKLHQLYRDMPSSELPQTDENKKQLFMISASKVAKQNLIPFFEKWGLRPNNDTIQKVAALGYPILTAEIWKGTDSNPIKPDMPNVNNILEGNQFAWSLKGISDFEFAKINFNKSTEEMQVDLKSGVPHHYFNETYASIKVQNASGKVVYNKDIYGNKQQNAESQKVSVKVGDYIELTHLEGVHRATLTNVDNSKQESFGKKAMYEVTKEGLKKVNQIVNPKPDTEAPTQPQGLYASNLTSNSVELKWNPSTDNVGVKEYQVLRDGQLIQTVQGTTFTDQNLTVNKEYKYAVKAVDAAGNTSIQSEILLVKTKDQNVSYEKWDPKKAYTKGDKVEHQGTVYEAVQNHQGNGDPNWIFALSLWKAITIN

SEQ ID NO: 26858 - protein, 1282 aa, Bacillus cereus ATCC 10876
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGPQGVQGLQGPIGPTGATGAQGIQGIQGLQGPIGATGPEGPQGIQGVQGLPGATGPQGIQGAQGIQGTQGPSGNTGATGATGQGITGPTGITGPTGITGPSGGPPGPTGPTGATGPGGGPSGSTGATGATGNTGATGSTGVTGATGSTGPTGSTGAQGLQGIQGIQGPIGPTGPEGPQGIQGIPGPTGVTGEQGIQGVQGIQGAKGATGDQGPQGIQGVPGPSGATGPQGVQGIQGPMGDIGPTGPEGPEGLQGPQGIQGVPGPVGATGPEGSQGIQGIQGPVGTTGPQGPQGIQGIQGVQGITGAPGVQGVTGIQGIQGEIGATGPEGPQGVQGAQGGIGPTGPMGPQGVQGVQGIQGATGAQGVQGPQGIQGIQGPTGATGDTGATGATGEGTTGPTGVTGPTGVTGPSGGPAGPTGPTGPSGPAGVTGPSGGPPGPTGATGATGVTGDTGATGSTGVTGATGETGATGVTGLQGPQGIQGVQGEIGPTGPQGVQGPQGIQGVTGPTGDQGPQGIQGPQGDIGPTGPQGIQGPQGSQGIQGATGGTGAQGPQGIQGPQGDIGPTGPQGPTGIQGIQGEIGPTGPEGPEGLQGPQGIQGVQGPVGATGPEGPQGIQGIQGPVGATGPQGPQGIQGIQGVQGITGATGAQGATGIQGIQGEIGATGPEGPQGVQGIQGAIGPTGPMGAQGVQGIQGIQGATGAQGVQGPQGIQGIQGPTGATGDTGATGATGEGTTGPTGVTGPTGVTGPSGGPAGPTGPTGPSGPAGVTGPSGGPPGPTGATGATGVTGDTGATGSTGVTGATGATGATGVTGLQGPQGIQGVQGEIGPTGPQGIQGPQGIQGVTGATGAQGPQGIQGPQGDIGPTGPQGIQGPQGPQGIQGDTGATGAQGPQGIQGPQGDIGPTGPQGPQGIQGPQGIQGPTGATGATGATGPQGIQGPQGIQGPQGIQGPTGDTGATGATGPQGIQGPQGIQGPQGIQGPTGATGATGATGPQGIQGPQGIQGPTGATGATGSQGPTGDTGPTGAGATGATGATGVSTTATYAFANNTSGTAISVLLGGTNVPLPNNQNIGPGITVSGGNTVFTVANAGNYYIAYTINLTAGLVVSSRITVNGSPLAGTINAPTVATGSFSATIIANLPAGAAISLQLFGLVAIATLSTATPGATLTIIRLS

SEQ ID NO: 26859 - protein, 111 aa, Bacillus cereus ATCC 10876
MKPEEPKEPEVKPEDPKEPKEPEVKPEEPKEPKEPEVKPEDPKEPKDLKKPEVKPEKPEVRLEKLIKEPQVKVEKELPKTGAAHSWMMSVGAGISFLVGGVLFVLGRRRKQ

SEQ ID NO: 26860 - protein, 431 aa, Bacillus cereus ATCC 10876
MPTIIDVYAREVLDSRGNPTVEVEVYTESGAFGRAIVPSGASTGEHEAVELRDGDKSRYLGKGVINAVNNVNEIIAPEIEGFDVTDQAGIDRAMIELDGTPNKSKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 26861 - protein, 368 aa, Bacillus cereus ATCC 10876; identical to SEQ ID NO: 26701

SEQ ID NO: 26862 - protein, 450 aa, Bacillus cereus ATCC 10876
MERLRKSKKGIGACVLAAGVTAITMIPQSAYAHGFVEKPSSRAALCSQNYGALNLNCGNIMYEPQSLEAPKGFPDGGPIDGKIASAGGLFGGILDQQTSNRWFKNTIKGGANTFTWKYTAAHPTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKANTEYTYTIKALDSAGNISKESEKLKVKTTHAIPDIEAPTQPKGLHSMGTTATTVDLMWSPSEDNVGVDHYIVYRESAGVMNKIGTAANTSFMDKDLKANTSYKYVVTAVDLAGNESSRSDVLTVTTKSEDSTYEKWNARKAYTKGDRVVHEGKVYEAVQDHQGNGDSNWIFALSLWKPVLNK

SEQ ID NO: 26863 - protein, 949 aa, Bacillus cereus ATCC 4342
MALSLGAIQTHVVAEEKVPYNVLKTKPVGIEKSVDEIGHVSKAEETLSFQERLKVGDFSQRPASIPNKAAVKQVKESYSMADLNKMNDQELVETLGSIKWHQITDLFQFNEEAKAFYKDKGKMQVVIDELAHRGSTFTKDDSKGIQTFTEVLRSAFYLAFYNSELSDLNERSFQDKCLPALKAIAKNPNFKLGTAEQDTVVSAYGKLIGNASSDVETVQYAANILKQYNDNLHTYVDDRMKGQAVYDIMQGIDYDIQSYLIEARKEANETMWYGKVDGFINEINRIALLNEVTSENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEISDTLPMKDAKMTKHSSQFFNTFTLEGTYIGSVTKGESEDWNAMSKKVNEALEQLAQKDWSGYKTVTAYFVNYRVNSSNQFEYDVVFHGIAKDDGENKAPTININGPYNGLVKEGIQFKSDGSKDEDGKIVSYLWDFGDGSTSAEVNPVHVYEREGSYKVALIVKDDKGRESRSETTVTVKDGSLTELEPNNRPEEANRIGLNNTIKGSLIGGDHTDVYTFNVASAKDIDISVLNEYGIGMTWVLHHESDMQNYAAYGQANGNHIEANFNAKPGKYYLYVYKYDNGDGTYELSVK

SEQ ID NO: 26864 - protein, 338 aa, Bacillus cereus ATCC 4342
MEVWNVKGKLLKGVLSFGIGLGALYGGSSAQADTSTNQNNILKVMTHNVYMLSTNLYPNWGQSERADLIGAADYIKNQDVIILNEVFDNSASDRLLGNLKREYPNQTAVLGRSNGNEWDKTLGSYSSSTPEDGGVAIVSKWPIIEKIQYVFAQGCGPDNLSNKGFVYTKIKKNDHFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIISSKDHANPSFIENKVLQPKSPQWTVTSWLKKYTYNDYSDHYPVEATISMK

SEQ ID NO: 26865 - protein, 553 aa, Bacillus cereus ATCC 4342
MKRIFSLLLIFVLAFSALMNMTVSAESKSTGTLTIHKFEQSKDLKTTTEGNGKEGQTVPEDAKPLEGVTFEIKRIESFEKISNDGTVIKEETKPVKDDAITKVTNAKGEAVFTNLPLGRYEVKAIKGPEHIELDMTTFIVDIPMTSTNGKELNYDVHIYPKNETKRGSVEFIKKGEGGIVLKDAEFHLFKKNKDGTSTQVKTPSSLVTGEDGKIRVDSLEYGDYYYFIEHKAPTDYLTSKEERPFSIKESGKVVKLDDIKNYKEPTITKSINNGSKVAGINKETDYTYDIKTLLPEDIQSYKKYVVKDILDDRLEIKGLPIVMVDGKKVEDDSVKVVVEGQKVTATIKDFSKINGKELHLQITAKIKSDVESGVKIPNKAVLDFVNKDDVSSEKDGKPSNEVVVTPTAGNIKIEKVDGKDKTLKLEGAKFQLQDKKGNVIKVNGKEMNDITDANGIITWNEIPYGEYQIVETEAPKYKDKDGAVEYYQKLRDPIDITLDEKHQKIELQVENNKSGWIIPATGGMGTILFTVVGLILMAVATFIFFRKKPVKNS

SEQ ID NO: 26866 - protein, 503 aa, Bacillus cereus ATCC 4342
MFNKKMVAMAMTVPLVMGTISTVSALEKQQQVKLEAYSPQKKATEYLKENAAQYGLKADLSDLQYISTTETSVASYVRFQQVVNGVPVFSKQITVTLNGEGKGVLAVSDYQSVKGVKEVTTKISEKDAIQKSMAYVGEVSEQNLWAPTEKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDNNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26867 - protein, 890 aa, Bacillus cereus ATCC 4342
MKNKKEIAIVALTTGLALTSVTPYGVSYAEETGKMQVDIQEDSFRTGELTQPSQKTPENVVKDALKEKTQHALSPKQVSGDKGVDYKVLQKRGSYDGTTLLRMQQIYEGKEVYGHQLTAHVDKKGVIKSVSGDSAQNLAKEDLKNPINLSNEEAKQYIYTKYGKDIKFISEPEVKEVIFVDENRGQATNAYQVTFAAAAPNYVSGTYLVDAHSGDMLKNMVQESSLKVSEEHLESLKESKKSNSISLTGTGKDDLGITRSFGISEQSNGKYALADYTRGQGIETYDVNYRDINFEEQYYPGILATSTSTTFNDPKAVSAHFLATKVYDFYKDKYKRNSFDNKGKKVVSVVHAWHSGETDNPKNWGNAFSANINNVSMLIYGDPMVRAFDIAGHEFTHAVTSSESNLEFFGESGAINEALSDIMGTAIEKYINNGEFNWTIGEQSGSVLRNMKNPSSVKFFDGVPYPDDYSKFSDLNGEDNEGVHFNSSIINKVAYLIAQGGTQNDVTVNGIGEDKMFDIFYYANTDELNMTSNFSELRLACLKVATNKYGANSIEVETVQKAFDAAKIKGTVKENEKTAENQVPELTVPLTITLRVGDTFDPMSNVKAIDKEDGDLSNRVEHEGEVDTSKPGKYIVDYSVVDSQGGNATATQTVIVEGNGETSDLNPTLTVPVATTITVGDSFDPMVKVKAIDKEDGDLTFKVKVDGEVDASKAGTYILTYTVTDSKGHEGIAKQTVTVKDREEVKNEIPILKVPATTTITKGDQFNPMAGISVTDKEDGDLTSKVAYEGTIDTSKPGTFEIIYSVRDSVGNEVHTIQKVFVKDKDTRKANDHANNSNIPNNSNSNKNESTYKELPNTGASTTNSTTMGLWMVIVGTVLILARKFRKVQK

SEQ ID NO: 26868 - protein, 381 aa, Bacillus cereus ATCC 4342
MDELLSSALINPDLLGPTLPAIPPFTLPTGPTGDTGPTGSTGPTGSTGPTGPGCIEPLPTFTQIVYVNKAGNDATADGSECAPFLTVTAAMASITDAIAPFPDPLNITKRYAISIGPGNYIEPLIHLKANVQLVGTSTLLTRLQIPFDINDPSWFDLNFSQDPRSGFVNLTLLSGPLDFNFQTAQSVSGKLFFVSVNITPTPIFTALSTSVNQVNIRDSMLSGGYTQNGINMAMFASFVSSGNITINSQATTDTQVNLVGGGINGNVIINVLPGHIPIDPLNLTSFAITENIFNPSPNSGNLFVNGANNVITRVRATVDSLPIRSRINLIGTSTSLIRVDDAFDLAYTPINPANWAPLPPTTVQEALDRIAALMAITIGTP

SEQ ID NO: 26869 - protein, 455 aa, Bacillus cereus ATCC 4342
MKNRFLKQLQNMKMNKKSLGAVALTAGIIGTTLIPQNAYAHGFVEKPGSRSALCSPTYGALNVNCGSVMYEPQSLEAPKGFPQGGPVDGQIASAGGKFGGVLDQQTADRWFKNTITGGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNGIQAQKVTAHSIELAWTASTDNVGVKGYQIFRNGEMIDTVPGTHFIDKKLQPSTEYSYTVKAIDAAGNASKESAKLTVKTTVEAPDTEAPTQPKGLHSMGTTTSSVDLMWSPSDDNIGVDHYDIYRETEGSMKKIATSNTTAYIDKNLLPNTTYKYVVKAVDVAGNESVQSDIFTITTKTESASYEEWDATKAYEKGDRVLYEGKVYEAVQSYKGNGDPNWIYALSLWKTV

SEQ ID NO: 26870 - protein, 382 aa, Bacillus cereus ATCC 4342
MHMKEKRYKNMKTKQTIAASTLALAMIAGANSAHAEVTDATSQQSTGDRLAEIKQHKQEFDAKLQQHKENVDQKLNELNQVKENVDTKVNELHERKQVADEKINEIKQRKEELDAKLQQDKQIAEDKIAEIKEHKKQVEDKVAEVKEHKQNIDNKVNEIKEHKQTVDEKVNEIKQHKENIDQKVNELKEVKKQVDEKLAELKKAKQTAEDKLAELKENKPHTGNTLEELKKIKGNLDSLSANLELAKQDVKNKLAALQEARQDLINKINEIKQSKQNVSDDLSKKKQDLDIKINDFKHTEKKIDDKLAELHTTKQNVDNKINEVSQSKQTETKTGTTNANNNARELPNAGSEQSNNMALGMLSVLGGVLLIARNKIKTLFSK

SEQ ID NO: 26871 - protein, 412 aa, Bacillus cereus ATCC 4342
MKKANEIAKSVAVASVIMSGSLGLQATSVFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNYPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKALEEQMSSIKNVNNQLNKGKGKLSFSMNGNQLKATSSNAGYGISYEDKNWGIFVNGEKVYTFNEKTTVGNISNDINKLNIKGPYIEIKQI

SEQ ID NO: 26872 - protein, 971 aa, Bacillus cereus ATCC 4342
MKGYSKKVLVGVSSASLMLGSFQGDALAEGTKGEQVSYRNVLKMEPVGVQLPVQELAHSSKVLENKSFEKRLQFADLSQRPPEVKKESKQLTVAKTYTIAELNQLSNQQLVDLLVTIDWEQINGLFQFNKDSLAFYQNDSRIQAIIDKLQQQGQAYTKDDSKGIETLVEVLRSGFYLGFYHTELSKLNERSYHDKCLPALKTIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALIGTVTAKNGWLINNGIYYTGRLGTFHSTGTKGLQVVTDAMKIYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPADRYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLNNVSVKKNKSQFFHTFTLQGTYTGTTAKGEYEDWKTITQNVNDTLKRLSAKEWTGYKTVTAYFVNYRVNASGQFEYDVVFHGINIEEGAVNKAPVAVINGPYSGNVNEAISFKSDGSKDEDGKILSYKWEFGDGTVSNEQNPTHVYTKEGTYTAKLTVIDDKGLTNTVTTNVTVQKKEDNSIEKEPNNSFQTANKLQFNQVLRASLGNGDTSDFFEINVETAKNLQINVTKENNIGVNWVLYSEADLNNYITYAQQEGNKLVGSYYTYPGKYYLHVYQYGGGTGNYTVEVK

SEQ ID NO: 26873 - protein, 802 aa, Bacillus cereus ATCC 4342
MLAGATLAIGVIAPQVLPTTAHADEKAGESTVNLRILETSDIHVNLMNYDYYQTKTDNKVGLVQTATLVNKAREEAKNSVLFDDGDALQGTPLGDYVANKINDPNKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPDVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVGDNQEFIVATNNYRGSSQTFPGVSKGEVVYQSQDETRQIIVKYMQETPVIDPAADKNWTFKPIVADKLNTTFDSSPNAQKYIKKDGKISYVGPSENEFAKYAIDITKKNDDDKETGGENPTTPPTGGGNNGGNPTTPPTGEGNNGGNPTTPPTGEGNNGGNPTTPPTGEGNNGGNPTTPPTGEGNNGGNPTTPSTDEGNNAGSGQTTTDNQNAKETTTVSENKEERDLPKTGTSVASTIGAGLAFIGAGFLLLFRRKKANR

SEQ ID NO: 26874 - protein, 117 aa, Bacillus cereus ATCC 4342
MLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 26875 - protein, 368 aa, Bacillus cereus ATCC 4342
MYQRNCFSCDGRRNGGSIGSTGATGITGPTGSTGPTGITGPTGITGPTGPTGSTGPTGITGPTGSVGATGAGFQSTTTFSLAAAPNYKKGQVVTYTGSGYVVKKDAPQGFPNISPDYIVLVESGPTGSTGPTGITGPSGSTGPTGNTGPSGSTGPTGITGPTGNTGSSGSTGPTGITGPTGNTGSSGSTGPTGITGPSGNTGPTGTAGSASAKSIVFQGTNAGFQRIAGSPGIDSNVIPYVTAGSGSIVGFTASINVNNLPAAVYTINICRNVPTNLIVPTSSYILSTITLATTDKITGTIVFSIKSTDTGPGQIQVFNPTPAVGPATVTWTSITTGNPISIGDAISLYITPGITASAVYSVFLITNI

SEQ ID NO: 26876 - protein, 80 aa, Bacillus cereus ATCC 4342
MKNKKEEKASLPSKPNKPTPNGEVKPSADVKPMQQPNTHNEVRLPATGGVGNEFTVLFVLGLGFIIAGAYVLKMKNRKEM

SEQ ID NO: 26877 - protein, 431 aa, Bacillus cereus ATCC 4342; identical to SEQ ID NO: 26106

SEQ ID NO: 26878 - protein, 1064 aa, Bacillus cereus BAG1O-2
MLQNPLKVIASSVILTTTLVTPVMTNSMTIHAETQEQSIENQVPAERIFHVIGKGDVNQIKDKERRQFSFSPYEPTGLYAGPNEKITIKVEGTQNIKAYIGTYSYDGAWNQDNLVKSFTLNPGENTIESPNGGMIYFYNQQNGGSVQAEVKTGGVPVPFFELGKHTKQDLINMLDTYPNAHAVELKGERSLITASPERVKKYLIGSNTDPVELLKKIDESIRLEDRVAGLSEEEADKHYVHFVEDNHSSYYMYAYTYRTAYVKDAIQVVLDINQFTKDGWGPWHEMGHQRQPNPWTWNGLGEVTNNIYSMSVQRAYGLPSRLEKDGVYQKAFTYLNKPQSEKDYNKIDDVFVKLVMFWQLDLAFREEFYPKLHQLYRAIPKEELPKTNDEKIQNFIYNTSKVAQKNLLPFFDQWGLIATPEIRQKIESLNYPILTAPIWEATDSKPVIVEENGETQDTEPKLTVPDGATMNVGDSFNPMAGVSATDKEDGDLTDKVTVEGKVDTSKAGNYELTYTVKDSKDQKVTAKQTVTVKKKEETKDEAPELKVPSETTIIEGDQFDPMAGVSAIDKEDGDITPEVKYEGDVDTNTPGTYMIKYTVKDSAGHLATQTQTITVKEKPAEDQEPELTVQEETVLTVGDRFDPMSGVKAIDKEDGDITSKVTYSGDQGTDKDGTYKIKYVVEDSKGHRVIKLRTVIVKTAGKPSENQAPLLKVPFTTTLHIGDTFDPMTGVSASDKEEGNLTEKVKHKGNVDTAKPGKYIVEYWVVDSQEVNATATQTVIVEENRETPDMEPKLTVPGGETMNVGGSFDPVTGVSATDKEDGDLTDKVTVEGKVDTIKPGTYVLTYTVKDSKGHKATAEQTVTVKETEELKDEAPVLTVPAEVNMNVGDSFDPMSGVKAIDKEDGDLTKKVVHFGEVDTSKAGTYEVKFLVRDSGGNEAIMTQKVVVKDKDNGNGSDNANNGLGNNNDSDNGNNNTNNGNGSDNNNTNNGNSLDNGSNGTNNSNSTDTDNNNISNISTSDKKEDTYKELPKTGTSTNNSAAMGILMVLAGMVLTIGRKFRKVLK

SEQ ID NO: 26879 - protein, 162 aa, Bacillus cereus BAG1O-2
MLKKVSQIVLICGIVFSLSACTETENSNESKQENVQEKIYKIGETVDVDGLQVTLDSVQLGYPDYTIDKKKDDILGIVFTVKNNSKKEIPFAFYEFEITNKKGTKFKEYKYDSFISKKVAPDEKIQDIMRFDVDKENTYIATYRPEFTRENRTIKFELKPNK

SEQ ID NO: 26880 - protein, 965 aa, Bacillus cereus BAG1O-2
MNKKSKINKMMLSISTMALSLGAIQTNVSAEEKVPYNVLHSKPVGIEKPVDEIGHVSKAEETLSFQERLKVGDFSQRPASITRNLAVKQAKDSYSMADLNKMNDQELVETLGSIKWHQITDLFQFNEDAKAFYKDNGKMQVIIDELAHRGSTFTKDDSKGIQTFTEVLRSAFYLAFYNNELSALNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNEVTSENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDSKLNKEYQEYMQQLINNQDKYTVPEVADDYLAEHAPKSLTEVKKEISETLSMKDAKMTKHESQFFNTFTLEGTFTGSVTKGESEDWNAMGKRVNEALEQLAQKEWSGYKTVTAYFVNYRVNSSNEFEYDVVFHGIAKDDGENKAPTVHINGPYNGLVKEGIQFKSDGSNDEDGKIVSYSWEFGDGRTSTEVNPVHAYEKEGTYKVVLRVKDDKGKESRSETTVTIKDGSLTESEPNNRKEEANRIGLNTTIKGSLIGGDHTDVYTFNVASAKDIDISVLNEYGIGMTWVLHHESDMQNYAAYGQANGNHIEAKLNAKPGKYYLYVYKYDNGDGTYSLSLK

SEQ ID NO: 26881 - protein, 333 aa, Bacillus cereus BAG1O-2
MKSKLLKGVLSFGIGLGALYSGSSAQAETPTNQNNTLKVMTHNVYMLSTNLYPNWGQSERADLIGAAGYIKNQDVVILNEVFDNSASDRLLGNLKREYPNQTAVLGRSSGNEWDKTLGNYSSSTPEDGGVAIVSKWPIVEKIQYVFEKGCGPDNLSNKGFVYTKIKRNDSFVHVIGTHLQAEDSMCGKTSPASVRTKQLQEIQEFIKNKNIPNNEYVLIGGDMNVNKINAENNSDSEYASMFKTLHASIPSYTGHTATWDATTNSIAKYNFPDSPAEYLDYIIASKDHANPSHIENKVLQPKSPQWTVTSWFKKYTYNDYSDHYPVEATISMK

SEQ ID NO: 26882 - protein, 502 aa, Bacillus cereus BAG1O-2
MLNKKMVAMAMTVPLVMGTISTVSALEKKQVKVEAYSPQKKAVEYLKGNANQYGLKPDLSDLQYISTTETSVASYVRFQQVVNGAPVFSKQITVTLNGEGKGVLAVSDYQPVTGVKEVTTKISEKDAIQKSMAYVGEASEQNLWAPTEKEFGYIVEEGVALPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAMTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNAKFRDGAKAIKQADALLYGGQHAADIDRIWAARGISTN

SEQ ID NO: 26883 - protein, 723 aa, Bacillus cereus BAG1O-2
MKKLKPALSVLGSVSMALTLASPALADIKQPNAGSTIEMFKEDANAKEGKDLIYGIDGKKGKMSTEKIEIQNDDWDQDGISNDLEIKGYKIEFNRQTGKNEAQAWDPERDKDKLKFITNPMSANSDGDPFTDAYEVQYYGSNSDTEFNPMVANIPNLQVGIKRIGVTPLAAITDSNGGSIDKGWEKSVSTQHSFGVGAGVEGGVEGSAAGPVPSGKASLNVSYGYSKTSTDTERYSSNIDWSTAKTVDSAKAAKVSLQLEYKNTGTASAQNVSPHFNIRLGDKIISTVKATQDRYKANQLSTEKGGRNTTEVLIDSVDNQADVNIYLSLDELKAVEQGAILSVEVLPTSTMELYIEKDGEFMNLGDSGKFESRVNASTTILETDIGNKPKFRMYAPEGVGSDTNLTFNEVLKHVKVDSKKINEFIDNSRGDQVIIAKENLENAKKSYVSKGAKVGVFTKIQQPELSYSAYDPFTKKFYAAVVPGLFGASNEISVSFENKNSKQTQQVTLVRKGNVYESKEAVSLNDFNPSQKVTFEINDAQKKLPTQKISTVVTYNKEYENYLTHRFSDELIVEGTPYTLQLSGNPVLSYKGNDKWQYLASGGNYTQPVNVIIERKGQPKPGQPIKAGEELHIKVQNSAYSGYEYLKLQDKYIHFDQKQNASTFKFNHAHSPGYLDYQREWHLQSDGNKLGFSTYDAGYISYGNDRQTYGGRFEDKWSLVKAK

SEQ ID NO: 26884 - protein, 213 aa, Bacillus cereus BAG1O-2
MYKKLGTIALTGALAFSLAACGSNEKTSNGVETKEKEQPKQETKKDNSKEGKTESAKGNRSNPIAFNETASIDDVILNTDGGEFKKFKAKVEVSILEVIRGEQAFGILKKENEFNEPAPEGKEWVLVKVKGKVVDAETQDFEYLLSDMNFKLVSKEGQVYNHELSAVTPNQLHQKLYKGAEGEGYISQVVNAGDDFTIQFETQKQNKVFFKSK

SEQ ID NO: 26885 - protein, 890 aa, Bacillus cereus BAG1O-2
MKNKKEIAIVALTTGLALTAVAPYGIGHAEETDQLQVQMQEESFRSGELTQPSQKTPENVVKDALKEKTEQALSPKQVNGETGVDYKVFQKRGSYDGTTLVRMQQTYEGKEVYGHQLTAHVDNKGVIKSVSGDSAQNLKQEDLKKPIKLSKEEAKQYIYTKYGSDIKFISEPEVKEVIFVDENNGQASNAYQVTFAAATPSYVSGTYLVNADNGEMLKNMVQESGLKVSEEHAEPLKESRKNNFVSLTGTGKDDLGITRTFGISEQSNGKYALADYTRGQGIETYDVNYRDITNEEKYYPGILVTSTSPTFTDPKAVSAHFLATKVYDFYKDKYKRNSFDNKGKKVVSVVHAWDSGGTNNPKNWENAFSANINKISMLIYGDPMVKAFDIVGHEFTHAVTSSESNLEFFGESGAINEALSDIMGTAIEKYINNGEFNWTTGEQTGSVFRNMKNPSSINYSNGVPYPDDYSKYNDLNGEDNGGIHFNSSIINKVAYLIAQGGTHNGVTVNGIGEDKMFDIFYYANTDELNMTSNFSELRLACLKVATNKYGANSIEVQAVQKAFDAAKIKETVKENEKTAENQVPELTVPSTITLRVGDTFDPMRNVTAADKEDGDLTNRVQHKGDVDTSKPGKYIVNYLVVDSQGGNATDTQTVIVEKNEEILDIEPKLTAPIGVTINVGDSFVPMTEVLAIDKEDGDLTSKVKVDGKVDTSKAGTYVLTYTVTDSKGHEVTAKQTVTVTVREEVKNDNPILKVPATTTINENDQFDPMVGVSATNKKNDDLTSKVKVDGKVDTSKADTYEIIYSVRDSVGNEVKAIQKVLVKDKDTSKANGLANNSNISNNSNSDKKEYTYKELPKTGASTTNSAVMGMLMVIAGTVLTLIRKFRKTHK

SEQ ID NO: 26886 - protein, 971 aa, Bacillus cereus BAG1O-2
MKGYSKKVLVGVSFASLLLGSFQGSISAENTKEEQVSYRNVLKMEPVGVQLPVQELAHSSKVLENKSFEKRLQFADLSQRPPEVKKESKQLAVAKTYTIAELNQFSNQQLVDLLVTIDWEQITGLFQFNKDSLAFYQNDSRMQAIIDKLKQQGQTYTQDDSKGIETLVEVLRSGFYLGFYNTELSKLNERSYHDKCLPALKTIASNPNFKLGTLEQNRVVSSYGKLIGNASSDVETITSAAKIFKQYNDSFSTLVDNLSAGNAIYDIMQGVDYDIQSYLYDTRKVPKDTVWYQKIDSYINELSRFALMGTITAKNGWLINNGIYYTGRLGTFHSTGTKGLQVVTDAMNIYPYLGEQYFVAAEQIATNYGGKDANGNMVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDTNLNKEYQDYMQMLVDNRDKYNVPLVSEDYLARHASKPVSDIAAEITAEANVKNVSVKKNKSQFFNTFTLQGTYTGTAAKGEYEDWKTITQKVNDTLKRLSTKEWTGYKTVTAYFVNYRVNASGQFEYDVVFHGMNTEEGAVNKAPVAVINGPYSGNVNEAISFKSDGSKDEDGKIASYKWEFGDGTVSNEQNSTHIYTKEGTYTAKLTVTDDKGATNTATTSVTVKKKEDNSVEKEPNNSFQTANKLQLNQILRASLGNGDTSDFFEINVETAKNLQINVTKENNIGVNWVLYSEADLNNYVTYAQQQGNQLVGSYYTYPGKYYLHVYQYGGGTGNYTVEVK

SEQ ID NO: 26887 - protein, 455 aa, Bacillus cereus BAG1O-2
MNNRILKHLQNMKMNKKSLGAVALTAGIIGTTLIPQNAYAHGFVEKPGSRSALCSPTYGALNVNCGSVMYEPQSLEAPKGFPQAGPVDGQIASAGGKFGGILDQQTADRWFKNTITGGENTFTWKFTAPHLTSKWHYYITKIGWNPNKALTRADFEPIGTVQHDGSAASNNVAHKINVPTDRSGYHVILAVWDVADTANAFYNVIDVNLINNVKPDTEAPSIPNGIQTQKVTANSIELTWNTSTDNVGVKGYQIFRNGEMIDTVPGTHFIDKKLQPSTEYSYTVKAIDAAGNVSKESTALTAKTTVEAPDTEAPTQPKGLHSMGTTASSVDLMWSPSDDNVGVDHYDIYREIEGTMKKIATSNTTSYMDNNLLANKTYKYVVKAVDVAGNESVQSDIFTITTKTESVSYGEWDAKKAYKKGDRVLYEGKVYEAVQNHQGNGDPNWIYALSLWRAV

SEQ ID NO: 26888 - protein, 553 aa, Bacillus cereus BAG1O-2
MKKILSVLLVVFLTFSAWSSVLVKAASSTKGSLTIHKYEQEKDGTTGVEGDGSANQEVPTNAKPLKGVTFEVIRVASFEQISNDGKIVKEDVKPVTGATPSQVVTDDNGQAVLKDLPLGRYEVKEVAGPPHVNLNPNTYTVDIPLTNKEGKVLNYDVHMYPKNEIKRGAVDLIKTGANDKALAGAAFSVFKKDGTEVKKELVTDANGHIRVQGLEYGEYYFQETKAPKGYVIDPTKREFFIKNSGTINEDGTITSGTVVKVEVKNYEEPTIDKKINGNLEALPINPLTNYNYDIKTLIPEDIKEYKKYVVTDTLDNRLVMQGKPIVKIDGAEVNASIVDVTVEGQKVTATVKDFTKLDGKKEFHLQIKSQVKEGIPSSSEILNTAKIDFTNKNDVIGDKESKPVVVVPTTGIIELSKIDGDDKKELKGAEFVLKDKKGKIVVVAGKEVIGVSDENGVIKWANIPYGDYQIFETKAPTYTKEDGTTASYQLLKDPIDVKVSENNQTVKLTIENNKSGWILPVTGGIGTTLFTVLGLMLMVTAAFVFFRKKFANK

SEQ ID NO: 26889 - protein, 738 aa, Bacillus cereus BAG1O-2
MKQLKPAISVLGSVSMALTLASPALADVKQPNPGGTVEIFKENVNVKKEDKNFTLGSDGEIGSLITQNIEMANNDWDKDGISNDLEMNGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRVYTPKDKSLADTPVLSYNEVFQHVNIDTKKVNHIVNKAKSTNNVSVVSANNGTDALNDLKAGQGNRGYLHKDSVHGAFAKLQQPTLVEGSFDSVTQKIRATILPGLFGVSKEIPTTYSKKWNAPSQTVTLVKRENGFTYESRENIHPIKSEIASHRKVTFEINDAHNLTPTQKIDTEIKANKEFEDYVVDNSGEFVTEGVPYTVASYGNTAYWGSHHAGNKWEYLWAEKSSDEKVNVIIERVGQPKPGKPIKKDEEVLIKFRNPIYSDYAYLKLQDSYIHLDQKQNASTFKFNHAYPKNFTGYHKQWNILSNGNKLKVGYLIDYMKYGNGENGTDTIAWNLSRVQ

SEQ ID NO: 26890 - protein, 458 aa, Bacillus cereus BAG1O-2
MNLKLISKLERLRKSKKGIGAFVLAAGVTAITMVPQSAYAHGFVEKPSSRAALCSQNYGALNLNCGNVMYEPQSLEAPKGFPDGGPIDGKIASAGGLFGGTLDQQTSSRWFKNTIKGGANTFTWKYTAAHSTSKWHYYITKKGWDPNKPLTRAELEPIGTVKHDGSAASNNLTHTINVPTDRNGYHVILAVWDVADTSNAFYNVIDVNLVNNETPDTVAPSQPTGLNASKVAANSVEITWKASTDNIGVKEYQVLRNGEVIDTVPGTTFIDKKLKADTEYTYTIKALDTAGNISKESEKLKVKTTNETPDIEAPTQPKGLHSMGTTATTVDLMWSPSEDNVGVDHYIVYRESAGVMNKIGTADNTSFMDKNLKANTSYKYVVTAVDLAGNESSRSDVLNVTTKSEDSTYEKWDARKAYTKGDRVVYEGKVYEAVQDHQGNGDSNWIFALSLWKPVMNK

SEQ ID NO: 26891 - protein, 370 aa, Bacillus cereus BAG1O-2
MKTKQTIAASTLALAMIAGANSAHAEVNDTTPQQNTGDRLAEIKQHRQELDAKLQQHKENVDQTLNELNQVKENVDTKVNELHERKQVADEKINEMKQHKQELDAKLQQDKQIVDEKINEIKEHKKQVDDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQKARQDLLNKINEIKQAKQTVSDDLTKKKQDLDIKINDFKHTEKKIDDKLAEVHTTKQNVDNKINEISQSKQTQADNSTKNNNARELPNAGSEQSNNMALGMLSVLGSVLLVTRNKIKTLFSK

SEQ ID NO: 26892 - protein, 878 aa, Bacillus cereus BAG1O-2
MVKYSKISKWILGVGLVTITCNGLQIQAETKEKNVKNVLQMEPVGIQKSVDELAHPSKVQENASFTKRLKLADLSQRPLAPTDNIKPLAEEKKYSMAELNQLSNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTIWYRNIDNFINEVSRFALLGTVSDKNGWLINNGIYYAGRLGKLHSTPTKGQQVVTDAMRIYPFLGEQYFVAAEQITTNYGGIDANGKTVNLDQIREEGKKKYLPKTYTFDDGAIVFKAGDKVSEEKIKRLYWAAKEVRSQFYRTVGSDKPLENGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGSTRLNSVVPRKSIIGGLSNDPAKRYTASQTLNAKYGTWDFYNYSFALQSYMYNKRPEMFDKVHDLIRANDVSSYDAYRSALSKDNNLNEEYQSYMQMLIDNRDKYTIPQVSDEYLAQHDPKSLSDITSDITNEAKLKGVKVTKNKSQFFNTFTLQGTYTGSSAKGEIEDWKVMNEATNEMLKRISGKEWTGYKTLTAYFINYRVNHAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 26893 - protein, 431 aa, Bacillus cereus BAG1O-2
MSTIIDVYAREVLDSRGNPTVEVEVYTESGAFGRAIVPSGASTGEHEAVELRDGDKSRYLGKGVINAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 26894 - protein, 746 aa, Bacillus cereus BAG1X1-2
MGNNSKHKTRKILAATATVTMLATGMISSSDVFAEQKEQQKNLSTSLQSEKSVKSENITFTVPGKGDVEVLKQQERKSMAFSPYEPTGLYAKPNEQITINVEGNQDIQVYIGTYSYDASWREDSKIKSFTLKPGVNTIQSPNGGLIYFYNKQQGGTIRTTITTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYATSYRTAYVGDAIQYVLDINKFITDGWGPWHEAGHLRQQSPWKFYNMTEVQNNIYSLSVEKAFNQPSNLEKSGIYPKAFQYLEQVNKNYDEISDVFVKLVMLWQLQLAYGEDFYPKLHQLYRDMPSSELPQTDENKKQLFMISASKVAKQNLIPFFEKWGLRPNNDTIQKVAALGYPILTAEIWKGTDSNPIKPDMPDVNNILEGNQFAWSLKGIGDFEFAKVNLNKSTEEMQIDLKAGVPHNYFDSTYASIKVQNTSGKVVYNKEFYGNKQQNAGTQKVSVKTGDLIELTHLEGRERATLINLDNNKRENLDKKVMYEVTKDGLKKVNQIVNPKPDTEAPTQPQGLYASNLTSNSVELKWNPSTDNIGVKEYQVLRDGQLIQTVQGTTFIDQNLTANKEYKYAVKAVDAAGNTSIQSEILPVKTKDQNVSYEKWDPKKAYTKGDKVEHQGTVYEAVQNHQGNGDPNWIFALSLWKPLTIK

SEQ ID NO: 26895 - protein, 971 aa, Bacillus cereus BAG1X1-2
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNIDSLAFYQNDSRMQAIIDKLKQQGQAYTKDDSKGIETLVEVVRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPEERYTAERTLNAKYGTWDFYNYSFALQSYMYNKRYNMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNASGQFEYDVVFHGINTEEGAENKAPVAVINGPYSGNVNEAISFKSDGSKDEDWKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 26896 - protein, 893 aa, Bacillus cereus BAG1X1-2
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANTDELNMTSDFSELRLACLTVATNKYGTNSIEVQAIQNAFDAAKITGTVKENEKTVENQAPELTVPITITLRVGDTFDPMRNVKAVDKEDGDLTNKVKHKGDVDTSKSGTYIMEYMVVDSQGRNATATQTVIVEKNGETSDLEPKLTVPVGATIHVGDSFVSMAEVLAIDKEDGDLTSKIKVDGEVDTSKAGTYILTYTVTDSKGHEVTAKQTVTVKVREEVKNDKPILKVPATTSITEGDQFDPLVGVSATDKEDGDLTSKVAYEGTIDTTKAGTYEIIYSVRDSVGNEVNTIQKVLVKDKETSKPNGLANKTNNNNISNNSNTDKKEYTYKELPKTGVSTTNSAAIGILMIIAGTVLTLIRKFRKIQK

SEQ ID NO: 26897 - protein, 336 aa, Bacillus cereus BAG1X1-2
MKRSKTYLKCLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKSFTLDWKNKKLVEKK

SEQ ID NO: 26898 - protein, 333 aa, Bacillus cereus BAG1X1-2
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTNQLKEIQDFIKNKNIPNNEYVLIGGDMNVNKINAENNNDSEYASMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 26899 - protein, 229 aa, Bacillus cereus BAG1X1-2
METLAVLIFLASIVLFVLFIIALFKRKPKAKLFISSIVCLVLAMILIPTKDKEEKPKAKETTQQASTEVKKEPKKEEPKKKDEPKEEEPKKEEPKKELSKEGESSKVKITVGSVESVDSVGGEYLNEKAKGIYKVVEISITNNQKDAITVDANSFKLMDNQDREFKYSTQAQTAYDIGNSGKSDFFLKQLNPGLTQTGKIIFDVPADAQGLVLKARGGMMGKEIKLKVE

SEQ ID NO: 26900 - protein, 172 aa, Bacillus cereus BAG1X1-2
MGKIFKFGCLGIIVLFVIGIIAMVAGGGDSTETTSTDTKAVSKEGVSSDVKIAVGSMETVDSVGNEYTKEQAQGVFKILEVTLTNNQKDAITVDANSFKLVDSKGREFTYSTQGQTSFDLANGGKTDFFLKQLNPGLTQTGKIVFDIPKDAEGIFLKASGGMTGKEIKLKVE

SEQ ID NO: 26901 - protein, 738 aa, Bacillus cereus BAG1X1-2
MKQLKPAISVLGSVSMALTLASPALADVKQPNPGGTVEIFKENANAKKEDKNFTLGSDGEIGSLITQNIEMANNDWDKDGISNDLEINGYKIEFNSQTGKNEAKAWDPEKDKGKPKFISNPMNANTDGDPFTDMYEVENYNNDSDTNFNPIIANIPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVHAATEQLETDIGNIPKFRVYTPKDKSLADKPVLSYNEVFQHVNIDTKKVNHIVNKAKSTNNVSVVSANNGTDALNDLKAGQGDRGYLHKDSVHGAFAKLQQPTLVEGSYDSVTQKIRATILPGLFGVSKEIPTTYSKKWNAPSQTVKLVKRENGFTYESRENIHPIKSEIAAHRKVTFEINDAHNLTPKQKIDTEVKANKEFEDYVVDNSGEFVTEGIPYTIASYGNTAYWGSHHAGNKWEYLWAEQSSDEKVNVIIERVGQPKPGKPIKKDEEVLIKFHNPIYSDYAYLKLQDSYIHLDQKQNASTFKFNHAYPKNFTGHHKQWNILSNGNKLKVGYLIDYMKYGNGENGTDTIAWNLSRAQ

SEQ ID NO: 26902 - protein, 965 aa, Bacillus cereus BAG1X1-2
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTSENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDTYTVPEVADDYLAEHATKSLGAVKKEISDTLPMKDTKMTKHNSQFFNTFTLEGTYTGSVTKGESEDWKEMSKRVNESLEQLAQKEWSGYKTVTAYFVNYRVNSSNEFEYDVVFHGIAKDDGENKAPTVNINGPYNGLVKEGIQFKSDGSSDEDGKIASYLWEFGDGSTSAEVNPVHVYEREGSYKVSLRVKDDKGKESRSETTVTIKDGSLTESEPNNRPEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYELSVK

SEQ ID NO: 26903 - protein, 118 aa, Bacillus cereus BAG1X1-2
NGSGGSGSGDNGSGGNGSGGNGSGGSGSHSGNGSHGGNRVKGDSSSQGGNGSQGGNRVKGDSNSQKGNGSQGDNVKDNTKKQGDKLPNTATHYPISILMGLSTFLIGMLLFIRRKNVK

SEQ ID NO: 26904 - protein, 431 aa, Bacillus cereus BAG1X1-2; identical to SEQ ID NO: 26534

SEQ ID NO: 26905 - protein, 125 aa, Bacillus cereus BAG1X1-2
PKEPKEPEVKPEDPKEPKEPEVKPEDSKEPKEPEVKPEDPKEPKEPEVKPEDPKEPKEPEVKPEDPKDLKKPEVRLEKLNKDPQVKVEKELPKTGAAHPWMMSVGAGISFLVGGVLFVLGRRRKQ

SEQ ID NO: 26906 - protein, 458 aa, Bacillus cereus BAG1X1-2
MKLKLTSKLERLRTSKKGIGACVLAAGMTAITMTPQSAYAHGFVEKPSSRAALCSQNYGALNLNCGNVMYEPQSLEAPKGFPDSGPIDGKIASAGGLFGGILDQQTSNRWFKNTIKGGVNTFTWKYTAAHSTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDIEAPSQPKGLHSMGTTATTVDLMWSPSEDNVGVDHYIVYRESAGVMNKIGTAANTSFMDKDLKANTSYKYVVTAVDLAGNESSRSDVLNVTTKSEDSVYEKWDARKAYTKGDRVVHEGKVYEAVQNHQGNGDSNWIFALSLWKPVLNK

SEQ ID NO: 26907 - protein, 412 aa, Bacillus cereus BAG1X1-2
MKKAKEIAKCVAVASVIMSGSFGLQATSAFAESKGTVENLQNGGKVYNSFKTTYDMKQNIKNSIKVSFIEDPYADKKIAIVTTDGSNIDAKYTINSGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTETTSDLKITNRRISDQYNIEWVSSKWWGTNNKDTYNEFFTNHYKLDWKNHQVTLDKQKALEEQMNSINSVNDKLNKGKGKLSLSMNGNQLQATSSNAGYGISYEDKNWGIFVNGEKVYTFNEKLTVGNISNDINKLNIKGPYIEIKQI

SEQ ID NO: 26908 - protein, 1093 aa, Bacillus cereus BAG1X1-2
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLADAVFEVFNANNESVGKITTGADGMAELNNLPIGTYTLKEIKAPTGYVSDDKPQTIEVKTGETGAVQIVNNKVKGNIEIKKLSDSGKVLPNVEFTVFTEDGKEVQKVVTKENGIANVEGLTYGKYYFLETKTPNGYIGNKTKYPFEIKEHNKTLTFTVENTEVKGSVKLLKVDNEDISKKLEGAVFELKDESGKVVGEYKTDKNGEINVKDLAYGKYSFVEKASPHGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEIHTSKSVTIQDKVEYKDLQVGKEYTLKGKLMNKETNKPLVVNGKEVTAETKFTPKEANGSITLDFTFDATGLEEKEVVVFEELLKEGKIVTTHADINDKGQTVKFVKPSVKTTATNKADGGKEIHSKDSITIQDKVEYTNLVVGKEYTVKGKIMNKAINKPLLIDGKEVTAETKFTAKEKNGFVTLDFTFVGAEQQGREVVVFEDLLHEGQVIATHADINDVGQTVRFVEPSIKTTATNKADGSKELDASKSVTIQDKVEYKDLIVGKEYVVKGKLMDKATNKPLLVDGKEVTVESKFIAKEKNGSITLDFTFNASALQGKEVVVFEELYQDNILVAIHAEIEDKEQTVKFKEVKPEQPKPEQPNSDKNTPTPEQPNEQVKEQPQPKQEIQSKIGWLPQTGTNLTSWISMAAGALLLIVGGVIFLKRKNA

SEQ ID NO: 26909 - protein, 370 aa, Bacillus cereus BAG1X1-2
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNNNAKELPNAGSEQSNNMALGMLSVLGGILLLTRNKIKTLFSK

SEQ ID NO: 26910 - protein, 455 aa, Bacillus cereus BAG1X1-2
MNNRFLKQLQNMKMNKKSLGAVALTAGIISTTLIPQNAYAHGFVEKPGSRSALCSSTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVPGTHFIDKKLQPSTEYSYTVKAIDAAGNVSKESTALTVKTTVETPDTEAPTQPKGLHSMGTTASSVDLMWSPSDDNIGVDHYDIYRETEGSMKKIATSNTTSYMDKNLLANTTYKYVVKAVDVAGNESVQSDIFTITTKTESASHEAWDAKKAYKKGDRVLHEGKVYEAVQSYQGNGDPNWIYALSLWKTV

SEQ ID NO: 26911 - protein, 878 aa, Bacillus cereus BAG1X1-2
MVKYSKISKWILGVGLVTITCNGLQIQAETKEKNVKNVLQMEPVGIQKSVDELAHPSKVQENASFTKRLKLADLSQRPLAPNDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEVNRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPTKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDITSDITNEAKLKDVKVTKNKSQFFNTFTLQGTYTGSAAKGEVEDWKVMNEATNDMLKRLSGKEWTGYKTLTAYFVNYRVNNAGQYEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 26912 - protein, 285 aa, Bacillus cereus BAG1X1-2
SVGKYKLVETKSLPGYKKLTEPVSFEIKKGMTKVLSLKVENEKLDKGSVEITKMAAESKEVLSGAVFEVHDDKGKVVVKVTTDKDGKAKIADLSVGNYTLVEVEAPKGYEKLTNPIPFEITNGMINAVQLEVLNKLNHLAPPGPETPDPEKPGTPDPEKPGTPNPEKPGTPDPEKPGTPNPEKPGTPDPEKPGTPNPEKPGTPNPEKPGTPNPEKPGTPDPEKPGTPNPEKPGTPDPEKPGIPNPENPEKELPKTGQKMPVEPYMGVLLVMMSFGLLVLGRKQRR

SEQ ID NO: 26913 - protein, 553 aa, Bacillus cereus BAG1X1-2
MKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGAVFSLFKKDGTEVKKELVTDANGHIRVQGLEYGEYYFQETKAPKGYVIDPTKREFFVKNSGTINEDGTITSGTVVKIEVKNNEEPTIDKKINGKLEALPINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDSANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 26914 - protein, 503 aa, Bacillus cereus BAG1X1-2
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNSPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26915 - protein, 179 aa, Bacillus cereus BAG1X1-2
MNKKLLASLLCSTFLFGVSACSSHDAPEKNEQATSKKTENNKLSSKDPQKELPTNVDSSDVYMSMGSAESLDVLGTGEVKAQGVFKVLDIAVYNRKEEPITLDINNFKLIDGFGREYHISNEYQSVLKAANISTFKFNIVNPNESSEGNIVFDVPKNTQGLTLKINNDKLDKELQLKVE

SEQ ID NO: 26916 - protein, 183 aa, Bacillus cereus BAG1X1-2
MRKLSILLTFILVLVSVTAACTQDKTDSAVENGPIEEPTAKNENEELINFEEKEEMSRLEQGILLVGESVKGGYYLAAVQSAYLNASNDSVIVNVSVKNVRGQTIGLSELKYNLKDEKDGKIYKGKVLDQNPSDIQVKPNETVELKIAFEVPHTVDEYMFYIESSLDPLQTYWKIDKLQSQTN

SEQ ID NO: 26917 - protein, 456 aa, Bacillus cereus BAG1X1-3
MNKKILNQFRKMATNKKGLSAAVVAVGIMSTTLIPQNAYAHGFVEKPGSRAALCSQNYGALNLNCGNIMYEPQSLEAPKGFPQGGPVDGKIASAGGLFGGILDQQTADRWFKNTIKGGENTFTWKYTAPHSTSQWHYYITKKGWNPNKPLTRADFEPIGTVKHDGSAASNNLSHKINVPTDRSGYHVILAVWDVADTVNAFYNVIDVNLVNNEKPDTEAPTQPSGLQVVKATSNSVELNWKPATDNVGVKEYQVFRNGEVINTVAGTSVVDKKLSQNTEYTYTVKAVDAVGNISKESEALVIKTTVEKPDTEAPTQPKGLHSMGITANTVDLMWSPSEDNIDMDHYIVYRENAGDMKEIGTANTTSFMDRNLQVNTTYKYVVTAVDTAGNESMKSDVLTVTTKEQENTYEQWDSYKAYKKGDRVVHEGKEYEAAQSYQGNGDPNWIFALSLWNEIK

SEQ ID NO: 26918 - protein, 458 aa, Bacillus cereus BAG1X1-3
MNLKLTSKLERLRKSKKGIGACVLAAGVTAITMIPQSAYAHGFVEKPSSRAALCSQNYGALNLNCGNIMYEPQSLEAPKGFPDGGPIDGKIASAGGLFGGTLDQQTTNRWFKNTIKGGANTFTWKYTAAHPTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDIEAPTQPKGLHSMGTTATTVDLMWSPSEDNVGVDHYIVYRESAGVMNKIGTAANTSFMDKDLKANTSYKYVVTAVDLAGNESSRSDVLNVTTKSEDSTYEKWDARKAYTKGDRVVHEGKVYEAVQNHQGNGDSNWIFALSLWKPVLNK

SEQ ID NO: 26919 - protein, 173 aa, Bacillus cereus BAG1X1-3
MSYTDLGYFHLNAYLQDNKDQLPGKDINMEQKIKHLDRAFSVSSVPDNIVVYRRSNESAFGLEKGTLIKGNKLNKQEFLKFKNKFLGKYQTFYTYMSTSILKDASESFSGRPILICLTVPKGNHGAYLASLSTSPWEMEMLLPRNTTYKVNGISYVKNGNSNYVLADTSIMKA

SEQ ID NO: 26920 - protein, 738 aa, Bacillus cereus BAG1X1-3
MKKLKPALSVLGSVSMALTLASPALADVKQPNPGSTVEIFKENANAKKEDKDFTLGSDGEIGSLITQNIEMANNDWDKDGISNDLEINGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKVRVHLEYKNVGTASAENVSPHFNIRLGNKIINTVKATQDRYKANYLSTEKGGRNKTEVVIDSLEGQADANIVLSLDELKAVEQGEILSIEVLPTSTMDLSIEKGEEVMHLGDSGRYESRVNAATEQLETDMGNIPKFRVYTPKDKSLADKSVLSYNEVFQHINIDTNKVKHIVNKAKSNNQVSVVSDNNGTDALNTLKAGQGDRGYLHKDSVHGAFAKLQQPTLAEGSYDPVTQKIRASILPGLFGVSNEISTTYSKKWNAPSQTVTLVKRENGYTYESRENIHPIKSEIAAHRKVTFEINDAHNLTPTQKIDTEIKANKEFEDYVVDNSGEFVTEGVPYTVASYGNTAYWGSHHAGNKWEYLWAEKSNDEKVNVIIERVGQPKPGKPIKKDEEVFIKFQNPIYSDYAYLKLQDSYIHLDQKQNASTFKFNHAYPKNFTGHHKQWNILSNGNKLKVGYLIDYMKYGNGENGIDTIAWNLSRVQ

SEQ ID NO: 26921 - protein, 967 aa, Bacillus cereus BAG1X1-3
MNKKSRFTQMMLGISTMALSFGSIQTQVSAEENTPYNVLQKKPIGIETSTYEIAHSTKADEILSYEERLKVGDFSQRPAPVVKRAAAKQFQQKYSVAELNRMSNDEFIDTLASISWNQITDLDQFNQETKEFYQNKERIQVIIDELGRRGSTFTKDDTKGIETFAEVLRSISYVGFNNKEVSYLNERSFHDKCLPALKAIAKNPNFKFGTDKQDAVVSAYGKLIRNASCDAETVQYATNILKQYNDNISTYISDKKKGDALYELIQGIDDDIQSYLFETRKKADETIWYGKIDGYINEVSRMALFNHLTTENKWLINNGIYYTGRLGNFHSNPNKPLEVLTQAMHMYPRLSEAYFNAVEQISTNYGGKDYNGNTVDFKKIREEGQQQYLPKTYTFDDGSIVFKTGDKVAEEKVKKLYWAAKEVKAQYHRVIGKDGALESGKADDVLTIVIYNNPDEYKRNSQLYGYDTNNGGIYIEGIGTFFTFERTPQQSRYSLEELFRHEFTHYLQGRYEVPGSWGQGEMYQDQRLTWFEEGNAEFFAGSTRTNNVVPRKSIISGLSSDPAKRYTAERTLFSKYGEGDEKWDFYNYSFALQSYLYTHQFETFDKIQDFIRANDVKNYDAYREALSKDPNLNKGYQDYMKQLIDNQGTYNTPQVSDDYLATPSPKPLADVKKDITDVAKIKDATITKHKSQFFDTFTLEGTYTGGVTKGESEDWKMMSKKINQSLEQLAQKEWSGYNTVTAYFVNYRVNEKNQFEYDVVFHGVATGEEEKQTVKVNMNGPYNEILNEKVEFHSDGTESTGGKIVSYLWDFGDGTTSTEANPTHVYGKEGTYTAKLTVKDNKGKVGRGQTSVTVKQDEPAGHNYQNAKVIRFNKLSKGNMDRPNMAYMHTFNVTSPKEVDISFIDELGIGIQWDVYHESDLEHPVITGQADGNNIKGKFEAKPGKYYLVSFFEKENGKGTYSVLLQS

SEQ ID NO: 26922 - protein, 915 aa, Bacillus cereus BAG1X1-3
MKNKKRTATVALTTGLALTAVIPFGVGHAEETDQLQAQIQEDSFRTGELTQPSQKAPEDVVKDALKEKTEQALSPKQVNGEMGVDYKVLQKRGSYDGTTLVRMQQTYEGKEVYGYQLTAHVDKKGVIKSVSGDSAQNLKQEDLKKPINLSQEKAKQYIYTKYGNDIKFISEPEVKEVIFVDENNGQASNAYQVTFAVVTPKYVSGTYLVNAHNGEMLKNMVQESDLKASEKLVDALEESRKSNLASLTGTGNDAFGISRTFGISKQSNGEYALADYSRGQGIETYDVNYRDITKEESYYPGTLATSTSTTFNDPKSVSAHYLATKVFDFYKDKYKRNSFDNKGQKVVSVVHAWDSEDTNDPKNWKNALSANINNSSMLVYGDPMVKAFDVAGHEFTHAVTSSESNLEYSGESGAINEALSDIMGTAIEKYINNGNFNWTIGEQTGLVLRDMKNPSSINYSNGVPYPDDYSKYTNLNGEDDGGVHFNSSIINKVAYLIAKGGTHNGVTVKGIGEDKMFDIFYYANTDELNMTSDFFELRSACLRVATNKYGANSAEAQAVQKAFDAAKIKVTVEEKEKAVEKQAPDLTVPFITTLHVGDMFDPMRGVKAVDKEDGDLTNIVKHKGDVDTSKPGNYIVEYSVVDSQGVNGTATQTVIVEENGETPDMEPKLTVPVGATINVGDSFDPMARVSATNKEDGDLTSKVTVDGKVDTSKAGTYVLTYTVTDTKGHEVTAKQTVTVKAGEEVKDEKPVLKVPAETTIIEGNQFASMAGVSATDKEGGDLTSKVTHEGTVDTSKAGTYEVIYSVKDSAGNKVTTIQKVVVKDKDNGNGSNNRNNGSDNDNGPDNGSTGTNNSNASDTGNSNISNNSTTDKKEDTYKELPKTGASTNNSAAMGVLMVLAGMVLSFGRKFRKVLK

SEQ ID NO: 26923 - protein, 71 aa, Bacillus cereus BAG1X1-3
KPGTTDPEKPGTTNPEKPGTTDPEKPGTTNPEKPEKELPKTGQKMPVEPYMGALLVMMSFGLLVLGRKQQR

SEQ ID NO: 26924 - protein, 746 aa, Bacillus cereus BAG1X1-3
MGNNSKHKTRKILAATATVTMLATGMISSSDVFAEQKEQQKNLSTSLQGKNSVKSENRTYTVPGKGDVEVLKQQERKSMAFSPYEPTGLYAKPNEQITINVEGNQDIQVYIGTYSYDASWREDSKIKSFTLKPGINTIQSPNGGMIYFYNKQQGGTIRTTITTGGTTTPFFELGKHTKQDLINMMDQYPNAHAVELKGERVLITASPARVKKYLLGSNTDPVQLLKKMDEATRIQDKVAGLSEEQVDKHYIHYVEENHSPDYYMYATSYRTAYVGDAIQYVLDINKFVKDGWGPWHEAGHLRQQSPWKFYNMTEVQNNIYSLSVEKAFNQPSNLEKSGIYPKAFQYLEQANKNYDEISDVFVKLVMLWQLQLAYGEDFYPKLHQLYRDMPSGELPQTDENKKQLFMISASKVAKQNLIPFFEKWGLRPNNDTIQKVAALGYPILTAEIWKGTDSNPIKPDMPNVNNILEGNQFAWSLKGIGDFEFAKVNLNKSTEEMQIDLKAGVPHNYFDSTYASIKVQNTSGKVVYNKEFYGNKQQNAETQKASVKTGDFIELTHLEGGERATLINLDNNKRESLDKKVMYEVTKDGLKKVNQIVNPKPDTEAPTQPQGLYASNLTSNSVELKWNPSTDNIGVKEYQVLRDGQLIQTVQGTTFIDQTLTANKEYKYAVKAVDAAGNTSIQSEILPVKTKDQNVSYEKWDPKKAYTKGDKVEHQGTVYEAVQNHQGNGDPNWIFALSLWKPLTIK

SEQ ID NO: 26925 - protein, 789 aa, Bacillus cereus BAG1X1-3
MKFIKGIFVSTIALTAFTGLELIKFHENPDEVYADSKDSVKNISQSEADIKEEDQIIVKFKSEVNFPYKDGLEKQIKNEDSDPELVKIFSELPQLTLKRLFTSVDPIEIENIDKDTRETEKKSSSNLLDYYMVEVPNKVTAEALMDKFKKSHLVEEVYMQEKPTLLPEIQLPTLSLSPYDDPRFLNQGYLKEAPYGINASYAWSIKGGDGKGTTFVDMEYGWLLDHEDLVNQKIELISGRNIDQHVGHGTSVLGIVSAEDNKVGNIGIAPKAKVKVVSQIRGDGSYNTADAIINAVHNLQAGDILLLEAQASYDGYGDKYLPVEVQPAIFDAIRAGTDKGIIVIEAGANGTNDLDQFRDKNGKQVLNRNSPDFKDSGAIMIGAASSTVPHKRLWFSNYGSRIDVYGWGENVDTTRAEPNRITKNLYTTGFSGTSSASPIIAGAATSIQGVAKEHLGRPYKPAELRNILSNPNTGTKSQDPSIDKIGVLPDLKSILSNLGYSPDISNTVNTLEGNQFVWSMKGIGDFEFAKLDFNKTKEEMQIQLKAGVPHHYFDSTYASVKVQNSSGKVLYNKDIYGNRQQNADTQKVSVKVGDYIEFTHLEGGNRATLINVDKNVQESFGKKIVYQVTVNGLKKVDQIINPNPDTEAPTQPQGLQATNITANSVDLKWNPSTDNVGVKEYQVLRDGKFIQTVQGTTFTDSKLTANIEYKYTVKAIDTAGNQSIQSSALSIKTKEQNTSYEKWDPKKAYTKGDRVEYQGKIYEAVQSYQGNGDSNWIFSLSLWRPITAS

SEQ ID NO: 26926 - protein, 712 aa, Bacillus cereus BAG1X1-3
MGNKTAKSKKLVGLVATATLATSMIAGASNTNAQTTDSLKVNGPIQATAEDKKENLPENQAPVLTGIYDSTIHVGDTFIPMLAVSAFDPEDGDITSKVTVGGKVDTFKPGTYELTYTVTDSKGLNVTVKRTVTVKENMKPTLTVPLRATINVGDKFDPMAGVSASDPEDGDITSKVTVDGKVDTSKAGTYELTYTVTNSKGLNVTEKQTVTVKEKEGTKNEAPVLTVPNFTTLHVGDTFDPMLGVSAFDLEDGDITSKVSNAGADEVDTSKPGKYFIVYGVTDSQGENTYTVRIVYVVDNEETPDLEPKLTVPVGATINVGDSFDPMAGVSAIDLEDGDITSKVTVDGKADTSKTGTYVLIYAVTDSKGHKVTAKQTVTVKEKEEIKNEAPVLTVPFTTTVHIGDTFDPMKGVKAVDKEDGDLISKVKHTGNVDTSKPGKYIVEYGIVDSQGVNATATQTVIVEGNGETPDMEPKLTVPVGATINVGDKFDSMAGVAAIDKEDGDITSKVLVDGKVDTSKAGTYELTYTVTDSKGHKVTAKQTVTVKEKEESKGEAPVLTVLAEVTMNVGDKFDPMASVAAIDKEDGDITDKVIHFGEVDTSKAGTYEVKFLVRDSDGNESTMTQKVVVKDKDNGNGSDNENNGNNNTNNGNKENNGKSNNSNNSTSDKKEDTYKQLPKTGASSNNSTAVGVLMVLAGMVITFGRKFKKALK

SEQ ID NO: 26927 - protein, 333 aa, Bacillus cereus BAG1X1-3
MKSKLLKVVLSFGMSLAALYSGSSVQAEMSTNQNDTLKVMTHNVYMLSTNLYPNWGQSQRADLIGAADYIKNQDVLILNEVFDNSASNRLLENLKKEYPNQTAVLGRSSGSEWDKTLGNYSSSTPEDGGVAIVSKWPIVEKIQYVFEKGCGPDNLSNKGFVYTKVKKNDRFVHVIGTHLQAEDSMCGNTSPASVRTKQLQEIQEFIKNKNIPNNEYVLIGGDMNVNKINAENNSDSEYASMFKTLHASIPSYTGHTATWDATTNSIAKYNFPDSPAEYLDYIIASKDHANPSHIENKVLQPKSPQWTVTSWFKKYTYDDYSDHYPVESTISMK

SEQ ID NO: 26928 - protein, 965 aa, Bacillus cereus BAG1X1-3
MNKKSKINKVMLSISTMALSLGALQTHASAEEKVPYNVLKTKPVGIEKPVDEVGHISKVDETLSFQERLKVGDFSQRPASIMKSSEVKQVKESYSMADLNKMNNQELVETLGSIKWNQITDLFQFNEDAKAFYKDNGKMQAVIDELAHRGSTFTKEDSKGIQTFTEVLRSAFYIAFYNNELSDLNERSFQDKCLPALKAIATNPNFKLGTYEQDSVVSAYGKLISNASSDAETVQYAANILKQYNDNFHTYVDDRMKGQAVYDMMQGIDYDMQSYLFETRKEAKDTMWYGKVDGLINEINRIALLNQVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLVEHAPKALTEVKKEISDTLSMKDTKMTKHTSQFFNTFTLEGTFTGSVTKGESADWKTMSKRVNEALEQLTQKEWSGYKTVTAYFVNYRVNSSNEFEYDVVFHGIAKDDGENKAPTVNVNGPYNGGVKEGIQFKSDGSNDEDGKIVSYLWDFGEGRTSKEVNPVHAYEREGIYKVALRVKDDKGKESRSETTVTIKDGSLTESEPNNRPEEANHIGLNTTIKGSLIGGDHTDTYTFNVASAKDIDISVLNEYRIGMTWVLHHESDMQNYAAYGQANGNHIEAKFNAKPGKYYLYVYKYDNGDGTYALSVK

SEQ ID NO: 26929 - protein, 184 aa, Bacillus cereus BAG1X1-3
MRKLSILLTLILVLVSVTAACTQDKKDSAVENGPIEEPTAKNENEELINFEEEEEDMSRLEQGILLVGESAKGGYYLTEVQSAYLNDSNDSIVVNVSVKNVRGQMIGLSELKYNLKDEKDGKTYEGKVLDQNPSDIQVKPNETVELKIAFEVPGTADEYMFYIESSLESLEAHWKIDKLQSQKN

SEQ ID NO: 26930 - protein, 182 aa, Bacillus cereus BAG1X1-3
MNKRLLTSLLCSTFLFGLSACGSHDTSSSNTKNEQETSKETKNDELSDKDPQKEFPTSGNSSDVYISIGPVDSLDVIGNGEVQAQGVFKVLDVRVHNDKEEPITLHSDNFKLIDGIGREYHISNEFQLTLKAANTATLKFGVLNPHENSEGNIVFDVPKNTQGLTLKVSGDMLGNGIDLKVE

SEQ ID NO: 26931 - protein, 129 aa, Bacillus cereus BAG1X1-3
EASDWKYAFKDLAAYDAEGKAYKYEVKEQPVEGYKSEVRGYDITNTKIKDGTVVDPIENAPPKVDTEVPPTKENTTSNINTEVSPTKENNKTSAWLPKTGGTSMEMISIIAGMLMLILGGVLFARQRMR

SEQ ID NO: 26932 - protein, 769 aa, Bacillus cereus BAG1X1-3
MKKLKPIIGAVSSLTMALTITSPALAETKPEQEGKVETFKEDTNLKEGQNIIYGDSGKKGIMIMEKPQENNDWDEDGIPNDVEEKGFKIVFNEKTGKHEAQLYDLVQDFGKKRFITNPKSANSDGDPFTDSYEVEHYDSDSDIDFNPMIANVPNLQIAVKRIDITPVASITDSNGDSRTNTWEKSLSVQHSFNVGLAGEGGAEGSAAGPVPSGKGSINVGYGYSNTKTETESISNSFDWSTATTVDSSKAANVRLHLEYKNTGTASAGDVSPHFNIRLGNKIINTVKATQDRYKANLLTTAKGGNNKTEILMDSIEGQADVKISLTLDELKAVEQGAPLSIEVLPTSTMNVYTMKDGQFVNLGDWSHFASNVNASTTLVETNYGPMPKYRVYTPRTGKEKPANINHNLSLDEFFAHTGIADKGWVANYVVNGRLNEDRERYGPNRTLLERGKNLGFFDNRALRPTLSYSSYDYSKKKIYASVIPGIFNLSDEIFVTVRNKKGENQKVTLVRNQNSNVYESKENEPVDIAVNRASLGGYQAKFELLDAKENKIEVFTPLVSNKSYLEAIDKLVVDNSGEPIVEGKKYYLKSSVGFYDGVKESWSAGTINQSINGRYVHFSLKGNNWDGLRLGPIQQAIHGPDIQATPVLIERKGKSKPEEPFKKDEEVFLKFTNSSHNNYQYLNFGNGYDYSWLDTEHNRSAIKLDKIPNQKSFYIKSDSNYITSRENQWTSSVADNGIAPLVGAGERVLKSEHTTSPGNYHQWELESSK

SEQ ID NO: 26933 - protein, 183 aa, Bacillus cereus BAG1X1-3
MGKIFKFGCLGFIGLIVLGIIASSLGGGDDKKEQSSTESKQETKAPAAKEELSKEGESSKVKISVGSVESADSVGGEYLKEKAQGVFKVVEVTVTNNQKDAITVDANSFKLVDNKDREFTYSTQAQTAFDVGNGGQSDFFLKQLNPGLSQTGKIIFDIPADAQGLVLKARGGMTGKEIKLKVE

SEQ ID NO: 26934 - protein, 378 aa, Bacillus cereus BAG1X1-3
MKTKQTIAASTLALAMIAGSTPTHAEVNDATPQQSTGDRLAEIKQHRQELDAKLQQHKENVDQTLNELNQVKENVDTKVNELHERKQVADEKIGEIKQHKQELDAKLQQDKQIAEDKIAEIKEHKKQVDDKVAEIKEHKQNIDNKVTEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQEARQDLLNKINEMKQAKQTVSDDLSKKKQDLDIKINDFKHTEKKIDDKLAELHTTKQNVDNKINEVSQPKQTTVNNSTTTTPSTVPAKNNAKELPNAGSEQSNNMALGMLSILGGILLVTRNKIKTLFSK

SEQ ID NO: 26935 - protein, 503 aa, Bacillus cereus BAG1X1-3
MLNKKMVAMAMTVPLVMGTISTVSALEKQQQVKLEAYSPQKKAIEYLKGHATEYGLKADLSDLQYISTTETSVASYVRFQQVVNGAPVFSKQITVTINGQGQGLLAVSDYQAVQSVKEIANKISEKDAEQKSMAYVGGESEQNLWAPTEKEFGYIIEDGVAIPVYKVLVHSNKPFGAWETFIDAENGKLIKKVDINRKAEGSGKVFLPNPVVSSGSKVGLKDNNDADSTALTNQLKTVTLKGLDGSGSLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDATAYSSSDPTCLRRLDTNKVYPKDITNEVHNDGEIWAQGQYEMAQSFGRDVATKIILQSHWSLTPNAKFSDGAKAIKQADALLYGGQHAAEIDRIWAARGISTN

SEQ ID NO: 26936 - protein, 971 aa, Bacillus cereus BAG1X1-3
MKGYSKKVLVGVSFASLMLGSFQGSILAEDTKGEQVSYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTKDDSKGIETLVEVLRSGFYLGFYNAELSKLNERSYHDKCLPALKTIANNPNFKLGTLEQNRVVSSYGKLIGNASSDVETITSVAKIFKQYNDNFSTLVDNLSAGNAIYDIMQGVDYDIQSYLYDTRKAPKDTVWYQRIDSYINELSRFALMGTITEKNGWLINNGIYYTGRLGIFHSTGTKGLQVATDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKLYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSALSQDANLNKEYQDYMQMLIDNREKYNVPLVSDDYLATHAPKPVSDIAAEITAEAKLSNVSVKKNKSQFFNTFTLQGTYTGTSAKGENEDWKTITQNVNDTLKRLSAKEWTGYKTVTAYFVNYRVNASGQFEYDVVFHGINTEEGAVNKAPIAVINGPYNGNVNEAISFKSDGSKDEDGKIASYKWEFGDGAVSNEQNPTHVYTKEGTYTAKLTVTDDKGLTNTATASVTVQKKEDNSVEKEPNNSFQTANKLQLNQLLRASLGNGDTSDYFEINVETARNLQINVTKENNIGINWVLYSAADLNNYVTYAQTQGNKLVGSYNAHPGKYYLHVYQYGGGTGNYTVEVK

SEQ ID NO: 26937 - protein, 431 aa, Bacillus cereus BAG1X1-3; identical to SEQ ID NO: 26106

SEQ ID NO: 26938 - protein, 164 aa, Bacillus cereus BAG1X1-3
MKKKLLPICAMALLTVGYSSVASADTGTLTKEESAQMQQDKAKKEEVIKEQQKSEVEKKEAAQVQEKSDMAKKEEAIKAGQKNDTAKKEVTPQVQEKEALAKKEEAIKAGQKNDAAKKEVAKPAVQGEKLPKTASNNVAMMALSACLVGIGTLFGLKRRNKVKA

SEQ ID NO: 26939 - protein, 79 aa, Bacillus cereus BAG2X1-1
DSDSDSDSDSDSDAESESNNSSNNGSNGGTNSNPGNHLPQTGGQNESSMLASLGALLTALGSSLFFFNRRKKNTKNSTN

SEQ ID NO: 26940 - protein, 878 aa, Bacillus cereus BAG2X1-1
MVKYSKFSKLIISVGLVTISCSGLQIQAETKEKSVKNVLQMEPVGLRKSVDELAHPSNVQENGSFTKRLKLADLSQRPPMPNENAKQLVEEKKYSMAELNQLSNKQLTDLLVTIQWYQIPELFQFNNESLKFYQDDSRMQAIIAKLAEQGQAYTKDDSKGIQTLVEVLRSGFYLGFYHQELSKLSERVYHDKCLPALKTIAKNPNFKLGTTEQNKVISSYGMLIGGASADVEVIQYAGEIFKQYNDNLSTFIEDRTKGDAVYNLMKEVDYEVQSYMNATGKEPKDMLWYGKIDGFINEINRFALIGTVTDKNGWLINNGIYYASRFGKFYSTPTKGQQVVTEAMGIYPYLGQQYFVAAEQIATNYGGIDANGKTVNLDQIREDGKKHYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQDERLTWFEEGNAEFFAGSTRLDSVVPRKSIIGGLSNDPAKRYTAAQTLNARYGTWDFYNYSFALQSYMYNNRPEMFDKVHDLIRANDVSSYDAYRSTLSKDNKLNEEYQSYMQMLIDNRDKYTIPQVSDEYLAQHAPKPLSDVAADITNEAKLKDVKITKNKSQFFNTFTLQGTYTGSVAKGEIEDWKVMNQATNGMLKQLSEKEWSGYKTLTAYFVNYRVNNAGQFEYDVVFSGLNTEEGTAVEKEPNNSFDTANPLLLNTILRGNLSDQDQVDRFVIDVKDPKDLQITVTNEQNLGLNWVLYSESDLNNYVTYATKHDGNKLLGNYNAKPGKYYLSVYKYGGGAGNYTVEVK

SEQ ID NO: 26941 - protein, 195 aa, Bacillus cereus BAG2X1-1
MLFLFYRQNTTKRCNCFCYDSFGNLTFYITGALAFSLAACGETEVKEVSKNDAPKQEEKKDKKASTENKVYKTGETVEINGLQITFNSAQFVEPNEYSKAEKGKVLEIDFAAKNNGKKDAYIGTEELKIADANGNQFKEYFGADNAFMNENIGPGNQITGKMYFDVAESDKYTGTYKPNFTLDDKSVKFEFTPAK

SEQ ID NO: 26942 - protein, 142 aa, Bacillus cereus BAG2X1-1
DSDSDSDSDSDSDSDSDSDSDSDSDSDSDSDSDSDSDSDSDSDSDSDSDSDSDSDSDSDSDSDSDSDSDSDSDSDSDSGSNNGSDNGSDKDSNSGSESDNSTKVLPKAGASNESSLLTSLGALFAALGSSLLFFNRRKKNTK

SEQ ID NO: 26943 - protein, 552 aa, Bacillus cereus BAG2X1-1
MMKRIFSLLLICVLAFSTLMNMTVSAESRSTGTLTIHKYEQKDGNPGVEGNGKAGQSVPEGAKPLKDVTFEIKRIASFEQINDGKVAKESIKDVTESAITKVTDANGEAVFQNLPLGRYEVKAINGPEHIELDKSTFIVDIPMTSADGKDLNYDVHIYPKNETKRGSVELIKKGEGDRVLEGAEFHLFKENENGTNTQIKTPHPLVTDSDGKIHVESLEYGEYYFIEEKAPKGYLTSKEEYPFSIKETGKLVKLEKDVKNYKEPTIEKTINDSSKNAGINRETEYTYDIKTLLPEDIQTYKNYVVTDVLDNRLEIVGTPVVMIDGKKVDESIVNVVVAGQKVMASVEDFSKVTGKELHLQITAKIKSDVQSGVEIPNKAVLDFVNKDDFTSEKDGKPSNEVVVTPTMGTIEIEKVDGKNKKLKLEGARFELRDKKGNVVTVNKKKMDDITDANGIITWNEIPYGEYQIVETVAPKYEDEDGAVEQYQKLRDPIDIKIDKDHKVIELQVENNKSGWIIPATGGMGTILFTAVGLLLMVTAAFIFFRKKPVKNS

SEQ ID NO: 26944 - protein, 532 aa, Bacillus cereus BAG2X1-1
MFKKVSAVTLVSLLALSPVAALAAPEDNNVKQVNVEKVDKEIEDGNNDAKLKELEQKKDQNQGNKEVSKEIEQTIKPEEKKEFKESKPSVEKKLESVEENKQEQKKENIGQKNVTPAKPVAPSGQVTNKPLAPPSSKVDEEETIDVSNFSGNVVGKAKWDPKENHYVLDITATVTNNSKEKASDLYIGIAIPKGLDGDFEDVHGVELEDGSEAIAIQLPEMDAGKTVTKNIKIPVLGNVAGEKVSKDIELYLIDHANNEYEPLGKIKGSANIDFSEMNKDIRFEGKVKATTCVQNLGENQFILDFLLTTQNLTIEDLKGFDVEIDVPKDIKLTIPDHYKQAEIPDYLKDASLQEGLHEGAMNLDIKWNGNVATIPVQAMEAGEGSVLYFQIVGETAKNLKDLKVTFTAKRGDQTVKKQVAIEKVENKDCKKKDDKNTAGNNNGEGTGNNTPNTKEPNSNQVIDKPNQITPTPVTPTPVTPTKVTPTPVTVSDKATLPKTGASQNDNLLTLVGVAMLVGSVLVHKRSRMNVNK

SEQ ID NO: 26945 - protein, 503 aa, Bacillus cereus BAG2X1-1
MLNKKMVAVAMTVPLVMGTISTASALEKQQQVKVEAYSPQKKAIEYLKANADQYGLKPDLSDLQYISTTETSVASYVRFQQIVNGAPVFSKQITVTLNGEGKGVLAVSDYQSVKGVKEVTAKISEKDAEQKSMAYVGGASEQNLWAPTEKEFGYIVEEGIALPVYKVVVHSNNPFGAWETFIDAENGKLIKKVDINRKAEGTGKVFLPNPIVSSGSLAGLKDNKDADSPALTNQLKTVTLKGLDGTGFLIGEYVTISSKAKTKSTNLQFNYTRANDSFEDVMSYYHIDTLQRYIQSIGFKNINNRSIKVNVNGTTADNSFYSPSTKALTFGTGGVDDAEDAGIIAHEYGHSIQDNQVPGFGSSAEGGAMGEGFGDFLGATYEDAVSATGYGKACVGEWDATAYSSSNPTCLRRLDNNKVYPKDIKNEVHDDGEIWAQGQYEMAQAFGRDVATKIILQSHWSLTPNAKFRDGAKAIKQADALLYGGQHASEIDRIWAARGISTN

SEQ ID NO: 26946 - protein, 183 aa, Bacillus cereus BAG2X1-1
MRKLSILLTFILVLVSVTAACTQDKTDSAIENGPIEEPTAKNENEELINFEEKEDMSRLEQGILLIGESVKGGYYLTSVQSAYLNDSNDSVIVNVSVKNVRGQTIGLSELKYNLKNEKDGKAYKGKVLDQNPSDIQVKPNETVELKIAFEVPGTADEYMFYIESSLDPLETYWKIDKLQSQKN

SEQ ID NO: 26947 - protein, 206 aa, Bacillus cereus BAG2X1-1
KPEEPKVTEEPNELEKPEVTDKPEIHVTPEEEQVEEETTEEIKEEKPETPKVTEEPNVLEKPEVTDKPEIHVTPEEEQVEEETTEEIKEEKPEEPKVTEEPNVLETPEVKEQPEILVTLEETTKELAEPSKPETPKVTEETSVLEKPEVQNKQDIHSQSDVPSSKENNKQSKSLPQTGGVSTESTSTIAGMLALILGAMMFRRKKN

SEQ ID NO: 26948 - protein, 364 aa, Bacillus cereus BAG2X1-1
MKTKQTIAASTLALAMIAGANSAHAEVNDATTQPSTGGDRLAEIKQHKQELDAKLQQHKEHVDQTLHELNQVKQTVDEKANELHEHKQVADEKIAEIKQHKQELDAKLQQDKQIADEKIAEMKEHKQTIDTKVNEIKEHKQTVDEKVNEIKQHKENIDVKVNELKEVKKHVDETLAELKKAKQTAEDKLAELKENKPNTGNTLEELKKIKGNLDSLSSNLELAKQDVQNKLAELQKARQDLENKLNEIKQSKQTVSDDLTQKKLDLDIKINDFKHTEKKIDDKLAELHTTQQNVDNKLNEVSQPTQPKPTTADTNNTTVPTKNTARELPNAGSEQSSNMALGMLSILGGLLLVTRNKIKTLFSK

SEQ ID NO: 26949 - protein, 179 aa, Bacillus cereus BAG2X1-1
MFKKIGTITLAGTLAFSLSACDEKEEVVKTVSNNTKEEQSSEKKEDANKEDTREYNVEKTTQIRDQKLTVHKVQIAQVAEYDKLEKGNEFVIVHVTVENVGNQKVRINPLDFYLERGDGSVVDHTFSTSNKNIFKIKDVDPNGKLTGAITFEAKKGDSNLQLIYRPDVMSKEEVKVKLK

SEQ ID NO: 26950 - protein, 1004 aa, Bacillus cereus BAG2X1-1
MCERSLIFSQYRINSQNSKMMERDTKKCKVGESMKGYSKKVLVGVSFVSLMLGSFQGNISAEDTKGEQVSYRNVLKMEPVGVQLPVQELAHSSKVLENKSFEKRLQFADLSQRPPEVQKESKQLAAAKTYTIAELNQLSNQALVDLLVTIDWEQITGLFQFNKDSLAFYQNDSRMQAIIDKLKQQGQAYTKDDSKGIETLVEVLRSGFYLGFYHTELSKLNERSYHDKCLPALKTIAQNPDFKLGTLEQNKVVSLYGKLIGNASSDAETVTSAANIFKQYNDNLSTFIDNRSAGNAVYDIMQGVDYDIQSYLYDTEKAPKDTMWYQKIDSYINELSRFALIGTVTAKNGWLINNGIYYTGRLGTFHSTGTKGLQVVTDAMKLYPYLGEQYFVAAEQITTNYSGKDANGKVVDLDQIREEAKKKYLPKTYTFDDGAIVLKAGDKVTEEKVKRLYWAAKEVKAQFHRTVESDQPLEKGNPDDVLTMVIYNSPAEYQFNRQLYGYETNNGGIYIEGTGTFFTYERTPQESIYSLEELFRHEFTHYLQGRYEVPGFWGQGKFYENERLSWFEEGNAEFFAGATRTDNVVPRKSMIGGLSSNPAERYTAERTLNAKYGTWDFYNYSFALQSYMYNKRYDMFDKIHDLIRKNDVTAYDAYRSALSKDANLNKEYQDYMQMLVDNRDKYNVPLVSDDYVATHAPKPVSDIAAEITVEAKLSNVSVKKNKSQFFNTFTLQGTYTGTAAKGEYEDWKTITQNVNDTLKRLSAKEWTGYKTVTAYFVNYRVNASGQFEYDVVFHGINTEEGTENKAPVAVINGPYNGNVNEAISFKSDGSKDEDGKIASYKWEFGDGTVSNEQNPTHVYTKEGTYTAKLTVTDDKGATNTNTTSVTVQKKEDNSIEKEPNNSFQTANKLQLNQVLRASLGNGDTSDYFEINVETAKNLQINVTKENNIGVNWVLYSEADLNNYVTYAQPQGNKLVGSYYTYPGKYYLHVYQYGGGTGNYTVEVK

SEQ ID NO: 26951 - protein, 99 aa, Bacillus cereus BAG2X1-1
GGNPTTPPTGEGNNGGNPTTPPTGEGNNGDEPKQDGNNAGSGQTTTDNQNEKETTKVSENKEERDLPKTGASIASTIGAGLAFIGAGLLLLFRRKKANR

SEQ ID NO: 26952 - protein, 554 aa, Bacillus cereus BAG2X1-1
MKKILSMFLIFVLAFASLPSMLIKAESPSGKKGTLTIHKFEQEPAGSPALQEGNSTGVEIPKGAKPLAGVVYQIKQVESFGTITNDGKIVKEDIKPVNGVPIEVETNADGIAFFDDLPLGRYEVKEISGPPHVNIDPKTYKVDIPMTSEDGKVLTYDVKIYPKNETKRGAVELTKVGVKNQALKGVQFSLFKEDGTELEKGLETDGDGKIRIGNLAYGKYYFLETKARDGYVLDPKKYEFFIKESGAINEDGTVKAGEVVKVDVKNYEEPTIDKKINGDLNNLPINTKTDYNYDIKTLIPEDIKDYKNYVVTDVLDSRLEIQGTPVVKIDGKVVDASVVEVVVDGQKVTATVKDFSKLDNKREFHLQIKSQIRSDVETGVEIPNTATINFKNKDDVTGEKETKPVIVTPTTGSITLTKVDGKDGKKLEGAEFALQDKDGNPVKIDGKAVVGTSDKDGVITWNKLPYGEYRIVETKAPTYEKEDGTTGSYQQLREAIRVTVDADHKAITLTVENNKSGWILPSTGGIGTILFTVLGLVLMMAAAFVFFRKKATNN

SEQ ID NO: 26953 - protein, 431 aa, Bacillus cereus BAG2X1-1
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGLKSFYNIKR

SEQ ID NO: 26954 - protein, 333 aa, Bacillus cereus BAG2X1-2
MKGKLLKGVLSFGIGLGVLYVGSSAQAETSTNQNNTLKVMTHNVYMLSTNLYPNWGQSDRADLIGAADYIKNQDVVILNEVFDNSASDRLLGNLKKEYPNQTAVLGRSNGNEWDKTLGSYSSSTPEDGGVAIVSKWPIVEKIQYVFAKGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNYPDASAEHLDYIIASKDHANPSFIENKVLQPKSPKWSVTSWLKKYTYDDYSDHYPIEATISMK

SEQ ID NO: 26955 - protein, 200 aa, Bacillus cereus BAG2X1-2
KEPTKEVEESKEEVKEPTKEVEEAKEEVKEPTKEVEEAKEEVKEPTKEVEETKEEVKEPVKEVEETKEEVKEPVKEVKETKEEVKEPVKEVKETKEEVKEPVKEVEETKEEVKKPTKEVEEVKESATGLDQEPKENNQVVEKEGRKADTLNKQHTNKSEEGKKSLPSTGGEASTSTLLSGITLVLSTLSMFVFRKRLFKK

SEQ ID NO: 26956 - protein, 503 aa, Bacillus cereus BAG2X1-2
MFNKKMVAMAMTVPLVMGTISTVSALEKKQQVKLEAYSPQKKATEYLKENAAQYGLKTDLSDLQYISTTETSVASYVRFQQVVNGAPVFSKQITVTLNGEGKGVLAVSDYQSVKGVKEVTTKISEKDAIQKSMAYVGEASEQNLWAPTEKEFGYIVEEGIARPVYKVVVHSNNPFGAWETFIDAENGKLIKKVDINQKAEGTGKVFLPNPVVSSGSKVGLKDNNDADSTALTNQLKTVTLKGLDGTGFLIGEYVTISSKSKTKSTNLQFNYTRANDSFEDVMSYYHIDTIQRYIQGLGFKNINNRSIKVNVNGTTADNSFYSPTTKALTFGTGGVDDAEDAGIIAHEYGHSIQDNQVPGFGSSVEGGAMGEGFGDFLGATYEDAVSTTGYGKACVGEWDAAAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 26957 - protein, 738 aa, Bacillus cereus BAG2X1-2
MKQLKPAISVLGSVSMALTLASPALADVKQPNPGGTVEIFKENANVKKEDKNFTLGSDGEIGSLITQNIEMANNDWDKDGISNDLEMNGYKIEFNSQTGKNEVKAWDPDKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTTNAAKLRVHLEYKNLGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRLYTPKDKSLADKPVLSYNEVFQHVNIDTKKVNHIVNKAKSTNNVSVVSANNGTDALNNLKAGQGDRGYLHKDSVHGAFAKLQQPTLVEGSYDSVTQKIRATILPGLFGVSQEIPTTYSKKWNAPSQTVTLVKRENGFTYESRENIHPIKSEIAAHRKVTFEINDAHNLTPTQKIDIEIKANKEFEDYVVDNSGEFVTEGVPYTVASYGNTAYWGSHHAGNKWEYLWAEKSSDEKVNVIIERVGQPKPGKPIKKDEEVLIKFRNPIYSDYAYLKLQDSYIHLDQKQNASTFKFNHAYPKNFTGYHKQWNILSNGNKLKVGYLIDYMKYGNGENGTDTIAWNLSRVQ

SEQ ID NO: 26958 - protein, 197 aa, Bacillus cereus BAG2X1-2
MGKIFKFGCLGFIGLIILGAIASAFGGGDDNKEKTSSEPKQETQAPAAKEEPKKQETKKEEPKKELSKEGESSKVKIAVGSVESLDSVGGEYLKEKAQGVFKVVEITITNNQKDAITVDANSFKLVDNKDREFTYSTQAQTAFDVGDGGSSDFFLKQLNPGLSQTGKIIYDVPADAQGLVLKARGGMMGKEIKLKVE

SEQ ID NO: 26959 - protein, 965 aa, Bacillus cereus BAG2X1-2
MNKKSKINKVMLSISTMALSLGAIQTNVSAEEKVPYNVLHSKPVGIEKPVDEVGQISKAEETLSFQERLKVGDFSQRPASIMKSSEVKQMKESYSMADLNKMNNQELVETLGSIKWNQITDLFQFNEDAKAFYKDKGKMQAIIDELAHRGSTFTKDDSKGIQTFTEVLRSAFYLAFYNNELSDLNERSFQDKCLPALKAIAKNPNFKLGTNEQDAVVSAYGKLISNASSDVETVQYASNILKQYNDNFYTYVEDRMKGQAVYDMMQGIDYDMQSYLFETRKEAKDTMWYGKIDGLINEINRIALLNEVTPENKWLVNNGIYFASRLGKFHSNPNKGLEVVTQAMHMYPRLSEPYFVAVEQITTNYNGKDYSGNTVDLETIRKEGKEQYLPKTYTFDDGSIVFKTGDKVSEEKIKRLYWAAKEVKAQYHRVIGNDKALEPGNADDVLTIVIYNTPDEYQLNRQLYGYETNNGGIYIEETGTFFTYERTPEQSIYSLEELFRHEFTHYLQGRFEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDSKLNKEYQEYMQQLIDNQDKYNVPEVADDYLAEHAPKSLTAVEKEISDTLPMKEAKMTKHSSQFFNTFTLEGTFTGSVTKGESEDWNEMSKRVNEALEQLAQKEWSGYKTVTAYFVNYRVNSSNEFEYDVVFHGIAKDDGENKAPTVNINGPYNGLVKEGIQFKSNGSNDEDGKIVSYLWEFGDGSTSAEVNPIHAYEREGIYKVALRVKDDKGKESRNETTVTIKDGSLTELEPNNRPEEANRIGLNTTIKGSLIGGDHTDVYTFNAASTKNIDISVLNEYGIGMTWVLHHESDMQNYAAYGQANGNHIEAKFNAKPGKYYLYVYKYDNGDGTYELSVK

SEQ ID NO: 26960 - protein, 183 aa, Bacillus cereus BAG2X1-2
MKKSFILLTLILVLVSFTAACTQDKKDSAVENGPIEEPTAKNENEELINFEEKEDMSRLEQGILLVGESVKGGYYLTAVQNAYLNASNDSVVVNVSVKNVRGQTIGLSELKYNLKDEKAGKAYEGKVLDQNPSDIQVKPNETVELKIAFEVPSTADEYTFYIESSLDPLGAHWKIDKLQSQKN

SEQ ID NO: 26961 - protein, 60 aa, Bacillus cereus BAG2X1-2
TMDSEKPGTTDSEKPGTMNPEKPEKELPKTGQKMPVEPYMGALLIMMSFGLLVLGRKQQR

SEQ ID NO: 26962 - protein, 971 aa, Bacillus cereus BAG2X1-2
MKGYSKKVLVGVSFASLMLGSFQGSTLAESTKGEQVSYRNVLKMEPVGVQLPVQELAHSSKVLESKSFEKRLQFADLSQRPPEVKKESKQLAAAKTYTIAELNQLSNQQLVDLLVTINWEQITGLFQFNKDSLAFYQNDSRMQAIIDKLKQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALIGTVTEKNGWLINNGIYYTGRVGTFHSTGTKGLQVVTDAMKMYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDTNLNKEYQDYMQMLVDNREKYNVPLVSDDYLATHAPKPVSDIAAEITAEAKLSNVSVKKNKSQFFNTFTLQGTYTGTTAKGEYEDWKTITQNVNDTLKRLSAKEWTGYKTVTAYFVNYRVNASGQFEYDVVFHGMNTEEGAVNKAPVAVINGPYNGNVNEAISFKSDGSRDEDGKIVAYKWEFGDGTVSNEQNPTHVYTKEGTYTAKLTVTDDKGLTNTVTTNVTVQKKEDNSVEKEPNNSFQTANKLQLNQVLRASLGNGDTSDYFEINVETAKNLQINVTKENNIGVNWVLYSEADLNNYVTYAQQDGNKLVGSYYTYPGKYYLHVYQYGGGTGGYTVEVK

SEQ ID NO: 26963 - protein, 209 aa, Bacillus cereus BAG2X1-2
MLKKFTTCILGGALVFNLSGCGNASDKTSSESKETNFKQEEKKVQTTDEAKTKENTKQKNTEQTKEKSKVKEKEYAVNKDFHTPKFDVTVKRVVERDKVGKESIGIQEPENGHVFIVVEVEGKNITNESMKLAVLPSVDLVDENDNAYQSDVWAASSYEVEKGETSTITKELKPGEVMRESKVYVINKEKFDTGKWYVVVNNEYKEQIK

SEQ ID NO: 26964 - protein, 774 aa, Bacillus cereus BAG2X1-2
MKKSKKMLAGATLAIGVIAPQVLPTTAHADENNGESTVNLRILETSDIHVNLMNYDYYQTKTDNKVGLVQTATLVNKAREEAKNSVLFDDGDALQGTPLGDYVANKINDPKKPVDPSYTHPLYRVMNLMKYDVISLGNHEFNYGLDYLNKVISKTEFPVINSNVYKDDKDNNEENDKNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEMKDVFNGVPVVMPGVFGSNLGIIDMQLKKVNGKWEIQKEQSKPQLRPIADSKGNSLVQSNQELVNEIKDDHQATIDYVNTAVGKTTAPINSYFSLVQDDPSVQLVTNAQKWYVEKLLAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPTKYDKDGKVVNANTNRIINMTYEGKPVADNQEFIVATNNYRGSSQTFPGVSKGEVVYQSQDETRQIIVKYMQETPVIDPAADKNWTFKPIVADKLHTTFDSSPNAQKYIKKDGKISYVGPSENEFAKYAIDITKKNDDDKETGGENPTTPPTGEGNNGGNPTTPPTGEGNNGGNPTTPPTGEGSNGENPTTPPGSGQTTTDNQNSKETTTTVSEKKEERDLPKTGTSVASTIGAGLAFVGAGLLLLFRRKKANR

SEQ ID NO: 26965 - protein, 179 aa, Bacillus cereus BAG2X1-2
MFKKIATVTLGGTLAFSLSACDEKKEVAKTVSNNTKEEQSSAKKENTKNEDTREYSVEKTTQIRNQKLTVHKVQIAQVAEYDKLEKGNEFVIVHVTVENIGNQKVRINPLDFYLERGDGSIVDHTFSTSNKNIFKIKDVDPNGKLTGAITFEAKKGDSNLELIYRPDVMSKEEVKVELK

SEQ ID NO: 26966 - protein, 563 aa, Bacillus cereus BAG2X1-2
MIEVVKGIREMKKIFSVLLVFFLTFSTWSSVLVKAASPSKGTLTIHKYEQEKDGAPGLEGDGSANQEVPSNAKPLKGVTFEVKRVASFEKISNDGKIVKEDVKPVMGATPTQVVTDDNGQAVLKDLPLGRYEVKEVAGPPHVNLNPNTYTVDIPLTNKEGKVLNYDVHMYPKNEIKRGAVDLVKTGANEKALAGAVFSLFKKDGTEVKKELATDGNGHIRVQGLEYGEYYFQETKAPKGYVLDLTKHEFFIKTSGTINEDGTITSGTVVKVEVQNYEEPNIDKKINGNLEALLINPLTNYNYDIKTLIPEDIKDYKKYVVTDTLDNRLMIQGKPVVKIDGAEVNASIVEVAVEGQKVTATVKDFTKLDGKKEFHLQIKSQVKEGVLSGSEILNTAKIDFINKNDVIGEKESKPVVVVPTTGIIELTKVDGADKKKLKGAEFVLKDKNGKIVVVAGKEVTGVSDENGVIKWTNIPYGDYQIFETKAPTYTKEDGTTASYQLLKDPIDVKISENNQTVKLLIENNKSGWILPVTGGIGTTLFTVLGLALMATAAFVFFRKKFANN

SEQ ID NO: 26967 - protein, 455 aa, Bacillus cereus BAG2X1-2
MNNRFLKQLQNMKMNKKSLGAVALTAGIIGTTLIPQNAYAHGFVEKPGSRSALCSPTYGALNVNCGSVMYEPQSLEAPKGFPQGGPLDGQIASAGGKFGGILDQQTANRWFKNTITGGENSFTWKYTAPHLTSKWHYYITKKGWNPNKALTRADFEPIGTVQHDGSAASNHLTHKINVPTDRSGYHVILAVWDVADTANAFYNVTDVNLINDVKPDIEAPSSPNGIQTQNVTANSIELTWNASTDNIGVKGYQIFRNGVMIDTVPGTHFIDKKLQPSTEYSYTVKAIDVAGNVSKESAALSVKTKVEAPDTEAPTQPKGLHSMGTTASSVDLMWSPSDDNIGVDRYDIYRETEGSMKKIATSNTTSYMDKNLLSNTTYKYVVKAVDVVGNESVQSDIFTITTKTESASYEGWDAKKAYEKGDRVLHEGKVYEAVQSYQGNGDPNWIYALSLWKTV

SEQ ID NO: 26968 - protein, 458 aa, Bacillus cereus BAG2X1-2
MNLKFTSKFERLRKSKKGIGACVLVAGMTAITMIPQSAYAHGFVEKPSSRATLCSQNYGALNLNCGNIMYEPQSLEAPKGFPDGGPIDGKIASAGGLFGGILDQQTSNRWFKNTIMGGANTFTWKYTAAHSTSKWHYYITKKGWDPNKPLTRADLEPIGTVKHDVSAASNNLTHTINVPTDRNGYHVILAVWDVADTSNAFYNVIDVNLVNNETPDTVAPSQPTGLNASKVVANSVTLTWKASTDNIGVKEYQVLRNGELIDTVPGTTFIDKKLKANTEYTYTIKALDSAGNISKESEKLKVKTTNETPDIEAPTQPKGLHSMSTTATTVDLMWSPSEDNVGVDHYTVYRESAGVMNKIGTTANTSFMDKELKANTSYKYVVTADDLAGNESSRSDVLSVTTKAEDSTYEKWDARKAYTKGDRVVHEGKVYEAVQDYQGNGDTNWIFALSLWKAVLNK

SEQ ID NO: 26969 - protein, 592 aa, Bacillus cereus BAG2X1-2
MGRKYVIRILALLSVISLFFNLMLPKASAEIEKIPSLKTTATNKADGGKEMHAKESITIQDKVEYTNLVVGKEYTVKGKLMNKVINKPLLIDGKEVTAETKFTAKETNGFVTLDFPFVGAEQQGREVVVFEELYEDGVLVATHADINDVGQTVRFVEPTIKTTATNKADGGKEMHAKDSITIQDKVEYKDLIVGKEYVVKGKLMNKVTNKPLLIDGKEVTTETKFTAKEKNGFVTLDFPFVGAEQQGREVVVFEEVYQDGVLVAIQSDINDVGQTVRFVEPTIKTTATNKADGGKEMHAKDSITIQNKVEYKDLIVGKEYVVKGKLMNKVMNKPLLIDGKEVKAETKFTAKEKNGFVTLDFPFVGAEQQGREVVVFEEVYQDGVLVAIQSDINDVGQTVRFVEPTIKTAATNKADGGKEMYANESVTIQDKVEYKDLIVGKEYVAKGKLMDKATKKPLLVDDKEVAVESKFTAKEKNGSITLDFTFNASKLQGKEVVVFEELYQDDILVAINVDIEDAGHTVKFKEKKLGKPQPEKPQSEKPQSEQPKTGKTSKAGTLPATGGNMYFTWFSVGAGLLLLTLGAILFMKRRNA

SEQ ID NO: 26970 - protein, 372 aa, Bacillus cereus BAG2X1-2
MKTKQTIAASTLALAMIAGANSAHAEVTDATPQQSTGDRLAEIKQHRQELDAKLQQHKENVDQKLNELNQVKENVDTKVNELHERKQVADEKINEMKQRKQELDAKLQQDKQIAEDKIAEIKEHKKQVEDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQETRQDLLNKINEMKQAKQTVSDDLTKKKQDLDIKINDFKHTEKKIDDKLAEVHTTKQNVDNKINEVSQSKQTETKTGTTNTNNNTRELPNAGSEQSNNMALGMLSVLGGVLLVTRNKIKALFSK

SEQ ID NO: 26971 - protein, 412 aa, Bacillus cereus BAG2X1-2
MKKAKGIVKSVAVASVIMSGSLGVQATSAFADSKGTVENLQNGGKVYNSFKTTYDMKQNIKNSIKVSFIEDPYADKKIAIVTTDGSNIDAKYTINGGYYNAGLKWPSAYHTEAEITSVDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDTFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNHKALEEQMSSINNVNNQLNKGKGKLSFSMNGNQLKATSSNAGYGISYEDRNWGIFVNGEKVYTFNEKTTVGNISNDINKLNIKGPYIEIKQI

SEQ ID NO: 26972 - protein, 3211 aa, Bacillus cereus BAG2X1-2
MKKLFNICLIVFVLFSQLASFPYNQVKAETLTGNSLFDTVEMKDATNHIIDEALNPKNLIQVGSTIHLEYAWSIKDQQTDSAVLQIPNALKVKSNQQGNLTADQQIIGQYFVTANDNKMKLVFNDQAKDSKSASGKINFDTVFNPDLKPGAKSVQLSFPLGTTAKSISVPVQVDNPASPTTNKDTAQQPTDEQKNGDAQQPAVEKKNGDAQQPAVEKKNADAQQPTETQKNGDAQQPAVEKKNGDAEQPVVEKKNADAQQPTENPVENPDPSPKQITENILTGVKLTDKDGKPFNDTDNRPNPDSTANIEFTWEILESLKVKKGDYYTFQLPEYFIVHNTITETLVDGTGQVIGEFVVGLDGKVTMTFNEYVEDHPNIAGDLKVGTEFNKVKITGTTEQKIPFPIKEKDVIIELDFKPNVKESVNKKGVPDRPINTNQINWKVEMNKTKDKLTNAVFQDNIPNGASLNEDSIKVYYLEVDINGNTTRGAEVPKEEYELTSSPDKLNIAFKKETNKAYEIEYATKITDESITSFKNNAKVSSDNQDSVSTNATVTVSRGTHLEKTSKYNPKTQTIEWTITYNGDQRDIKKADALLKDVLDKSHKVDKNSIVVKNASYDNTGKLVTGDNATNFTVKETDDGFDLQFTEDINSAYVITYTSKATSDVIKDGEIENKIIADGKWSKTNKVTLKQQNIIKKHNKKDTDYNKKTTTWTIIVNDNNYVLNDAVITDTFDFGGLALQENSFKITDGSRELNPNLDYTLHVTDKGFEVKLTGDYKSNMDKTLTITYTTDFNYENLSKEKDNKSFKNTANLSWIDINDNKNNSSSDDTFDPDYYTKGNGFKYGSYNAQTKEIKWDIGFNYNNRTIKDPSIVDVLRDNQKLIPESIEIRHMKLTGGAHGFELGDPVPSSEYTIETPTKDNNNTLTVHFKNEINSAYYISFKTSLAGEQINKRYDNYADVKDGSKTVTTIHGAFEIKNGGSGVTKTAKQNDKYIDWSISINASQSTIENAVVTDDPTDNQILDEKSFHLYPTTVAVDGTLTKDTTNELKEGTDYKLKVTTDNNTGKQQFKVDFLHTIDHAYILEYRSLINADNNETVSNKVKITGNRLTLTQVETTEEKVVKVSSGSGGGSANKGRGSLQIIKVDDKDQKVRLAGAEFTLYDQTGTTAIRPITTGDDGVAKFNNLRRDKYMIKETKAPKGYVISKELREGILVELGSEEITKYTLTNKKFVGKVVLTKTDAKSGEKLEHAVFSLLDQNKQVIPEHKKLTTNDKGQITVDNLKPGTYYLQETTAPEHYKLDGRLIEFKIEEDQTTVINRPATNSLIPGSAILTKVDKDGKTLAGAEFSVRDRHNNVIRGYEKLTTNDQGQIEAKDLLPGDYQFVEEKAPKDYDIDKKPIEFTIVKSQKKAVTVTATNHLIKGGVTLTKVDDIDGTALKGAVFKIVDAHDEKKVIRENVKTGADGTVTVKDLEPGTYKFIETKAPQDYTLNTDPITFTIDKSQQSLATVTATNSLKTGEVELLKVDEFGEKKPLEGAVFKLVDANNNEVPPHTNLTTDKKGKFKVSNLRPGTYKFIETSAPEHYVLRAEPIEFTIDRSQKETLLVKAENALKPGDVELTKVDDIDGTALEGAVFKIVDAHDEKKIIRENVKTGADGKAIATGLRPGDYKFIEVTAPKYYDKNTTPIEFTIKESQGTSPITVTAKNSLTKGGIELTKVNAADERETLEGAVFKIVNRDTNEDVRTDLVTNSKGMLAVDDLRPGNYKLIETKAPTYYDVNVESIEFTIEKGQQKLLPLTFKNSLTKGKVKLIKEDDVESSIALAGAVFTLKDATGKEIAKDLKTDDYGVLVIPDLAPGDYQFIETSAPEHYKLDQTPIKFTIKKGSKDDLPVPVIVKNSLLTGGVTLTKVDDVDGVTLKGAEFIIVDAHDTKKVVRKGLTTDEQGKVSASDLRPGDYQFIEVKAPKDYDLSKNPIPFTIGKSQQENITVTATNSLTKGGVILTKIDDIDRTMLKDAVFKIVDMDGKEVRTNLVTNDNGEISVSNLRPGDYQFIEIAAPEHYVLDETPIPFKIERNQTAKITVTGKNTLKKGSVELTKIDDIDTDTKLANAVFNLLDADGELVEEGLKTNDEGKIIVENLRPGTYQFVETIAPEHYDLNKKPIEFTIKKSQTETLHVTAKNALTKGAVELSKVDDIDGTTLEGAVFNIVDMRGTVIHKDLVTNGKGKIEINDLRPGDYQFIETEAPKHYVLDETPINFTIEKGQKKTISLTANNSLKQGSIELIKVDDLNDQTKLADAVFNLLDQNGKVLKTDLKTNSEGKIIVENLRPGTYQFVETTAPKHYDLDKKPIVVTVEKSQKDIATVTMKNSLTKGGVDLTKVDDVDGTTLEGAVFNIVDMKGTVIREKLTTNSQGKISVSDLRPGDYQFIETNAPKHYDLNKEPIPFTIEKGQAEPISVTAKNSLTKGAVELSKVDDIDGTALEGAVFKIVDDKNNDVRTDLTTVKDGKISVPDLRPGDYQFIEIKAPEHYKLDSTPLKFTIKKSQAEKLQVTATNSLIEGAVELIKVDDINPDTKLADAVFNIIDAKGKVVRTNLTTDKDGKISASNLRPGDYQFVETKAPKDYDLNKTPIPFTIEKSQTAHVSVTAKNALTKGGVELTKVDSLDAKETLEGAVFKITDMNGNDIRKNLVTNKDGKIIAKDLQPGDYQFIETKAPKHYDLNEEPIKFTIERSQTKHVFVTATNSLTKGSVELIKVDDVEENTTLEGAVFKIVNKDGHDVRTDLTTDKNGRLVVDELPPGDYEFIETKAPNHYDLNETPIKFTVKKGQEKIASVTATNSLTKGAVELSKVDDFDGSVLKDAVFKIVDMNGHDVRSNLTTDKDGKISVSDLRPGDYQFIETKAPKHYDLNQNPIKFTVEKSQTTKASVTATNSLTKGAVELIKLDDVDNSTLEGAIFKIVDMNGNDVRSDLTTDKDGKISVSDLRPGDYQFIETKAPTGYDLSAKPIPFTITKGQSQVTSVTALNSLTTGSMELTKVDMDHHGTLEGAIFNILDQDGKVVREGLQTDGHGKLIVNDLKPGNYQLVETKAPEGYQLDASPINFTIKKAQATPLQITVSNKKIDSSSGGDDKPVTPPNKEEETGKETSEELEKGNPETHGKGTSEELEKENPETQINKQQDDRNKGKELPNTGHKNDPTQTVGILLLLAGLLSILATKRKKYY

SEQ ID NO: 26973 - protein, 103 aa, Bacillus cereus BAG2X1-2
TDPKDPSTDPKDPSTDPKDPSTDPKDPSTDPKDPSTDPKDPSTDPKDPSTDKNSDSQVPPTTEKDKPTLLPNTGGTSTEMISIFGGMLLFLLGGSLIARRRIK

SEQ ID NO: 26974 - protein, 431 aa, Bacillus cereus BAG2X1-2; identical to SEQ ID NO: 26715

SEQ ID NO: 26975 - protein, 201 aa, Bacillus cereus BAG2X1-3
MKKPFYKKWWFWLIVVIVVIGAYGNSADDKKDEATKASTEPKQEAKQETKKEEPKKEEAKPKKEEPKKELSKEGESSKVKIAVGSVESIDSVGGEYLKEKAQGVFKVVEITITNNQKDAITIDANSFKLVDNQDREFKYSTQAQTAFDIGNGGSSDFFLKQLNPGLSQTGKIIFDVPVDAQGLVLKARGGMMGKEIKLKVE

SEQ ID NO: 26976 - protein, 179 aa, Bacillus cereus BAG2X1-3
MFKKIGTITLAGTLAFSLSACDEKEEVAKTVSNNTKEEQSSEKKEDAKKEDTREYNVEKTTQIRDQKLTVHKVQIAQVAEYDKLEKGNEFVIVHVTVENVGNQKVRINPLDFYLERGDGSVVDHTFSTSNKNIFKIKDVDPNGKLTGAITFEAKKGDSNLQLIYRPDVMSKEEVKVKLK

SEQ ID NO: 26977 - protein, 364 aa, Bacillus cereus BAG2X1-3
MKTKQTIAASTLALAMIAGANSAHAEVNDATTQPSTGGDRLAEIKQHKQELDAKLQQHKEHVDQTLNELNQVKQTVDEKANELHEHKQVADEKIAEIKQHKQELDAKLQQDKQIADEKIAEMKEHKQTIDTKVNEIKEHKQTVDEKVNEIKQHKENIDVKVNELKEVKKHVDETLAELKKAKQTAEDKLAELKENKPNTGNTLEELKKIKGNLDSLSSNLELAKQDVQNKLAELQKARQDLENKLNEIKQSKQTVSDDLTQKKLDLDIKINDFKHTEKKIDDKLAELHTTQQNVDNKINEVSQPTQPKPTTTDTNNTTVPTKNTARELPNAGSEQSSNMALGMLSILGGLLLVTRNKIKTLFSK

SEQ ID NO: 26978 - protein, 99 aa, Bacillus cereus BAG2X1-3; identical to SEQ ID NO: 26951

SEQ ID NO: 26979 - protein, 431 aa, Bacillus cereus BAG2X1-3; identical to SEQ ID NO: 26953

SEQ ID NO: 26980 - protein, 176 aa, Bacillus cereus BAG2X1-3
MYKKMGTIALTGALAFSLAACGETEVKEVSKNDAPKQEEKKDKKASTENKVYKTGETVEINGLQITFNSAQFVEPNEYSKAEKGKVLEIDFAAKNNGKKDAYIGTEELKIADANGNQFKEYFGADNAFMNENIGPGNQITGKMYFDVAESDKYTGTYKPNFTLDDKSVKFEFTPAK

SEQ ID NO: 26981 - protein, 106 aa, Bacillus cereus BAG2X1-3
SDSDSDSDSDSDSDSDSDSDSDSDSDSDSDSDSDSDSDSDAESESNNSSNNGSNGGTNSNPGNHLPQTGGQNESSMLASLGALLTALGSSLFFFNRRKKNTKNSTN

SEQ ID NO: 26982 - protein, 878 aa, Bacillus cereus BAG2X1-3
MVRYSKFSKLIISVGLVTISCSGLQIQAETKEKSVKNVLQMEPVGLRKSVDELAHPSNVQENGSFTKRLKVADLSQRPPMPNENAKQLVEEKKYSMAELNQLSNKQLTDLLVTIQWYQIPELFQFNNESLKFYQDDSRMQAIIAKLAEQGQAYTKDDSKGIQTLVEVLRSGFYLGFYHQELSKLSERVYHDKCLPALKTIAKNPNFKLGTTEQNKVISSYGMLIGGASADVEVIQYAGEIFKQYNDNLSTFIEDRTKGDAVYNLMKEVDYEVQSYMNATGKEPKDMLWYGKIDGFINEVNRFALIGTVTDKNGWLINNGIYYASRFGKFYSTPTKGQQVVTEAMGIYPYLGQQYFVAAEQIATNYGGIDANGKTVNLDQIREDGKKHYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQDERLTWFEEGNAEFFAGSTRLDSVVPRKSIIGGLSNDPAKRYTAAQTLNAKYGTWDFYNYSFALQSYMYNNRPEMFDKVHDLIRANDVSSYDAYRSTLSKDNKLNEEYQSYMQMLIDNRDKYTIPQVSDEYLAQHAPKPLSDVAADITNEAKLKDVKITKNKSQFFNTFTLQGTYTGSVAKGEIEDWKVMNQATNGMLKQLSEKEWSGYKTLTAYFVNYRVNNAGQFEYDVVFSGLNTEEGTAVEKEPNNSFDTANPLLLNTILRGNLSDQDQVDRFVIDVKDPKDLQITVTNEQNLGLNWVLYSESDLNNYVTYATKHDGNKLLGNYNAKPGKYYLSVYKYGGGAGNYTVEVK

SEQ ID NO: 26983 - protein, 552 aa, Bacillus cereus BAG2X1-3
MMKRIFSLLLICVLAFSTLMNMTVSAESRSTGTLTIHKYEQKDGNPGVEGNGKAGQSVPEGAKPLKDVTFEIKRIASFEQINDGKVAKESIKDVTESAITKVTDANGEAVFQNLPLGRYEVKAINGPEHIELDKSTFIVDIPMTSADGKDLNYDVHIYPKNETKRGSVELIKKGEGDRVLEGAEFHLFKENENGTNTQIKTPHPLVTDSDGKIHVESLEYGEYYFIEEKAPKGYLTSKEEYPFSIKETGKLVKLEKDVKNYKEPTIEKTINDSSKNAGINRETEYTYDIKTLLPEDIQTYKNYVVTDVLDNRLEIVGTPVVMIDGKKVDESIVNVVVAGQKVMASVEDFSKVTGKELHLQITAKIKSDVQSGVEIPNKAVLDFVNKDDVTSEKDGKPSNEVVVTPTMGTIEIEKVDGKNKKLKLEGARFELRDKKGNVVTVNKKKMDDITDANGIITWNEIPYGEYQIVETVAPKYEDEDGAVEQYQKLRDPIDIKIDKDHKVIELQVENNKSGWIIPATGGMGTILFTAVGLLLMVTAAFIFFRKKPVKNS

SEQ ID NO: 26984 - protein, 503 aa, Bacillus cereus BAG2X1-3
MLNKKMVAVAMTVPLVMGTISTASALEKQQQVKVEAYSPQKKAIEYLKANADQYGLKPDLSDLQYISTTETSVASYVRFQQIVNGAPVFSKQITVTLNGEGKGVLAVSDYQSVKGVKEVTAKISEKDAEQKSMAYVGGASEQNLWAPTEKEFGYIVEEGIALPVYKVVVHSNNPFGAWETFIDAENGKLIKKVDINRKAEGTGKVFLPNPIVSSGSLAGLKDNKDADSPALTNQLKTVTLKGLDGTGFLIGEYVTISSKAKTKSTNLQFNYTRANDSFEDVMSYYHIDTLQRYIQSIGFKNINNRSIKVNVNGTTADNSFYSPSTKALTFGTGGVDDAEDAGIIAHEYGHSIQDNQVPGFGSSAEGGAMGEGFGDFLGATYEDAVSTTGYGKACIGEWDATAYSSSDPTCLRRLDNNKVYPKDIKNEVHDDGEIWAQGQYEMAQAFGRDVATKIILQSHWSLTPNAKFRDGAKAIKQADALLYGGQHASEIDRIWAARGISTN

SEQ ID NO: 26985 - protein, 532 aa, Bacillus cereus BAG2X1-3; identical to SEQ ID NO: 26944

SEQ ID NO: 26986 - protein, 1004 aa, Bacillus cereus BAG2X1-3
MCERSLIFSQYRINSQNSKMMERDTKKCKVGESMKGYSKKVLVGVSFVSLMLGSFQGNISAEDTKGEQVSYRNVLKMEPVGVQLPVQELAHSSKVLENKSFEKRLQFADLSQRPPEVQKESKQLAAAKTYTIAELNQLSNQALVDLLVTIDWEQITGLFQFNKDSLAFYQNDSRMQAIIDKLKQQGQAYTKDDSKGIETLVEVLRSGFYLGFYHTELSKLNERSYHDKCLPALKTIAQNPDFKLGTLEQNKVVSLYGKLIGNASSDAETVTSAANIFKQYNDNLSTFIDNRSAGNAVYDIMQGVDYDIQSYLYDTEKAPKDTMWYQKIDSYINELSRFALIGTVTAKNGWLINNGIYYTGRLGTFHSTGTKGLQVVTDAMKLYPYLGEQYFVAAEQITTNYGGKDANGKVVDLDQIREEAKKKYLPKTYTFDDGAIVLKAGDKVTEEKVKRLYWAAKEVKAQFHRTVESDQPLEKGNPDDVLTMVIYNSPAEYQFNRQLYGYETNNGGIYIEGTGTFFTYERTPQESIYSLEELFRHEFTHYLQGRYEVPGFWGQGKFYENERLSWFEEGNAEFFAGATRTDNVVPRKSMIGGLSSNPAERYTAERTLNAKYGTWDFYNYSFALQSYMYNKRYDMFDKIHDLIRKNDVTAYDAYRSALSKDANLNKEYQDYMQMLVDNRDKYNVPLVSDDYVATHAPKPVSDIAAEITAEAKLSNVSVKKNKSQFFNTFTLQGTYTGTAAKGEYEDWKTITQNVNDTLKRLSAKEWTGYKTVTAYFVNYRVNASGQFEYDVVFHGINTEEGTENKAPVAVINGPYNGNVNEAISFKSDGSKDEDGKIASYKWEFGDGTVSNEQNPTHVYTKEGTYTAKLTVTDDKGATNTNTTSVTVQKKEDNSIEKEPNNSFQTANKLQLNQVLRASLGNGDTSDYFEINVETAKNLQINVTKENNIGVNWVLYSEADLNNYVTYAQPQGNKLVGSYYTYPGKYYLHVYQYGGGTGNYTVEVK

SEQ ID NO: 26987 - protein, 170 aa, Bacillus cereus BAG2X1-3
MKKLVAIFTGMLLTVGLTACGDTEVKEVKKDDSAKQEQKKEESNKVFAIGDTFEVNGLQITFTSANFVEPNEYTAPEKGKVLEVQFSAKNNGKKEMYFGAEELKLADASGNQFKEYFGMDNSFMNENIAAGNQITGKMYYDVAEADKYTGTYKPSFTLDEKSVKIDFQVK

SEQ ID NO: 26988 - protein, 183 aa, Bacillus cereus BAG2X1-3; identical to SEQ ID NO: 26946

SEQ ID NO: 26989 - protein, 129 aa, Bacillus cereus BAG2X1-3
QVEEETTEEIKEEKPETPKVTEEPNVLETPEVKEQPEILVTPEETTKELAEPSKPETPKVTEETSVLEKPEVQNKQDIHSQSDVPSSKENNKQSKSLPQTGGVSTESTSTIAGMLALILGAMMFRRKKN

SEQ ID NO: 26990 - protein, 78 aa, Bacillus cereus BAG2X1-3
DSDSDSDSDSDSDSGSNNGSDNGSDKDSNSGSESDNSTKVLPKAGASNESSLLTSLGALFAALGSSLLFFNRRKKNTK

SEQ ID NO: 26991 - protein, 554 aa, Bacillus cereus BAG2X1-3
MKKILSMFLIFVLAFASLPSMLIKAESPSGKKGTLTIHKFEQEPAGSPALQEGNSTGVEIPKGAKPLAGVVYQIKQVESFGTITNDGKIVKEDIKPVNGVPIEVETNADGIAFFDDLPLGRYEVKEISGPPHVNIDPKTYKVDIPMTSEDGKVLTYDVKIYPKNETKRGAVELTKVGVKNQALKGVQFSLFKEDGTELEKGLETDGDGKIRIGNLAYGKYYFLETKARDGYVLDPKKYEFFIKESGAINEDGTVKAGEVVKVDVKNYEEPTIDKKINGDLNNLPINTKTDYNYDIKTLIPEDIKDYKNYVVTDVLDSRLEIQGTPVVKIDGKVVDASVVEVVVDGQKVTATVKDFSKLDNKREFHLQIKSQIRSDVETGVEIPNTATINFKNKDDVTGEKETKPVIVTPTTGSITLTKVDGKDGKKLEGAEFALQDKDGNPVKIDGKAVVGTSDKDGVITWNKLPYGEYRIVETKAPTYEKEDGTTGSYQQLREAIRVTVDADHKAITLTVENNKSGWILPSTGGIGTILFTVLGLVLMMVAAFVFFRKKATNN

SEQ ID NO: 26992 - protein, 659 aa, Bacillus cereus BAG3O-2
MFNQRTKNGVKKILAITAASTVFSMFGSSISIIEAASAPGVYVTPKNSVSSDIISIDWSPVQTAPYTYWAVHNWNQGGEAGGYAGFQQQSGFDENGKRTLHFAVWDPISSKEAIKAEYVSPTSVASNFGGEGTGLKIQTTYDWKNYNWYRMTMRSWQENGHTKFGQWLKDVSKNQWKLIGIMDFPVPNVTFNYGQTLFQEDWLGNGQDVREARVKNGYGRNISDKKWTSWNTQSIEGQEPLNNNWDGGATSEYLWFKAGGDSRSTIGTGKTFTLNQPSQPEIGKLDYDVKSTYYENEKLNITWQLKDSSTPQFKGKIEIYNNENMTGQPINVINDIKSYQNGISQSISLPTNTYAKIVLTDIFDQTVEKKVKIKNESPNILEGDRFAWSMKGIGDFEFAKLDLNKSTEELQVSLIAGTPHNYFDSTYASIKVQDTSGKVVYNKEIYGNTQQNAESKTVPVKVGNFIELTHLEGAERAILTNLDNNKRESFDKKVIYEVTKDGLKKINQIVIPKPDTEAPTQPLGLYASDVTTNSVELKWNPSTDNVGVKEYQVLRDGQLIQTVQGTTFTDQNLTANKEYKYAVRAVDAAGNTSIQSDILLIKTKDQNVSYEKWDPKKAYTKGDKVEYQGKFYEAVQSYQGNGDPTWIFALSLWQPFKVI

SEQ ID NO: 26993 - protein, 163 aa, Bacillus cereus BAG3O-2; identical to SEQ ID NO: 26501

SEQ ID NO: 26994 - protein, 965 aa, Bacillus cereus BAG3O-2
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTVARKEANETMWYGKVDGFINEINRIALLNEVKPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNKEYQEYMQQLIDNQDKYNVPEVADDYLAEHATKSLAAVKKEISDTLPMKDTKMTKHNSQFFNTFTLEGTYTGSVTKGESEDWKAMSKRVNESLEQLAQKEWSGYKTVTAYFVNYRVNSSNQFEYDVVFHGIAKDDGENKAPTVNINGPYSGLVKEGIQFKSDGSNDEDGKIVSYLWEFGDGSTSAEVNPVHVYEREGSYKVSLRVKDDKGKESRSEATVTIKDGSLTESEPNNRPEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYSLSVK

SEQ ID NO: 26995 - protein, 181 aa, Bacillus cereus BAG3O-2
MNKKLLAPLLCSTFLFGISACGSHDAPAINEQATSKKTENEKLSSKDSQKELPTNVDSSDVYMSMGSAESLDVIGTGEVKAQGVFKVLDIAVYNRKEEPITLDINNFKLIDGFGREYHISNEYQSVLKAANTSTFKFGIVNPDEHSDGNIVFDVPKNTRGLTLKFNNDKLDKELQLKVELE

SEQ ID NO: 26996 - protein, 455 aa, Bacillus cereus BAG3O-2
MNNRFLKQLQNMKMNKKRLGVVALTAGIISTTLIPQNAYAHGFVEKPGSRSALCSPTYGALNVNCGSVMYEPQSLEAPKGFPQGGPVDGQIASAGGKFGGILDQQTENRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVPGTHFIDKKLQPSTEYSYTVKAIDAAGNVSTESTALTVKTTVETPDTEAPTQPKGLHSMGTTASSVDLMWSPSDDNIGVDHYDIYRETEGSMKKIATSNTTSYLDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 26997 - protein, 971 aa, Bacillus cereus BAG3O-2
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITEKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWETITQNVNDTLKRLSAKEWTGYKTVTAYFVKYRVNTSGQFEYDVVFHGINTEEGAENKAPVAVINGPYSGNVNEAILFTSDGSKDEDGKITSYKWEFGDGAVSNEQNPTHVYTKEGTYTTKLTVTDDKGATNTATATVTVQKKEDNSVEKEPNNSFQTANQLQLNQVLRASLGNGDTSDFFEFNVETAKNLQINVTNENNIGMNWVLYSEADLNNYVTYAQQQGNKLVGSYYTYPGKYYLHVYQYGGGTGNYTVEVK

SEQ ID NO: 26998 - protein, 458 aa, Bacillus cereus BAG3O-2
MNLKLTSKFERLRKSKKGIGACVLAAGVTAITMIPQSAYAHGFVEKPSSRAALCSQNYGALNLNCGNIMYEPQSLEAPKGFPDGGPIDGKIASAGGLFGGILDQQTSNRWFKNTIKGGANTFTWKYTAAHPTSKWHYYITKKGWDPNKPLTRAELEPIGTVKHDGSAASNNITHTINVPTDRNGYHVILAVWDVSDTSNAFYNVIDVNLVNNETPDTVAPSQPTELNASKVTANSVALTWKASTDNIGVKEYKVLRNGEVIDTVPGTTFIDKKLKANTEYTYTIKALDSAGNISKESEELKVKTTNEIPDIEAPTQPKGLHSMSTTATTVDLMWSPSEDNVGVDHYIVYRESFGVMNKIGTTDNTSFMDKELKANTSYKYVVTAVDLAGNESSRSDVLNVITKSEDSTYEKWDARKAYTKGDRVVHEGKVYEAVQDYQGNGDTNWIFSLSLWKPVLNK

SEQ ID NO: 26999 - protein, 667 aa, Bacillus cereus BAG3O-2
MIIKKHPFRTLAKTAVALTMIIPTSQAISQPFAYAQENITKSQQQVAPFWNKNKDYPGESYVTYEGKVYHSVYWVNAGTLPTQQFSGWELYTGSEYIPDNSDPNDLFGEGITWPTHVFAPYVDNGMNPQNLLKYAQETNTSFFTLSFIVADKNGNPVWGGSHTPIGDGNLDDQIKQIRKIGGDVKVSFGGANAGNIPGLGADLAAAITDVNKLKDAYKSVINTLHLTHMDFDIEGVLVAHPESIERRSKAIALLQKELKAEGKDVKIGYTLPVMPYGLTNDGINVIQSAIKHDVDLNSINIMTMDYGQQNQQMGQAAIDAINSLHGQLTNLYKGTIKDSDIWKMIAVTPMIGKNDTQNETFTLNNAKELFQFAKEKGIGEISMWSVYRDKKATESWQIGQATGDASGLPDVEDGAFSKLFSAFNSNTEIDIIAPTAPSNLRSVNQTATTVELQWEASTDNIGVKEYEVYRDGKKVGTTKTTRYEDAGLQANTKYNYKIKATDAAGNKSKSSNEVSVTTKEENPEQTAPTAPTELQASETTTNSVHLIWEKSISNVGIKEYEIYRNGTKIATSPSTYYTDENLLASTEYSYMVKAIDTQGKVSVASNEIKITTKDTSSSEYKAWDSYAAYKKGDRVEHQGKIFEAVQSYQGYGDPNWIFSLALWKVIK

SEQ ID NO: 27000 - protein, 333 aa, Bacillus cereus BAG3O-2; identical to SEQ ID NO: 26676

SEQ ID NO: 27001 - protein, 503 aa, Bacillus cereus BAG3O-2; identical to SEQ ID NO: 26634

SEQ ID NO: 27002 - protein, 172 aa, Bacillus cereus BAG3O-2
MGKIFKFGCLGIIALFVIGIIAMVAGGGDSTEQTSTDTKAVSKEGVSSDVKISVGSMETVDSVGNEYSKEQAQGVFKILEVTLTNNQKDAITVDTNSFKLVDNKGREFTSSVQGQSSFDLANGGKTDFFLKQLNPGLTQTGKIVFDIPKDAEGLFLKASGGMTGKEINLKVE

SEQ ID NO: 27003 - protein, 960 aa, Bacillus cereus BAG3O-2
MNKNLKFTQLIIGMSTMALSFGSIQTQISAEEKAPYNLLQMKPIGTETSKDEMAHATKADETLNFEERLKVGDFSQRPTSVMKHDERQLKQSYTLAELNKMSDSEFIDTLSRVSWNQITDLFQFNQDTKAFYQNKERMNVIIDELGQRGTSFTKEDSKGIETFVEVLRSAFYVGYFNNEVGYLKERSFHDKCLPSLKAIAKNPNFTLGTAEQDRVVVAYGKLISNASSDAETVQYAANILKQFNDNLSMYAKNYTKEQAVYEIVKGIDYDLQSYLQETNKKPNATMWYGKIDNFINEVSRIALIRNLTTENSWLINNGIYYAGRLGKFHSNPNKGLEVITQAMNMYPRLSGPYFIAVEQIKTNYGGKDYDGNTVDLQKIREEGKLQYLPKTYTFDDGSIVFKTGDKVTEEKIKRLYWAAKEVKAQYHRVIGNDKALEPGNADDVLTIVIYNNPDDYQLNRQLYGYETNNGGIYIEEKGTFFTYERTPKQSIYSLEELFRHEFTHYLQGRYEVPGLFGSGELYQNERLTWFQEGNAEFFAGSTRTNNVVPRKSIISGLSSDPASRYTAKQTLFAKYGSWDFYNYSFALQSYLYNHHFETFDKIQDLIRANDVKNYDAYREALSKDAQLNTEYQTYMQQLIDNQDKYNVPQVTNDYLIQHAPKPLAEVKKEIVDVTNIKDAKITKHESQFFNTFTVEGKYIGSTSKGESEDWKTMSKQVNQTLEQLSQTGWSGYKTVTAYFVNYRVNAANQFEYDIVFHGVATEEKEKTTTIVNMNGPYSGIVNEGIQFHSDGTESENGKIISYLWNFGDGTTSTEVSPTHVYGEKGAYTVELTVKDSRGKESKEQTKVTVKQDPQTGGSLEEEKVLPFNKLVKGNLIAPDQTDVYTFDVTVPKEVDISVVNEQNIGMTWVLYHESDMQNYVACGEDEGNAIKGKFVAKPGKYYLNVYKFDDNTGEYSLLIK

SEQ ID NO: 27004 - protein, 878 aa, Bacillus cereus BAG3O-2
MVKYSKISKWILGVGLVTITCNGLQIQAETKEKNVKNVLQMEPVGIQKSVNELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTQDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDTIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDEYRATLSKDNKLNEEYQSYMQMLIDNRDKYTIPQVSDEYLTQHDPKSLSDVTSDITNEAKLKDVKVTKNKSQFFNTFTLQGTYTGSAAKGEVEDWKVMNETTNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 27005 - protein, 746 aa, Bacillus cereus BAG3O-2
MGNKSKYKTKRILVATATLTIIASGMASSSDVFAEETQQQKNLSTSLQSEKSVKSENRTFTVPGKGDVEILKQQERKSMAFSPYEPTGLYAKPNEQITINVEGNQDIQVYIGTYSYDASWREDSKIKSFTLKPGINTIQSPNGGMIYFYNKQQGGTIRTTITTGGTTMPFFELGKHTKQDLINMLDQYPNAHAVELKGERVLITASPARVKKYLLGSNTDPVQLLKKLDEATRIQDKVAGLSEEQVDKHYVHYVEENHSPDYYMYATSYRTAYVGDAIQYVLDINKFVTDGWGPWHEAGHLRQQSPWKFYNMTEVQNNIYSLSVEKAFNRPSNLEKSGIYPKAFQYLEQVNKNYDEISDVFVKLVMLWQLQLAYGEDFYPKLHQLYRDMPSSELPQTDENKKQLFMISASKVAKQNLIPFFEQWGLRPNNDTIQKVAALGYPILTAEIWKSTDSNPIKPDMPNVNNILEGNQFTWSLKGIGDFEFAKINFNKSTEEMQVDLKAGVPHHYFNETYASIKVQNASGKVVYNKDIYGNKQQNAESQKVSVKVGDYIELTHLEGVHRATLTNVDNSKQESFGKKAMYQVTKEGLKKVNQIVNPKPDTEAPTQPQGLYASNLTSNSVELKWNPSTDNVGVKEYQVLRDGQLIQTVQGTTFTDQNLTVNKEYKYAVKAVDAAGNTSIQSEILLVKTKDQNVSYEKWDPKKAYTKGDKVEHQGTVYEAVQNHQGNGDPNWIFALSLWKAITIN

SEQ ID NO: 27006 - protein, 553 aa, Bacillus cereus BAG3O-2
MKKIFSVLLVLFLTFSTWSSVLVKADSSSKGTLTIHKYEQEKDGAQGLEGDGSANQEVPKDVKPLKGVTFEVKRVASFEKISNDGKIVKEDVKPVMGATPNQVVTDDNGQVVLKDLPLGRYEVKEVAGPPHVNLNPNTYTVDIPLTNKEGKVLNYDVHMYPKNEIKRGAVDLIKTGVNEKALAGAVFSLFKKDGTEVKKELATDANGHIRVQGLEYGEYYFQETKAPKGYVIDPTKREFFVKNSGTINEDGTITSGTVVKLEVKNYEEPTIDKKINGKLEALPINPLTNYHYDIKTLIPEDIKEYKKYVVTDTLDNRLVIQGKPIVKIDGAEVNASIVEVAIEGQKVTATVKDFTKLDGKKEFHLQIKSQVKEGVPSGSEILNTAKIDFTNKNDVIGEKESKPVVVIPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKSANN

SEQ ID NO: 27007 - protein, 179 aa, Bacillus cereus BAG3O-2; identical to SEQ ID NO: 26847

SEQ ID NO: 27008 - protein, 183 aa, Bacillus cereus BAG3O-2; identical to SEQ ID NO: 26632

SEQ ID NO: 27009 - protein, 370 aa, Bacillus cereus BAG3O-2
MKTKKTIAASTLALAMIAGANSAHAEVNDATPQQSTGDRLAEIKQHKQELDAKLQQHKENVDQTLNELNKVKENVDTKVNELHERKQVADEKINEVKQHKQELDAKLQQDKQIAEDKIAEIKEHKKQVEDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLSKKKQDLDIKINDFKHTEKKIDDKLAELHTTKQNVDNKINEVSQSKQTQADNGTKNNNAKELPNAGSEQSNNMALGMLSVLGGVLLLTRNKIKTLFSK

SEQ ID NO: 27010 - protein, 336 aa, Bacillus cereus BAG3O-2
MKRSKTYLKCLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKLFTLDWKNKKLVEKK

SEQ ID NO: 27011 - protein, 62 aa, Bacillus cereus BAG3O-2
PGTPDPEKPGTPDPEKPGTPNPEKLEKELPKTGQKMPVEPYMGALLVMMSFGLLILGRKQQR

SEQ ID NO: 27012 - protein, 1093 aa, Bacillus cereus BAG3O-2
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYTVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKPQTIEVKTGETGAVQIVNNKVKGNIEIKKLSDSGKILPNVEFTVFTEDGKEVKKVVTKENGIANVEDLTYGKYYFLETKTPNGYIGNKTKYPFEIKEHNKTLTFTVENTEVKGSVKLLKVDNEDISKKLEGAAFELKDANGKVVGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPNGYVLNEETFSFEIKENGQIIKHIVKDEKIPSIKTTATDKIDGTKEMHTSKSVTIQDKVEYKDLQVGKEYTLKGKLMNKETNKPLVVNGKEVTVETKFTPKEANGSITLDFTFDATGLEEKEVVVFEELLKDGKVVTIHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIVTHADINDVGQTVRFVEPSIKTTATNKADGSKELDASKTVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEQPNSGKNTPTPEQPNEQVKEQPQLKKEIQSKIGWLPQTGTNLTSWISMAAGALLLIVGGVIFLKRKNA

SEQ ID NO: 27013 - protein, 893 aa, Bacillus cereus BAG3O-2
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDIKFISEPEVKAVIFVDENHGQASNAYQVTFAATTPNYVSGTYLVNAHNGDMLKDVVQESSLKISEEYVESVKENKTSNFTSLTGTGKDDLGVTRTFGISKQTSGNYALADYTRGQGIETYDVNYRDITNEESYYPGILATSASTTFNDPKAVSAHFLATKVYDFYKEKYNRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANTDELNMTSDFSELKLACLKVAANKYGTNSIEVQAVQNAFDAAKITGTVKENEKTAENQAPELTVPFTITLRVGDTFDPMRNVKAVDKEDGDLTNKVKHKGDVDTSKPGTYIVEYLVVDSQGGNATATQTVIVEGNGETSDLEPKLTVPVGATIHVGDSFVPMAEVLAIDKEDGDLTSKIKVDGEVDTNKAGTYVLKYTVTDSKGHEVTAKQTVTVKVREEVKNDKPILKVPATTSITEGDQFDPLIGVSATDTEDGDLTSKVAYEGTIDTNKAGIYEIIYSVRDSVGNEVNTIQKVLVKDKETSKPNGLANKANKSNISNNSNSDKKEYTYKELPKTGVSTTNSAAIGILMIITGTVLTFVRKFRKIQK

SEQ ID NO: 27014 - protein, 738 aa, Bacillus cereus BAG3O-2
MKQLKPAISVLGSVSMALTLVSPALADVKQPNPGGTVEIFKENANAKKEDKNFTLGSDGEIGSLITQNIEMANNDWDKDGISNDLEINGYKIEFNSQTGKNEAKAWDPEKDKGKPKFISNPMNANTDGDPFTDMYEVENYNNDSDTNFNPIVANIPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRIYTPKDKSLADKPVLSYNEVFQHVNIDTKKVNHIVNKAKSTNNVSVVSANNGTDALNDLKAGQGDGGYLHKDSVHGAFAKLQQPTLVEGSYDSVTQKIRATILPGLFGVSKEIPTTYNKKWNAPSQTVTLVKRENGFTYESRENIHPIKSEIAAHRKVTFEINDAHNLTPIQKIDTEIKANKEFEDYVVDNSGEFVTEGVPYTVASYGNTAYWGSHHAGNKWEYLWSEKSSDEKVNVIIERVGQPKPGKPIKKDEEVLIKFQNPIYSDYAYLKLQDSYIHLDQKQNASTFKFNHAYPKNFTGHHKQWNILSNGNKLKVGYLIDYMKYGNGENGTDTIAWNLSRVQ

SEQ ID NO: 27015 - protein, 431 aa, Bacillus cereus BAG3O-2; identical to SEQ ID NO: 26534

SEQ ID NO: 27016 - protein, 706 aa, Bacillus cereus BAG3O-2
MKIEDQLPNGLEYVKDSLKAEGNEPNPVELKEEAGKITAKYENITDTAERSIIFKVKVTEAVKVGKKIVNTAIVDDDNPKNPPQKPEAIITPEYKNGKIKAEKTVNNPAPKLGEEVEYRITFRNVVEHGKLAKVKIKDELPNSLEFVEGSERAEGDNPKPLHVKVKNGIVLAEYPEITDTKERSIVFKAKVKEKAKIGEAIVNTAVVEDTINPPEKPNVAIQPQHKEGVLQAEKTVSNHEPKLGEEVEYRISFENTVENGKLTEVKVEDEIPAGLEYVQDSIKSDGPEPNPVELKVENGKVTAKYPEITDTKKRSIIFKVKVQETVQVGKEIINKAVVDDNNPTNPPVESLIPITPQYKDGKLEARKEVSNHEPKLGEEIEYRITFNGRVDGGKLVDVKIEDEIPSGLEYVKESLEAVGDKPVPTELKVENGKVTVKYPEITDTKERSIIFKVKVKESVKVGEEITNKAIIHVDDPDHPVMEPTATIKPEYKDGKLKATKTVNNKEPKLGEEVEYRISFKNTVENGKLAEVKVEDEIPAGLEYVQDSIRFEGAEPNPIELKMEFGKVIAKYLEITDTKERSIIFKVKVKAAPSKGITNRAVVDDKINPPLEPTVTILPKTKEDLKIPEEPKEPEVKPEDPKEPKEPKEPEVKPEVRLEKLIKEPQAKVEKELPKTGAAHSWMMSVGAGISFLVGGVLFVLGRRRKQ

SEQ ID NO: 27017 - protein, 120 aa, Bacillus cereus BAG3X2-1
KEEVKEPVKEVKETKEEVKEPVKEVEETKEEVKKPTKEVEEVKESATGLDQEPKENNQVVEKEGRKADTLNKQHTNKSEEGKKSLPSTGGEASTSTLLSGITLVLSTLSMFVFRKRLFKK

SEQ ID NO: 27018 - protein, 164 aa, Bacillus cereus BAG3X2-1
MKKKLLPICAMALLTVGYSSVASASTGTLTKEETAQMQQDKAKKEEAIKEQQKSEVEKKEAAQVQEKSDMAKKEEAIKAGQKNDTAKQEVTPQVQEKEALAKKEAAIKAGQKNDAAKQEVAKQAVQGEKLPNTASNNVAMMALSACLVAIGTLFGLNRRNKIKA

SEQ ID NO: 27019 - protein, 542 aa, Bacillus cereus BAG3X2-1
MKQKKISLLVFTIIISLIFSACSNKTNKTEAGSQKQVLNLTIPEEIPSLDTAKAMDGTSSHIMQNIFEGLYVLDNQDNPIPGVAKSFERSKDEKKYTFHLRKDAKWSNGEMVTAHDFAFAWKRTLSPETASQYAYMLFYIKNAKEINKGIVAADQLGVKAIDDYTLEVELEQPVPYLLQLLALPIYLPQHESFVKEKGSSYGLEPENLIYNGPFVLEKWKHGQEFQLKKNNRYWDKKQVKLQAIDFNIVKDTMTAINLYESGSIDRAPITAKHFEQYKDNKELHMKKEAGIAMLRFNEKNTTLANKKIRQSISLALNKEEIVNHFGSTGATPAEGLIPAGYTNEATQKDFRKENGSLVLYDLQKAKQTWEDAKKELGIESVTLELLAFEQDNERIIAEYIKGELEKHLQGLTIQIKQQPFKQKLQLEQTGQYEISMVGWAPDYKDPISFLELFTTDNPNNKMKYSNSSYDDFINKAKNEVILDQQKRWDYLLEAERVLLEDAAVAPLYHTGKAYVQKDYVKGIEKHQFGGAYTYKNTFLIKK

SEQ ID NO: 27020 - protein, 965 aa, Bacillus cereus BAG3X2-1
MNKKSKINKVMLSISTMALSLGAIQTNVSAEEKVPYNVLHSKPVGIEKPVDEVGQISKAEETLSFQERLKVGDFSQRPASIMKSSEVKQMKESYSMADLNKMNNQELVETLGSIKWNQITDLFQFNEDAKAFYKDKGKMQAIIDELAHRGSTFTKDDSKGIQTFTEVLRSAFYLAFYNNELSDLNERSFQDKCLPALKAIATNPNFKLGTYEQDAVVSAYGKLSSNASSDVETVQYASNILKQYNDNFHTYVDDRMKGQAVYDMMQGIDYDMQSYLFETRKEAKDTMWYGKIDGFINEINRIALLNEVTPENKWLVNNGIYFASRLGKFHSNPNKGLEVVTQAMHMYPRLSEPYFVAVEQITTNYNGKDYSGNTVDLETIRKEGKEQYLPKTYTFDDGSIVFKTGDKVSEEKIKRLYWAAKEVKAQYHRVIGNDKALEPGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFEMFDKIQDLIRANDVGNYDTYRETLSKDSKLNKEYQEYMQQLIDNQDKYNVPEVADDYLAEHAPKALTEVKKEISDTLSMKDTKMTKHTSQFFNTFTLEGTFTGSVTKGESADWKAMSKRVNEALEQLTQKEWSGYKTVTAYFVNYRVNSSNEFEYDVVFHGIAKDDGENKAPTVNVNGPYNGGVKEGIQFKSDGSNDEDGKIVSYLWDFGDGRTSKEVNPVHAYEREGTYKVALRVKDDKGKESRSETTVTIKDGSLTESEPNNRPEEANHIGLNTTIKGSLIGGDYTDTYTFNVASAKDIDISVLNEYGIGMTWVLHHESDMQNYAAYGQANGNHIEAKFNAKPGKYYLYVYKYDNGDGTYALSVK

SEQ ID NO: 27021 - protein, 769 aa, Bacillus cereus BAG3X2-1
MKKLKPIIGAVSSLTMALTITAPALAETKPEQEGKVETFKEDTNLKEGQNIIYGDSGKKGIMIMEKPQENNDWDEDGIPNDVEEKGFKIVFNEKTGKHEAQLYDLVQDFGKKRFITNPKSANSDGDPFTDSYEVEHYDSDSDIDFNPMIANVPNLQIAVKRIDITPAASITDSNGESRTNTWEKSLSVQHSFNVGLAGEGGAEGSAAGPVPSGKGSINVGYGYSNTKTETESISNSFDWSTATTVDSSKAANVRLHLEYKNTGTASAGDVSPHFNIRLGNKIINTVKATQDRYKANLLTTAKGGNNKTEILMDSIEGQADVKISLTLDELKAVEQGAPLSIEVLPTSTMNVYTMKDGQFVNLGDWSHFASNVNASTTLVETNYGPMPKYRVYTPRTGKEKPANINHNLSLDEFFAHTGIADKGWVANYVVNGRLNEDRERYGPNRTLLERGKNLGFFDNRALRPTLSYSSYDYSKKKIYASVIPGIFNLSDEIFVTVRNKKGESQKVTLVRNQNSNVYESKENEPVDIAVNRASLGGYQAKFELLDAKENKIEVFTPLVSNKSYLEAIDKLVVDNSGEPIVEGKKYYLKSSVGFYDGVKESWSAGTINQSINGRYVHFSLKGNNWDGLRLGPIQQAIHGPDIQATPVLIERKGKSKPEEPFKKDEEVFLKFTNSSHNNYQYLNFGNGYDYSWLDTEHNKSAIKLDKIPNQKSFYIKSDSNYITSRENQWTSSVADNGIAPLVGAGERVLKSEHTTSPGNYHQWELESSK

SEQ ID NO: 27022 - protein, 878 aa, Bacillus cereus BAG3X2-1
MVKYSKISKLILGVGLVTISCNGLQIQAETKEKNVKNVLQMEPIGIQKSVDELAHSSKVQENASFTKRLKLADLSQRPLAPNENVKQLAEEKKYSMAELNQLSNKQLTDLLVTIKWYQIPELFQFNSDSLKFYQDDSRMQAIIDKLVEQGQAYTKDDTKGIETLVETLRAAFYLGFYHDELSKLNERSYHDKCLPALKAIAKNPNFKLGTPEQNQVISSYGMLIGNASADVEVVQYAGEIFKQYNDNVATFVEDNTKGNAVYELMKGIDYDIQAYMYNTGKEAKDTMWYRNIDGLINEISRFALIGTVTDKNGWLINNGIYYAGRLGKLHSTPTKGQQVVTDAMRIYPYLGEQYFVAAEQITTNYGGVDATGKTINLDQIREEGKKKYLPKTYTFDDGAIVFKAGDKVSEEKIKRLYWAAKEVRSQFYRTVGSDKPLESGHTDDVLTMVIYNSPDEYQFNRQLYGYETNNGGIYIEGSGTFFTYERTPEQSIYSLEELFRHEFTHYLQGRYEVPGLWGQGELYQNERLTWFEEGNAEFFAGSTRLDSVVPRKSIIGGLSYDPAKRYTAAQTLNAKYGTWDFYNYSFALQSYMYNKRPEMFDKVHDLIRANDVPGYDTYRSTLSKDNKLNEEYQSYMQMLIDNRDKYTIPQVSDDYVAQHAPKPLSDVASDITNEAKLKNVKVTKNKSQFFNTFTLQGTYTGSAAKGENEDWKVMNQATNDMLKHLSEKGWSGYKTLTAYFVNYRVNDAGQFEYDVVFSGVNTEEGTAVEKEPNNSFDTANLLSLNTLLRGNLSDQDQVDRFVIDVKDPKDLQITVTNEQNLGLNWVLYSESDLNNYVTYATKRDGNKLLGNYNAKPGKYYLSVYKYGGGAGNYTVEVK

SEQ ID NO: 27023 - protein, 185 aa, Bacillus cereus BAG3X2-1
MRKLSILLTLILVLVSVTAACTQDKKDSAVENGPIEEPTAKNENEELINFEEEEEEDMSRLEQGILLVGESAKGGYYLTEVQSAYLNDSNDSVVVNVSIKNVRGQMIGLSELKYNLKDEKDGKAYEGKVLDQNPSDIQVKPNETVELKIAFEVPGTADEYMFYIESSLESLEAHWKIDKLQSQKN

SEQ ID NO: 27024 - protein, 117 aa, Bacillus cereus BAG3X2-1
EGNNGENPTTPPTGEGNNGENPTPPPTGEGNNGGNPTTPPTGEGNNGNEPKQDGNNAGSGQTTTDNQNSKETTTVSENKEERDLPKTGTSVVSTIGAGLAFVGAGLLLLFRRKKANR

SEQ ID NO: 27025 - protein, 333 aa, Bacillus cereus BAG3X2-1
MKSKLLKVVLSFGMSLAALYSGSSVQAEMSTNQNDTLKVMTHNVYMLSTNLYPNWGQSQRADLIGAADYIKNQDVVILNEVFDNSASNRLLGNLKKEYPNQTAVLGRSSGSEWDKTLGNYSSSTPEDGGVAIVSKWPIVEKIQYVFEKGCGPDNLSNKGFAYTKVKKNDRFVHVIGTHLQAEDSMCGNTSPASVRTKQLQEIQEFIKNKNIPNNEYVLIGGDMNVNKINAENNSDSEYASMFKTLHASIPTYTGHTATWDATTNSIAKYNFPDSPAEYLDYIIASKDHANPSHIENKVLQPKSPQWTVTSWFKKYTYDDYSDHYPVESTISMK

SEQ ID NO: 27026 - protein, 971 aa, Bacillus cereus BAG3X2-1
MKGYSKKILVGVSFASLMLGSFQGSILAGDTKGEQVSYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTKDDSKGIETLVEVLRSGFYLGFYNAELSKLNERSYHDKCLPALKTIANNPNFKLGTLEQNKVVSSYGKLIGNASSDVETITLAAKIFKQYNDNFSTLVDNLSAGNAIYDIMQGVDYDIQSYLYDTRKAPKDTVWYQRIDSYINELSRFALMGTITEKNGWLINNGIYYTGRLGIFHSTGTKGLQVATDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKLYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSALSQDANLNKEYQDYMQMLVDNREKYNVPLVSDDYLATHAPKPVSDIAAEITAEAKLSNVSVKKNKSQFFNTFTLQGTYTGTAAKGENEDWKTITQNVNDTLKRLSAKEWTGYKTVTAYFVNYRVNASGQFEYDVVFHGINTEEGAVNKAPIAVIDGPYNGNVNEAISFKSDGSKDEDGKIASYKWEFGDGAVSNEQNPTHVYTKEGTYTAKLTVTDDKGLTNTATASVTVQKKEDNSIEKEPNNSFQTANKMQLNQLLRASLGNGDTSDYFEINVETARNLQINVTKENNIGVNWVLYSAADLNNYVTYAQTQGNKLVGSYNAHPGKYYLHVYQYGGGTGNYTVEVK

SEQ ID NO: 27027 - protein, 182 aa, Bacillus cereus BAG3X2-1
MNKRLLTSLLCSTFLFGLSACGSHDTSSSNTKNEQETSKETKTDELSNKDPQKEFPTHGDFSGIYISIGSVNSLNVIGNGEVQAQGVFKVLDLRVHNGQEEPITLNSDNFKLIDGTGREYHISNEFQLTLKAANTATFKFGVLNPRENSEGNIVFDVPKNTQGLTLKVNGDMLGKGIELKVE

SEQ ID NO: 27028 - protein, 503 aa, Bacillus cereus BAG3X2-1
MLNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQSVKDVKEVTTKISEKDAIQKSMAYVGEASEQNLWAPTEKEFGYIVEEGIARPVYKVVVHSNNPFGAWETFIDAENGKLIKKVDINRKVEGTGKVFLPNPVVSSGSKTGLKDNNDADSTALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACVGEWDATAYSSSDPTCLRRLDTNKVYPKDVTNEVHDDGEIWAQGQYEMAQAFGRDVATKIILQSHWSLTPNAKFRDGAKAIKQADALLYGGQHAADIDRIWAARGISTN

SEQ ID NO: 27029 - protein, 431 aa, Bacillus cereus BAG3X2-1; identical to SEQ ID NO: 26715

SEQ ID NO: 27030 - protein, 378 aa, Bacillus cereus BAG3X2-1
MKTKQTIAASTLALAMIAGSTPTHAEVNEATPQQSTGDRLAEIKQHRQELDAKLQQHKENVDQTLNELNQVKENVDTKVNELHERKQVADEKIGEIKQHKQELDAKLQQDKQIAEDKIAEIKEHKKQVDDKVAEIKEHKQNIDNKVTEIKEHKQTVDEKVNEIKQHKENIDQKVNELKEVKKQVDEKLAELKKAKQTAEDKLAELKENKPNIGNTLEELKKIKGNLDSLSANLELAKQDVKNKLAELQEARQDLLNKINEMKQAKQTVSDDLSKKKQDLDIKINDFKHTEKKIDDKLAELHTTKQNVDNKINEVSQPKQTTVNNNTTTTPSTVPAKNNAKELPNAGSEQSSNMALGMLSILGGILLVTRNKIKTLFSK

SEQ ID NO: 27031 - protein, 149 aa, Bacillus cereus BAG3X2-1
MKKKFLLICAIALLSIGYSSVASASTGTMSKEEVQAQEQALEKKEVEFQVWQKEALEKKKAAMQDQGKKALEKAEVVIQDQQKEALEKKKAAIQAQQKNDVEKKEVAKQAVKGEKLPNTASNSVIMMILSACLVALGSVFGFTRRKIKA

SEQ ID NO: 27032 - protein, 172 aa, Bacillus cereus BAG3X2-2
MGKIFKFGCLGIIALFVIGIIAMVAGGGDSTEKTSTDTKAVSKEGVSSDVKISVGSMETVDSVGNEYSKEQAQGVFKILEVTLTNNQKDAITVDTNSFKLVDNKGREFTSSVQGQTSFDLANGGKTDFFLKQLNPGLTQTGKIVFDIPKDAEGLFLKASGGMTGKEINLKVE

SEQ ID NO: 27033 - protein, 503 aa, Bacillus cereus BAG3X2-2; identical to SEQ ID NO: 26634

SEQ ID NO: 27034 - protein, 181 aa, Bacillus cereus BAG3X2-2
MNKKLLASLLCSTFLFGVSACGSHDAPAKNEQATSKKTENDKLSSKDSQKELPTNVDSSDVYMSMGSAESLDVIGTGEVKAQGVFKVLDIAVYNRKEEPITLDINNFKLIDGFGREYHISNEYQSVLKAANTSTFKFGIVNPDEHSDGNIVFDVPKNTRGLTLKFNNDKLDKELQLKVELE

SEQ ID NO: 27035 - protein, 163 aa, Bacillus cereus BAG3X2-2
MLKKVSQIVLIFGIAFSLSACTETKDSNESKQEDVQDKVYKIGETVDVDGLQVTIDSVKLGYTDYDEDKKKEEILGIIFKVENNSKKEIPFAFYEFEITDKKGTRFKEYNNPDSFISKKLAPEEKIQDIMLFDVAKENTYIATYRPEFTRENRTIKFELKPNK

SEQ ID NO: 27036 - protein, 175 aa, Bacillus cereus BAG3X2-2
MYKKLGTIAITGALAFSLAACGETEETAKKVSNDTKTEQPAEKKEEKKEFKIGEMIQLGDHKLTVTNIEKSQGGEFDKPKEGHEFLIAKVTIENSGKEEISYNPFDFSLQNSEGNIVDQAFTTVNQDTVLNSGKLAPNGKISGTIAFESKQGDPKLQLIFKPNFLSKKEIRVNLQ

SEQ ID NO: 27037 - protein, 458 aa, Bacillus cereus BAG3X2-2
MKLKLTSKLERLRTSKKGIGACVLAAGMTAITMTPQSAYAHGFVEKPSSRAALCSQNYGALNLNCGNVMYEPQSLEAPKGFPDSGPIDGEIASAGGLFGGILDQQTSNRWFKNTIKGGVNTFTWKYTAPHSTSKWHYYITKKGWDPNKPLTRAELEPIGTVKHDGSAASNNLTHTINVPTDRNGYHVILAVWDVADTSNAFYNVVDVNLVNNETPDTVAPSQPTELNASKVSANSVEITWKASTDNIGVKEYQVLRNGEVIDTVSGTTFIDKKLKADTEYTYTIKALDSAGNISKESEKLKVKTTHTIPDIEAPTQPKGLHSMGTTATTVNLMWSPSEDNVGVDHYIVYRESAGVMNKIGTAANTSFMDKDLKANTSYKYVVTAVDLAGNESSRSDVLNVTTKLEDPAYEKWDARKAYTKGDRVVHEGKVYEAVQNHQGNGDSNWIFALSLWKPVLNK

SEQ ID NO: 27038 - protein, 960 aa, Bacillus cereus BAG3X2-2
MNKNLKFTQMMIGISTMALSFGSIQTQVSAEEKAPYNTLQMKPIGTETLKDEIAHATKADGTLTFEERLKVGDFSQRPTSVMKHDERQLKQSYTLAELNKMPDSQFIDTLSRVSWNQITDLFQFNQDTKAFYQNKERMNVIIDELGQRGTSFTKEDSKGIETFVEVLRSAFYVGYFNNEVGYLKERSFHDKCLPSLKAIAKNPNFTLGTAEQDRVVVAYGKLISNASSDAETVQYAANILKQFNDNLSMYAKNYTKEQAVYEIVKGIDYDLQSYLQETNKKPNATMWYGKIDNFINEISRIALIRNLTTENSWLINNGIYYAGRLGKFHSNPNKGLEVITQAMNMYPRLSGPYFIAVEQIKTNYGGKDYDGNTVDLQKIREEGKLQYLPKTYTFDDGSIVFKTGDKVTEEKIKRLYWAAKEVKAQYHRVIGNDKALEPGNADDVLTIVIYNNPDDYQLNRQLYGYETNNGGIYIEEKGTFFTYERTPKQSIYSLEELFRHEFTHYLQGRYEVPGLFGSGELYQNERLTWFQEGNAEFFAGSTRTNNVVPRKSIISGLSSDPASRYTAKQTLFAKYGSWDFYNYSFALQSYLYNHHFETFDKIQDLIRANDVKNYDAYREALSKDAQLNTEYQTYMQQLIDNQDKYNVPQVTNDYLIQHAPKPLAEVKKEIVDVTNIKDAKITKHESQFFNTFTVEGKYIGSTSKGESEDWKTMSKQVNQTLEQLSQTGWSGYKTVTAYFVNYRVNAANQFEYDIVFHGVATEEKEKTTTIVNMNGPYSGIVNEGIQFHSDGTESENGKIISYLWNFGDGTTSTEANPTHVYGEKGTYTVELTVKDSRGKESKEQTKVTVKQDPQTGESLEEEKVLPFNKLVKGNLIAPDQTDVYTFDVTVPKEVDISVVNEQNIGMTWVLYHESDMQNYVVCGEDEGNAIKGKFVAKPGKYYLNVYKFDDNTGEYSLLIK

SEQ ID NO: 27039 - protein, 55 aa, Bacillus cereus BAG3X2-2; identical to SEQ ID NO: 26651

SEQ ID NO: 27040 - protein, 878 aa, Bacillus cereus BAG3X2-2
MVKYSKISKWILGVGLVTITCNGLQIQAETKEKNVKNVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQTYTKDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWYRNIDNFINEINRFALLGTVTNKNGWLINNGIYYAGRLGKLHSTPTKGQQVATDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPTKRYTASQTLNAKYGTWDFYNYSFALQSYMYNKRPEMFDKVHDLIRANDVSSYDEYRATLSKDNKLNEEYQSYMQMLIDNRDKYTIPQVSDEYLTQHDPKSLSDVTSDITNEAKLKDVKVTKNKSQFFNTFTLQGTYTGSAAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 27041 - protein, 431 aa, Bacillus cereus BAG3X2-2; identical to SEQ ID NO: 26534

SEQ ID NO: 27042 - protein, 553 aa, Bacillus cereus BAG3X2-2
MKKIFNVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGAVFSLFKKDGTEVKKELVTDANGHIRVQGLEYGEYYFQETKAPKGYVIDPTKREFFVKNSGTINEDGTITSGTVVKIEVKNNEEPTIDKKINGKLEALPINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDSANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 27043 - protein, 554 aa, Bacillus cereus BAG3X2-2
MKKFLSMFLIFLLAFASLPSMLIKAESKSEKKGTLTIHKFEQEPLNNPALKESSSKGVEIPKDAKPLAGVVYQIKQVESFGTISNDGKIVKEDIKPVNGVPIEVETNADGIAFFGDLPLGRYEVKEISGPPHVNIDTKTYKVDIPMTSEDGKVLTYDVKIYPKNETKRGAVELTKIGVENKALKGVQFSLYKEDGTELEKGLETDGNGKIRVGNLSYGKYYFLETKALDGYVLDPKKYEFFIKESGVINKDGTVTSGEVVKVDVKNYEEPTIDKKINGDLNNLPINTKTDYNYDIKTLIPEDIKDYKYYVVTDVLDSRLEIQDQPVVKIDGKVVDASVVEVVVDGQKVTATVKDFSKLDNKKEFHLQIKAQIRDGVETGVEIPNTATITFKNKDDVTGEKATKPVIVTPTTGGITLTKVDGKDGKKLEGAEFALQDTKGNPVEIDGKKVVGTSDKNGVITWNKLPYGEYQVVETKAPTYEKEDGTTGSYQQLREPIHVKIDADHKTVTLTVENNKSGWILPSTGGIGTILFTVVGLVLMIIAAFVFFRKKATNN

SEQ ID NO: 27044 - protein, 746 aa, Bacillus cereus BAG3X2-2
MGNNSKHKTRKILAATATVTMLATGMIFSSDVFAEQKEQQKNLSTSLQKEKSVKSENRTFTVPGKGDVEVLKQQERKSMAFSPYEPTGLYAKPNEQITINVEGNQDIQVYIGTYSYDASWREDSKIKSFTLKPGINTIQSPSGGMIYFYNKQQGGTIRTTITTGGTTTPFFELGKHTKQDLINMLDQYPNAHAVELKGERVLITASLARVKKYLLGSNTDPVQLLKKMDEATRIQDKVAGLSEEQVDKHYVHYVEENHSPDYYMYATSYRTAYVGDAIQYVLDINKFITDGWGPWHEAGHLRQQSPWKFYNMTEVQNNIYSLSVEKAFNQPSNLEKSGIYPKAFQYLEQVNKNYDEISDVFVKLVMLWQLQLAYGEDFYPKLHQLYRDMPSGELPQTDDNKKQLFMISASKVAKQNLIPFFEKWGLRPNNDTIQKVAALGYPILTAEIWKSTDSNPIKPDMPNVNNILEGNQFAWSLKGISDFEFAKINFNKSTEEMQVDLKAGVPHHYFNETYASIKVQNASGKVVYNKDIYGNKQQNAESQKVSVKVGDYIELTHLEGVHRATLTNVDNSKQESFGKKAMYEVTKEGLKKVNQIVNPKPDTEAPTQPQGLYASNLTSNSVELKWNPSTDNVGVKEYQVLRDGQLIQTVQGTTFTDQNLTVNKEYKYAVKAVDAAGNTSIQSEILLVKTKDQNVSYEKWDPKKAYTKGDKVEHQGTVYEAVQNHQGNGDPNWIFALSLWKAITIN

SEQ ID NO: 27045 - protein, 1093 aa, Bacillus cereus BAG3X2-2
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTQVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKPQTIEVKTGETGAVQIVNNKVKGNIEIKKLSDSGKILPNVEFTVFTEDGKEVKKVVTKENGIANVEDLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPNGYVLVKEPIMFEIKEHGKVIELLAVNHLIKGDLEITKVDVADGNNKLPNAEFTIYNEAGKEVVKGKTDDKGIAKFEKLPFGKYTYKETVAPNGYVLNEETFSFEIKENDQIIKHIVKDEKIPSIKTTATDKTDGTKEMHTSKSVTIQDKVEYKDLQVGKEYTLKGKLMNKETNKPFVVNGKEVTVETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKTVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEHPNSGKNTPTPEQPNEQVKEQPQLKKEIQSKIGWLPQTGTNLTSWISMAAGALLLIVGGVIFLKRKNA

SEQ ID NO: 27046 - protein, 509 aa, Bacillus cereus BAG3X2-2
ENEQLDKGSVEITKVDKDSQKVLEGVVFEVQDDKGKVVTEVKTDKNGKVKISDLSVGKYKLVEKESLPGYKQLTEPVSFEITKGMTEVLSLNIENEMVDTGNVEITKIDKDNKAPLAGVVFEVQDDKGKVVTKVTTDKAGKATVSDLSVGKYKLVEVESLPGYKKLEKPVPFEITKGMTKSLAFTVENEMVDTGNVEITKIDKDSKAPLENVVFEVRDSKGKVVAKVTTDKEGKANVSDLSVGKYKLVETKSLPGYKKLTEPVSFEITKGMTKVLSLKVENEQLDKGSVEIIKMAAESKEVLSGAVFEVHDEKGKVVVKVTTDKDGKAKITDLSVGNYTLVEVEAPKGYEKLTNPIPFEITNGMINAVQLEVLNKLNHLAPPGPETPDPEKPGTPDPEKPGTPDPEKPGTPNPEKPGTPNPEKPGTPNPEKPGTPNPEKPGTPNPEKPGTPNPEKPGTPDPEKPGTPNPEKPEKELPKTGQKMPVEPYMGALLVMMSFGLLILGRKQQR

SEQ ID NO: 27047 - protein, 370 aa, Bacillus cereus BAG3X2-2
MKTKQTIAASTLALAMIAGANSAHAEVNDTTPQQSTGDRLAEIKQHKQELDAKLQQQKENVDQTLNELNKVKENVDTKVNELHERKQVADEKINEVKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAVLQEARQDLINKINEIKQSKQTVSDDLSKKKQDLDIKINDFKHTEKKIDDKLAELHTTKQNVDNKINEVSQSKQTQADNGTKNNNAKELPNAGSEQSNNMALGMLSVLGGVLLLTRNKIKTLFSK

SEQ ID NO: 27048 - protein, 971 aa, Bacillus cereus BAG3X2-2
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQTIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNTSGQFEYDVVFHGINTEEGAENKAPVAVINGPYSGNVNEAISFTSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 27049 - protein, 893 aa, Bacillus cereus BAG3X2-2
MRNKKEIAIVALTTGFVLTSVTPYRVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDIKFISEPEVKAVIFVDENHGQASNAYQVTFAATTPNYVSGTYLVNAHNGDMLKDMVQESSLKISEEYVESVKENKTSNFTSLTGTGKDDLGVTRTFGISKQTSGNYALADYTRGQGIETYDVNYRDITNEESYYPGILATSASTTFNDPKAVSAHFLATKVYDFYKEKYNRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANTDELNMTSDFSELKLACLKVAANKYGTNSIEVQAVQNAFDAAKITGTVKENEKTAENQAPELTVPFTITLRVGDTFDPMRNVKAVDKEDGDLTNKVKHKGDVDTSKPGTYIVEYLVVDSQGGNATATQTVIVEGNGETSDLEPKLTVPVGATIHVGDSFVPMAEVLAIDKEDGDLTSKIKVDGEVDTNKAGTYVLKYTVTDSKGHEVTAKQTVTVKVREEVKNDKPILKVPATTSITEGDQFDPLIGVSATDKEDGDLTSKVAYEGTIDTNKAGIYEIIYSVRDSVGNEVNTIQKVLVKDKETSKPNGLANKTNNNNISNNSNTDKKEYTYKELPKTGVSTTNSAAIGILMIIAGTVLTLIRKFRKIQK

SEQ ID NO: 27050 - protein, 455 aa, Bacillus cereus BAG3X2-2
MNNRFLKQLQNMKMNKKSLGVVALTAGIISTTLIPQNAYAHGFVEKPGSRSALCSPTYGALNVNCGSVMYEPQSLEAPKGFPQGGPVDGQIASAGGKFGGILDQQTENRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVPGTHFIDKKLQPSTEYSYTVKAIDAAGNVSTESTALTVKTTVETPDTEAPTQPKGLHSMGTTASSVDLMWSPSDDNIGVDHYDIYRETEGSMKKIATSNTTSYLDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 27051 - protein, 336 aa, Bacillus cereus BAG3X2-2
MKRSKTYLKYLALSAVFASSAITLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKLFTLDWKNKKLVEKK

SEQ ID NO: 27052 - protein, 965 aa, Bacillus cereus BAG3X2-2
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDRELVETLGSIKWHQITDLFQFNEDAKAFYKDKGKMQVIIDELAHRGSTFTKDDSKGIQTFTEVLRSAFYLAFYNSELSDLNERSFQDKCLPALKAIANNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHAPKSLTEVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSAEVNPVHVYEREGSYKVSLRVKDDKGKESRSETTVTIKDGSLTESEPNNRLEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYKLSVK

SEQ ID NO: 27053 - protein, 333 aa, Bacillus cereus BAG3X2-2
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTDQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPQSPQWTVTSWFQKYTYNDYSDHYPVEATISMK

SEQ ID NO: 27054 - protein, 1093 aa, Bacillus cereus BAG4O-1; identical to SEQ ID NO: 27012

SEQ ID NO: 27055 - protein, 738 aa, Bacillus cereus BAG4O-1; identical to SEQ ID NO: 27014

SEQ ID NO: 27056 - protein, 179 aa, Bacillus cereus BAG4O-1; identical to SEQ ID NO: 26847

SEQ ID NO: 27057 - protein, 172 aa, Bacillus cereus BAG4O-1; identical to SEQ ID NO: 27002

SEQ ID NO: 27058 - protein, 746 aa, Bacillus cereus BAG4O-1; identical to SEQ ID NO: 27005

SEQ ID NO: 27059 - protein, 370 aa, Bacillus cereus BAG4O-1; identical to SEQ ID NO: 27009

SEQ ID NO: 27060 - protein, 431 aa, Bacillus cereus BAG4O-1; identical to SEQ ID NO: 26534

SEQ ID NO: 27061 - protein, 553 aa, Bacillus cereus BAG4O-1; identical to SEQ ID NO: 27006

SEQ ID NO: 27062 - protein, 667 aa, Bacillus cereus BAG4O-1; identical to SEQ ID NO: 26999

SEQ ID NO: 27063 - protein, 659 aa, Bacillus cereus BAG4O-1; identical to SEQ ID NO: 26992

SEQ ID NO: 27064 - protein, 458 aa, Bacillus cereus BAG4O-1; identical to SEQ ID NO: 26998

SEQ ID NO: 27065 - protein, 706 aa, Bacillus cereus BAG4O-1; identical to SEQ ID NO: 27016

SEQ ID NO: 27066 - protein, 971 aa, Bacillus cereus BAG4O-1; identical to SEQ ID NO: 26997

SEQ ID NO: 27067 - protein, 878 aa, Bacillus cereus BAG4O-1; identical to SEQ ID NO: 27004

SEQ ID NO: 27068 - protein, 960 aa, Bacillus cereus BAG4O-1; identical to SEQ ID NO: 27003

SEQ ID NO: 27069 - protein, 163 aa, Bacillus cereus BAG4O-1; identical to SEQ ID NO: 26501

SEQ ID NO: 27070 - protein, 81 aa, Bacillus cereus BAG4O-1
GNRVKGDSSSQGGNGSQGNRVKGDSNSEEGKGSQGDNVKDNTKKQGDKLPNTATHYPISILMGLSTFLIGMLLFIRRKNVK

SEQ ID NO: 27071 - protein, 62 aa, Bacillus cereus BAG4O-1; identical to SEQ ID NO: 27011

SEQ ID NO: 27072 - protein, 336 aa, Bacillus cereus BAG4O-1; identical to SEQ ID NO: 27010

SEQ ID NO: 27073 - protein, 455 aa, Bacillus cereus BAG4O-1; identical to SEQ ID NO: 26996

SEQ ID NO: 27074 - protein, 893 aa, Bacillus cereus BAG4O-1; identical to SEQ ID NO: 27013

SEQ ID NO: 27075 - protein, 333 aa, Bacillus cereus BAG4O-1; identical to SEQ ID NO: 26676

SEQ ID NO: 27076 - protein, 503 aa, Bacillus cereus BAG4O-1; identical to SEQ ID NO: 26634

SEQ ID NO: 27077 - protein, 181 aa, Bacillus cereus BAG4O-1; identical to SEQ ID NO: 26995

SEQ ID NO: 27078 - protein, 965 aa, Bacillus cereus BAG4O-1; identical to SEQ ID NO: 26994

SEQ ID NO: 27079 - protein, 183 aa, Bacillus cereus BAG4O-1; identical to SEQ ID NO: 26632

SEQ ID NO: 27080 - protein, 659 aa, Bacillus cereus BAG4X12-1
MFNQRTRNGVKKILTITAASTVFSMFGSSISIIEAASAPGVYVTPKNSVTSDIISIDWSPVQTAPYTYWAVHNWNQGGEAGGYAGFQQQSGFDENGKRTLHFAVWDPISSKEAIKAEYVSPTSVASNFGGEGTGLKIQTTYDWKNYNWYRMTMRSWQENGHTKFGQWLKDVSKNQWKLIGIMDFPVPNVTFNYGQMLFQEDWLGNGQDVREARVKNGYGRNISDKKWTSWNTQSIEGQEPLNNNWDGGATSEYLWFKAGGDSRSTIGTGKTFTLNQPSQPEIGKLDYDVKSMYYENEKLNITWQLKDSSTPQFKGKIEIYNNENMTGQPINVINDIKSYQNGISQSISLPTNTYAKIVLTDIFDQTVEKKVKIKNESPNILEGDRFAWSMKGIGDFEFAKLDLNKSTEELQVSLIAGTPHNYFDSTYASIKVQDTSGKVVYNKEIYGNTQQNAESKTVPVKVGNFIELTHLEGGERATLTNLDNNKRESFDKKVIYEVTKDGLKKVNQIVNPKPDTEAPTQPQGLYASNVASDSVELKWNPSTDNVGVKEYQVLRDGQLIQTVQETKFTDQNLTANKEYKYTVKAVDAAGNISVQSDILPVTTKSQNVTYEKWDPKKAYTKGDKVEYQGKFYEAVQSYQGNGDPTWIFALSLWQPFKMI

SEQ ID NO: 27081 - protein, 748 aa, Bacillus cereus BAG4X12-1
MKRISSLLLTMPIILGSIATIPHTKVSAETMSFNQETFTLETLNQQTDQAIANGNFEAHLNNLTAYLNGNIGGITEENLKKKLADPAFAAALAQWQFISQTGAVTMATFAKKDADHQKFLGWAMKNTDVMNTYLEGGSPTGKNPVNALEIWNTIWNADANSHEGLYLKLAIATSLAHAEPIKYWTNNQPINPLTRYQHYKSADQNNELLPCFRTYDVWHLRLVVNTWSPEEDLTWARNMINMEHPELKNQDKVGESAYLINYVTHNKDGVSIHAGNDAFYGLGWNLSSIYKFGGVCGNISKFGTQVSQAFGVAAMPVGQPGHCALIWNNKPSSWNLGNDISGWSQSSRHDATVIPWSDNSPTNQVPYMLLFENAERDPVKLDQSERLRWLAKAMTSKDNKIAIYKISTNILPINFLVWEDYVSLMLQNPNVTDAEWKELNNNIISVFPNEPRPMMDLLTQIKKHVPNTDDILEGDQFAWSLKGIGDFEFAKVNLNKSTEEMQIDLKAGVPHNYFDSTYASIKVQNTSGKVVYNKEFYGNKQQNAETQKVPVKIGDFIELTHLEGRERATLINLGNNKRENFDKKAMYEVTKDGLKKVNQVVNPKPDTEAPTQPQGLYASNVAFNSVELKWNPSTDNVGVKEYQVLRDGQLIQTVQGTTFTDQNLTANKEYKYAVKAVDAAGNTSIQSNILPVKTKDQNVSYEKWDPKKAYTKGDKVEHQGTVYEAVQNHQGNGDPNWIFALALWNPLT

SEQ ID NO: 27082 - protein, 960 aa, Bacillus cereus BAG4X12-1
MNKNLKFTQMMIGISTMALSFGSIQTQVSAEEKAPYNLLQMKPIGTETSKDEMAHATKADETLNFEERLKVGDFSQRPTSVMKHDERQLKQSYTLAELNKMSDSEFIDTLSRVSWNQITDLFQFNQDTKAFYQNKERMNVIIDELGQRGTSFTKEDSKGIETFVEVLRSAFYVGYFNNEVGYLKERSFHDKCLPSLKAIAKNPNFTLGTAEQDRVVVAYGKLISNASSDAETVQYAANILKQFNDNLSMYAKNYTKEQAVYEIVKGIDYDLQSYLQETNKKPNATMWYGKIDNFINEVSRIALIRNLTTENSWLINNGIYYAGRLGKFHSNPNKGLEVITQAMNMYPRLSGPYFIAVEQIKTNYGGKDYDGNTVDLQKIREEGKLQYLPKTYTFDDGSIVFKTGDKVTEEKIKRLYWAAKEVKAQYHRVIGNDKALEPGNADDVLTIVIYNNPDDYQLNRQLYGYETNNGGIYIEEKGTFFTYERTPKQSIYSLEELFRHEFTHYLQGRYEVPGLFGSGELYQNERLTWFQEGNAEFFAGSTRTNNVVPRKSIISGLSSDPASRYTAKQTLFAKYGSWDFYNYSFALQSYLYNHHFETFDKIQDLIRANDVKNYDAYREALSKDAQLNTEYQTYMQQLIDNQDKYNVPQVTNDYLIQHAPKPLAEVKKEIVDVTNIKDAKITKHESQFFNTFTVEGKYIGSTSKGESEDWKTMSKQVNQTLEQLSQKGWSGYKTVTAYFVNYRVNAANQFEYDIVFHGVATEEKEKTTTIVNMNGPYSGIVNEGIQFHSDGTESENGKVISYLWNFGDGTTSTEANPTHVYGEKGAYTVELTVKDSRGKESKEQTKVTVKQDPQTGGSLEEEKVLPFNKLVKGNLIAPDQTDVYTFDVTVPKEVDISVVNEQNIGMTWVLYHESDMQNYVACGEDEGNAIKGKFVAKPGKYYLNVYKFDDNTGEYSLLIK

SEQ ID NO: 27083 - protein, 336 aa, Bacillus cereus BAG4X12-1; identical to SEQ ID NO: 27010

SEQ ID NO: 27084 - protein, 740 aa, Bacillus cereus BAG4X12-1
MGNKLKHKTKRILVATATLTIISSGMASSSDVFAEETQQQKNLSTSPQSEKSVKSENRTFTVPGKGDVEVLKQQERKSMAFSPYEPTGLYAKPNEQITINVEGNQDIQVYIGTYSYDASWREDSKIKSFTLKPGVNTIQSPNGGLIYFYNKQQGGTIRTTITTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYATSYRTAYVGDAIQYVLDINKFVTDGWGPWHEAGHLRQQVPWKFYNMGEVQNNIYSLSVEKAFNQPSNLEKSGTYTKAFQYLEQTNKNYDEISDAFVKLVMLWQLQLAYGEDFYPKLHQLYRDMSSNELPQTDENKKQLFMISASKVAKQNLIPFFEKWGLHPNNDTIQKVTALGYPILTAEIWRGTDSNPNSLNVLEGSQFAWSLKGIGDFEFAKVNLNKSTEEMQIDLKAGVPHNYFDSTYASIKVQNTSGKVVYNKEIYGNKQQNAEQAKVPVKVGDFIEFTHLEGANRATITNMEKNIQEIFGNKVVYEITREGLKKVDKIVNPKPDTEAPTQPQGLYASNVTSNSVELKWNPSTDNVGVKEYQVLRDGQLIQMVQGTTFTDQNLTANKEYKYAVKAVDAAGNTSIQSNILSVKTKDQNVSYEKWDSNKAYKKGDKVEHQGTVYEAVQNYQGNGDPNWIFALSLWKPLTIK

SEQ ID NO: 27085 - protein, 667 aa, Bacillus cereus BAG4X12-1
MIIKKHPFRTLAKTAVALTMIIPTSQAISQPFAYAQENITKSQQQVAPFWNKNKDYPGESYVTYEGKVYHSVYWVNAGTLPTQQFSGWELYTGSEYIPDNSDPNDLFGEGITWPTHVFAPYVDNGMNPQNLLKYAQETNTSFFTLSFIVADKNGNPVWGGSHTPIGDGNLDDQIKQIRKIGGDVKVSFGGANAGNISGLGADLAAAITDVNKLKDAYKSVINTLHLTHMDFDIEGVLVAHPESIERRSKAIALLQKELKAEGKDVKIGYTLPVMPYGLTNDGINVIQSAIKHDVDLNSINIMTMDYGQQNQQMGQAAIDAINSLHGQLTNLYKGTIKDSDIWKMIAVTPMIGKNDTQNETFTLNNAKELFQFAKEKGIGEISMWSVYRDKKATESWQIGQATGDASGLPDVDDGAFSKLFSAFNSSTEIDVIAPTAPSNLRSVSKTTTTVELQWEASTDNIGVKEYEVYRDGKKVGTTKTTRYEDAGLQANTKYNYTIKATDAAGNKSKSSNEVSVTTKEENPEQTAPTAPTGLQALETTTNSVHLIWEESISNVGIKEYEIYRNGTKIATSPSTYYTDENLLASTEYSYMVKAIDTQGKISVASNEIKITTKDTPSSEYKAWDSYAAYKKGDRVEHQGKIYEAIQSYQGYGDPNWIFSLALWKVIK

SEQ ID NO: 27086 - protein, 971 aa, Bacillus cereus BAG4X12-1
MKGYSKKMLVGVSFASLMLGSFQGVSLAEDTKGEQVSYRNVLKMEPVGVQLPVQELAHSSKVLESKSFEKRLQFADLSQRPPEVKKGSKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITEKTGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVKYRVNTSGQFEYDVVFHGINTEEGAENKAPVAVINGPYSGNVNEAILFTSDGSKDEDGKITSYKWEFGDGAVSNEQNPTHVYTKEGTYTTKLTVTDDKGATNTATATVTVQKKEDNSVEKEPNNSFQTANQLQLNQVLRASLGNGDTSDFFEFNVETAKNLQINVTNENNIGMNWVLYSEADLNNYVTYAQQQGNKLVGSYYTYPGKYYLHVYQYGGGTGNYTVEVK

SEQ ID NO: 27087 - protein, 370 aa, Bacillus cereus BAG4X12-1
MKTKQTIAASTLALAMIAGANSAHAEVNDATPQQSTGDRLAEIKQHKQELDAKLQQHKENVDQTLNELNKVKENVDTKVNELHERKQVADEKINEVKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAVLQEARQDLINKINEIKQSKQTVSDDLSKKKQDLDIKINDFKHTEKKIDDKLAELHTTKQNVDNKINEVSQSKQMQADNGTKNNNAKELPNAGSEQSNNMALGMLSVLGGVLLLTRNKIKTLFSK

SEQ ID NO: 27088 - protein, 172 aa, Bacillus cereus BAG4X12-1
MGKIFKFGCLGIIVLFVIGIIAMVAGGGDSTEKTSTDTKAVSKEGVSSDVKIAVGSMETVDSVGNEYTKEQAQGVFKILEVTLTNNQKDAITVDANSFKLVDNKGREFTYSTQGQTSFDLTNGGKTDFFLKQLNPGLTQTGKIVFDIPKDAEGLFLKASGGMTGKEINLKVE

SEQ ID NO: 27089 - protein, 732 aa, Bacillus cereus BAG4X12-1
MKKLKPTLSVVGSLTMALTLASPALAETSLPTEGSKVEVFKEDANAKEGKNPVYDTNDKIGKLMTENIDVQNNDWDNDGISNDLEKNGYKIEFNRKTGKNEALAWDPEKDKGKLKFISNPMSANSDGDPFTDMYEVENYNNNSDTDFNPIVANIPNLQIGLKRIEVIPIATITDNNGGSISRGWEKSVATQHSFNVGLTGTGGVEGSAAGPVPSGSVSVNVGYGYSKTTTETESYTNNFDWSTATTVDTAKAAKVRVHLEYKNVGTSSAENVSPHFNIRLGNKIINTVKATQDRYKANYLSTEKGGRNKTEVVIDSLEGQADVNIFLSLDELKAVEQGELLAIEVLPTSTMDVSIEKDGEFMNLGDSGKYESRVNATTEELETDIGNKPKFRVYTPKGSRGEYPALSYNEVFKHVNIDTNKVNNIVSKYTRNNSIEVVSSSNAASYGTTLENYKNNENVGLYTNNKHGAFENLQPPKLEESSYDPITKKIRATISPGLFGAKNEISASYETRQGSTQKVTLVRSGNGHIYESRENVPFGEFLPSNKVTFEVQDSQNKLPTNKISTVVKYNAEFNNYVVDNSGEFVVEGASYTIADNNADKYKRYWGSHHASNKWEYLQSELSSSEKVNLVIERVGQPKPGQPIKKDEEVLIKFANPIYSDYVYLKLQDGYIHLDQKRNASTFKFNSAFDGPTYYTLFKIQSNGNYIQREYDNNYMKYGTGNGNNIWNLTRAQ

SEQ ID NO: 27090 - protein, 458 aa, Bacillus cereus BAG4X12-1
MNLKLTPKFERLRKSKKGIGACVLAAGVTAITMIPQSAYAHGFVEKPSSRAALCSQNYGALNLNCGNIMYEPQSLEAPKGFPDGGPIDGKIASAGGLFGGILDQQTSNRWFKNTIKGGANTFTWKYTAAHPTSKWHYYITKKGWDPNKPLTRAELEPIGTVKHDGSAASNNITHTINVPTDRNGYHVILAVWDVSDTSNAFYNVIDVNLVNNETPDTVAPSQPTELNASKVTANSVALTWKASTDNIGVKEYQVLRNGEVIDTVPGTTFIDKKLKANTEYTYTIKALDSTGNISKESEELKVKTTNEIPDIEAPTQPKGLHSMSTTATTVDLMWSPSEDNVGVDHYIVYRESFGVMNKIGTTDNTSFMDKELKANTSYKYVVTAVDLAGNESSRSDVLNVITKSEDATYEKWDARKAYTKGDRVVHEGKVYEAVQDYQGNGDTNWIFSLSLWKPVLNK

SEQ ID NO: 27091 - protein, 72 aa, Bacillus cereus BAG4X12-1
MKRGQKRKAQNLVIVTAALSMFATGITPSLEIFAEEQAQQQKVYEAVQNHQGNGDSNWIFALSLWKPLILNL

SEQ ID NO: 27092 - protein, 431 aa, Bacillus cereus BAG4X12-1
MPTIIDVYAREVLDSRGNPTVEVEVYTESGAFGRAIVPSGASTGEHEAVELRDGDKSRYLGKGVINAVNNVNEIIAPEIEGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 27093 - protein, 970 aa, Bacillus cereus BAG4X12-1
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHANKNVEKAAKTIINAANNSGDTQDIYMNVIPAEKQKAELKGEFFETNLYTVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKPQTIEVKTGETGAVQIVNNKVKGNIEIKKLSDSGKILPNVEFTVFTEDGKEVKKVVTKENGIANVEDLTYGKYYFLETKTPNGYIGNKTKYPFEIKEHNKTLTFTVENTEVKGSVKLLKVDNEDISKKLEGAAFELKDANGKVVGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPNGYVLNEETFSFEIKENGQIIKHIVKDEKIPSIKTTATDKIDGTKEMHTSKSVTIQDKVEYKDLQVGKEYTLKGKLMNKETNKPLVVNGKEVTVETKFTPKEANGSITLDFTFDATGLEEKEVVVFEELLKDGKVVTTHADINDKGQTVKFVKPSVKTTATNKADGSKELDASKTVTIQDKVEYKDLIVGKEYVVKGKLMDKATNKPLLVDGKEVTVESKFTAKEKNGSITLDFTFNASALQGKEVVVFEELYQDNILVAIHAEIEDKGQTVKFKEGKSEQPKPEQPNSGKNTPTPEQPNEQVKEQPQLKKEIQSKIGWLPQTGTNLTSWISMAAGALLLIVGGVIFLKRKNA

SEQ ID NO: 27094 - protein, 136 aa, Bacillus cereus BAG4X12-1
PKEPEVKPEEPKEPKEPEVKPEEPKEPEVKPEEPKEPKEPEVKPEEPKEPEVKPEEPKEPKEPEVKPEEPKDLKKPEVKPEKPEVRLEKLIKEPQVKVEKELPKTGAAHSWMMSVGAGISFLVGGVLFVLGRRRKQ

SEQ ID NO: 27095 - protein, 893 aa, Bacillus cereus BAG4X12-1
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDIKFISEPEVKAVIFVDENHGQASNAYQVTFAATTPNYVSGTYLVNAHNGDILKDMVQESSLKISEEYVESVKENKTSNFTSLTGTGKDDLGVTRTFGISKQTSGNYALADYTRGQGIETYDVNYRDITNEESYYPGILATSASTTFNDPKAVSAHFLATKVYDFYKEKYNRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANTDELNMTSNFSELKLACLKVATNKYGTSSIEVQAVQNAFDAAKITGTVKENEKTAENQAPELTVPFTITLRVGDTFDPMRNVKAVDKEDGDLTNKVKHKGDVDTSKPGTYIVEYLVVDSQGRTTTATQTVIVEGNGEILNLEPKLTVPVGATIHVGDSFDPMIKVKAIDKEDGDLTSKVKIVGGVDTSKVGTYVLTYTVTDSKGHEVTAKQTVTVKVREEVTNEKPILKVPATTSITEGDQFDPLVGVSATDKEDGDLTSKIAYEGTIDTTKAGTYEIIYSVKDSMGNDVNTIQKVLVKDKETSKANGLANKANKSNISNNSNSDKKEYTYKELPKTGVSTTNSAAIGILMIITGTVLTFVRKFRKIQK

SEQ ID NO: 27096 - protein, 455 aa, Bacillus cereus BAG4X12-1
MNNRFLKQLQNMKMNKKSLGVVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVPGTHFIDKKLQPSTEYSYTVKAIDAAGNVSTESTALTVKTTVETPDTEAPTQPKGLHSMGTTASSVDLMWSPSDDNIGVDHYDIYRETEGSMKKIATSNTTSYLDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 27097 - protein, 333 aa, Bacillus cereus BAG4X12-1; identical to SEQ ID NO: 27053

SEQ ID NO: 27098 - protein, 878 aa, Bacillus cereus BAG4X12-1
MVKYSKISKWILGVGLVTITCNGLQIQAETKEKNVKNVLQMEPVGIQKSVDELAHPSKVQENESFTKRLKLADLSQRPLAPTDNIKPLAEEKKYSMAELNQLNNKQLTDLLVTIKWYQIPELFQFNSDSLKFYQDDSRMQAIINKLAEQGQAYTQDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKCPEMFDKVHDLIRANDVSSYDEYRATLSKDNKLNEEYQSYMQMLIDNRDKYTIPQVSDEYLTQHDPKSLSDVTSDITNEAKLKDVKVTKNKSQFFNTFTLQGTYTGSAAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 27099 - protein, 112 aa, Bacillus cereus BAG4X12-1
GGNGSGGNRSGSNGSGGSGSGGNGSGGNRSGGDGSGGSGSHGGNGSQGGNRVKGDSNSQEGNGSQGGNVKDNTKKQGDKLPNTATHYPISILMGLSTFLIGMLLFIRRKNVK

SEQ ID NO: 27100 - protein, 503 aa, Bacillus cereus BAG4X12-1; identical to SEQ ID NO: 26634

SEQ ID NO: 27101 - protein, 553 aa, Bacillus cereus BAG4X12-1; identical to SEQ ID NO: 26913

SEQ ID NO: 27102 - protein, 183 aa, Bacillus cereus BAG4X12-1; identical to SEQ ID NO: 26632

SEQ ID NO: 27103 - protein, 181 aa, Bacillus cereus BAG4X12-1
MNKKLLASLLCSTFLFGVSACSSHDAPAKNEQATSKKTENDKLSSKDSQKELPTNVDSSDVYMSMGSAESLDVIGTGEVKAQGVFKVLDIAVYNRKEEPITLDINNFKLIDGFGREYHISNEYQSVLKAANTSTFKFGIVNPDEHSDGNIVFDVPKNTRGLTLKFNNDKLDKELQLKVELE

SEQ ID NO: 27104 - protein, 965 aa, Bacillus cereus BAG4X12-1
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHAPKSLTEVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSAEVNPVHVYEREGSYKVSLRVKDDKGKESRSETTVTIKDGSLTESEPNNRLEEANRIGLNSTIKGSLIGRDHTDVYTFNVASAKDIDISVLNEYGIGMTWVLHHESDMQNYAAYGQANGNHIEAKFNAKPGKYYLYVYKYDNGDGTYKLSVK

SEQ ID NO: 27105 - protein, 163 aa, Bacillus cereus BAG4X12-1
MLKKVSQIVLIFGIAFSLSACTETKDSNESKQEDVQDKVYKIGETVDVDGLQVTIDSVKLGYPDYDEDKKKEEILGIIFKVENNSKKEIPFAFYEFEITDKKGTRFKEYNNPDSFISKKLAPEEKIQDIMLFDVAKENTYIATYRPEFTRENRTIKFELKPNK

SEQ ID NO: 27106 - protein, 965 aa, Bacillus cereus BAG4X2-1; identical to SEQ ID NO: 26880

SEQ ID NO: 27107 - protein, 78 aa, Bacillus cereus BAG4X2-1
GNGSGGSGSGSNDSGGNGSGGNRVKGDSSSQGGNVKDNATKQGDKLPNTAAHYPASILIGLSTFLIGMLLFIRRKNAK

SEQ ID NO: 27108 - protein, 738 aa, Bacillus cereus BAG4X2-1; identical to SEQ ID NO: 26889

SEQ ID NO: 27109 - protein, 884 aa, Bacillus cereus BAG4X2-1
MKNKKEIAIVALTTGLALTAVAPYGIGHAEETDQLQVQMQEESFRSGELTQPSQKTPENVVKDALKEKTEQALSPKQVNGETGVDYKVFQKRGSYDGTTLVRMQQTYEGKEVYGHQLTAHVDNKGVIKSVSGDSAQNLKQEDLKKPIKLSKEEAKQYIYTKYGSNIKFISEPEVKEVIFVDENNGQASNAYQVTFAAATPSYVSGTYLVNADNGEMLKNMVQESGLKVSEEHVEPLKESKKNNFVSLTGTGKDDLGITRTFGISEQSNGKYALADYTRGQGIETYDVNYRDITNEEKYYPGILVTSTSPTFTDPKAVSAHFLATKVYDFYKDKYKRNSFDNKGKKVVSVVHAWDSGGTNNPKNWENAFSANINNISMLIYGDPMVKSFDIVGHEFTHAVTSSESNLEFFGESGAINEALSDIMGTAIEKYINNGKFNWTTGEQTGSVFRNMKNPSSINYSNGVPYPDDYSKYNDLNGEDNGGIHFNSSIINKVAYLIAQGGTHNGVTVNGIGEDKMFDIFYYANTDELNMTSNFSELRLACLKVATNKYGANSIEVQAVQKAFDAAKIKGTVKENEKTAENQVPELTVPSTITLRVGDTFDPMRNVTAADKEDGDLTNRVQHKGDVDTSKPGKYIVNYLVVDSQGGNATDTQTVIVEKNEEILDIEPKLTAPIGVTINVGDSFVPMTEVLAIDKEDGDLTSKVKVDGKVDTSKAGTYVLTYTVTDSKGHEVTAKQTVTVKVREEVKNDNPILKVPATTTINENDQFDPMVGVSATNKKNDDLTSKVKVDGKVDTSKADTYEIIYSVRDSVGNEVKAIQKVLVKDKDTSKANGLASNSNYDKKEYTYKELPKTGASTTNSAIMGMLMVIAATVLTLVRKCRKIQK

SEQ ID NO: 27110 - protein, 971 aa, Bacillus cereus BAG4X2-1
MKGYSKKVLVGVSFASLLLGSFQGSISAENTKEEQVSYRNVLKMEPVGVQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLKQQGQTYTQDDSKGIETLVEVLRSGFYLGFYNTELSKLNERSYHDKCLPALKTIASNPNFKLGTLEQNRVVSSYGKLIGNASSDVETITSAAKIFKQYNDSFSTLVDNLSAGNAIYDIMQGVDYDIQSYLYDTRKVPKDTVWYQKIDSYINELSRFALMGTITAKNGWLINNGIYYTGRLGTFHSTGTKGLQVVTDAMNIYPYLGEQYFVAAEQIATNYGGKDANGNMVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDTNLNKEYQDYMQMLVDNRDKYNVPLVSEDYLATHASKPVSDIAAEITAEANVKNVSVKKNKSQFFNTFTLQGTYTGTAAKGEYEDWKTITQKVNDTLKRLSTKEWTGYKTVTAYFVNYRVNASGQFEYDVVFHGMNTEEGAVNKAPVAVINGPYSGNVNEAISFKSDGSKDEDGKIASYKWEFGDGTVSNEQNSTHIYTKEGTYTAKLTVTDDKGATNTATTSVTVKKKEDNSVEKEPNNSFQTANKLQLNQILRASLGNGDTSDFFEINVETAKNLQINVTKENNIGVNWVLYSEADLNNYVTYAQQQGNQLVGSYYTYPGKYYLHVYQYGGGTGNYTVEVK

SEQ ID NO: 27111 - protein, 213 aa, Bacillus cereus BAG4X2-1; identical to SEQ ID NO: 26884

SEQ ID NO: 27112 - protein, 723 aa, Bacillus cereus BAG4X2-1; identical to SEQ ID NO: 26883

SEQ ID NO: 27113 - protein, 162 aa, Bacillus cereus BAG4X2-1; identical to SEQ ID NO: 26879

SEQ ID NO: 27114 - protein, 502 aa, Bacillus cereus BAG4X2-1; identical to SEQ ID NO: 26882

SEQ ID NO: 27115 - protein, 553 aa, Bacillus cereus BAG4X2-1
MKKILSVLLVVFLTFSAWSNELVKAASPTKGSLTIHKYEQEKEGTTGVEGDGSTNQEVPTNVKPLKGVTFEVKKVASFEKISNDGKIVKEDVKPVTGATPSQVVTDDNGQAVLKDLPLGRYEVKEVAGPPHVNLNPNTYTVDIPLTNKEGKVLNYDVHMYPKNEIKRGAVDLIKTGANDKALAGAAFSVFKKDGTEVKKDLVTDANGHIRVQGLEFGEYYFQETKAPKGYVIDPTKREFFIKNSGTINEDGTITSGTVVKVELKNYEEPTIDKKINGNLEALPINPLTNYNYDIKTLIPEDIKEYKKYVVTDTLDNRLVMQGKPIVKIDGAEVNASVVDVAVEGQKVTATVKDFTKLDGKKEFHLQIKSQVKEGVPSSSEILNIAKIDFTNKNDVIGEKESKSVVVVPTTGIIELSKIDGDNKKKLKGAEFVLKDKNGKIVVVAGKEVIGVSDENGVIKWSNIPYGDYQIFETKAPTYTKEDGKTASYQLLKDPIDVKVSENNQTVKLTIENNKSGWILPVTGGIGTTLFTVLGLTLMVTAAFVFFRKKFANK

SEQ ID NO: 27116 - protein, 55 aa, Bacillus cereus BAG4X2-1
METEKYLQVVEDEELEQLVGGAGPGWVETLTKDCPWKQPGACVIIMGQKICKKCY

SEQ ID NO: 27117 - protein, 333 aa, Bacillus cereus BAG4X2-1; identical to SEQ ID NO: 26881

SEQ ID NO: 27118 - protein, 370 aa, Bacillus cereus BAG4X2-1
MKTKQTIAASTLALAMIAGANSAHAEVTDATPQQNTGDRLAEIKQHKQELDAKLQQHKENVDQTLNELNKVKENVDTKVNELHERKQVADEKINEMKQHKQELDAKLQQDKQIAEDKINEIKEHKKQVDDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQKARQDLLNKINEIKQAKQTVSDDLTKKKQDLDIKINDFKHTEKKIDDKLAEVHTTKQNVDNKINEISQSKQTQADNSTKNNNARELPNAGSEQSNNMALGMLSVLGSVLLVTRNKIKTLFSK

SEQ ID NO: 27119 - protein, 878 aa, Bacillus cereus BAG4X2-1
MVKYSKISKWILGVGLVTITCNGLQIQAETKEKNVKKVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTMWYRNIDNFINEVSRFALIGTVTDKNGWLINNGIYYAGRLGKLHSTPTKGQQVVTDAMRIYPYLGEQYFVAAEQITTNYGGVDANGKTINLDQIRDDGKKKYLPKTYTFDDGAIVFKAGDKVSEEKIKRLYWAAKEVRSQFYRTVGSDKPLENGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGSTRLNSVVPRKSIIGGLSNDPAKRYTASQTLNAKYGTWDFYNYSFALQSYMYNKRPEMFDKVHDLIRANDVSSYDAYRSALSKDNNLNEEYQSYMQMLIDNRDKYTIPQVSDEYLAQHDPKSLSDITSDITNEAKLKDVKVTKNKSQFFNTFTLQGTYTGSSAKGEIEDWKVMNEATNDMLKRISGKEWTGYKTLTAYFINYRVNHAGQFEYDVVFSGVNTEEGTAVEKEPNNSFETANPLFLNTLLRGNLSDQDKGDKFVIDVKDQKDLQISVTNEQNIGLNWVLYSESDLNNYVTYATKRDGNKLLGNYNAKPGKYYLSVYKYGGGTGNYTVEVK

SEQ ID NO: 27120 - protein, 458 aa, Bacillus cereus BAG4X2-1; identical to SEQ ID NO: 26890

SEQ ID NO: 27121 - protein, 455 aa, Bacillus cereus BAG4X2-1; identical to SEQ ID NO: 26887

SEQ ID NO: 27122 - protein, 431 aa, Bacillus cereus BAG4X2-1; identical to SEQ ID NO: 26893

SEQ ID NO: 27123 - protein, 122 aa, Bacillus cereus BAG4X2-1
EVTDPKGEVTDPKGEVTDPKGEVTDPKGEVTEPKGEVTEPKGEVTEPKGEVTDPKSEVTDPKGEGIDRVNSQITKNNALNKQIVKKEQILPATGHDTNWLSVFGGGLMLIGAYLYRRLKRVN

SEQ ID NO: 27124 - protein, 370 aa, Bacillus cereus BAG5O-1
MKTKQTIAASTLALAMIAGVNSAHAEVNDTTPQQNTGDRLAEIKQHRQELDAKLQQHKENVDQTLNELNQVKENVDTKVNELHERKQVADEKINEMKQHKQELDAKLQQDKQIVDEKINEIKEHKKQVADKVAEVKEHKQNIDNKVNEIKEHKQTVDEKVNEIKEHKENIDQKVNELKEVKKQVDEKLAELKKAKQTAEDKLAELKENKPNTGNTLEELKKIKGNLDSLSANLELAKQDVKNKLAELQKARQDLLNKINEIKQAKQTVSDDLTKKKQDLDIKINDFKHTEKKIDDKLAEVHTTKQNVDNKINEISQSKQTQADNSAKNNNARELPNAGSEQSNNMALGMLSVLGSVLLVTRNKIKTLFSK

SEQ ID NO: 27125 - protein, 455 aa, Bacillus cereus BAG5O-1; identical to SEQ ID NO: 26887

SEQ ID NO: 27126 - protein, 162 aa, Bacillus cereus BAG5O-1; identical to SEQ ID NO: 26879

SEQ ID NO: 27127 - protein, 971 aa, Bacillus cereus BAG5O-1
MKGYSKKVLVGVSFASLLLGSFQGSISAENTKEEQVSYRNVLKMEPVGVQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLKQQGQTYTQDDSKGIETLVEVLRSGFYLGFYNTELSKLNERSYHDKCLPALKTIASNPNFKLGTLEENRVVSSYGKLIGNASSDVETITSAAKIFKQYNDSFSTLVDNLSAGNAIYDIMQGVDYDIQSYLYDTRKVPKDTVWYQKIDSYINELSRFALMGTITAKNGWLINNGIYYTGRLGTFHSTGTKGLQVVTDAMNIYPYLGEQYFVAAEQIATNYGGKDANGNMVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDTNLNKEYQDYMQMLVDNRDKYNVPLVSEDYLATHASKPVSDIAAEITAEANVKNVSVKKNKSQFFNTFTLQGTYTGTAAKGEYEDWKTITQKVNDTLKRLSTKEWTGYKTVTAYFVNYRVNASGQFEYDVVFHGMNTEEGAVNKAPVAVINGPYSGNVNEAISFKSDGSKDEDGKIASYKWEFGDGTVSNEQNSTHIYTKEGTYTAKLTVTDDKGATNTATTSVTVKKKEDNSVEKEPNNSFQTANKLQLNQILRASLGNGDTSDFFEINVETAKNLQINVTKENNIGVNWVLYSEADLNNYVTYAQQQGNQLVGSYYTYPGKYYLHVYQYGGGTGNYTVEVK

SEQ ID NO: 27128 - protein, 502 aa, Bacillus cereus BAG5O-1; identical to SEQ ID NO: 26882

SEQ ID NO: 27129 - protein, 213 aa, Bacillus cereus BAG5O-1; identical to SEQ ID NO: 26884

SEQ ID NO: 27130 - protein, 431 aa, Bacillus cereus BAG5O-1
MSTIIDVYAREVLDSRGNPTVEVEVYTESGAFGRAIVPSGASTGEHEAVELRDGDKSRYLGKGVINAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGVKSFYNIKR

SEQ ID NO: 27131 - protein, 333 aa, Bacillus cereus BAG5O-1; identical to SEQ ID NO: 26881

SEQ ID NO: 27132 - protein, 721 aa, Bacillus cereus BAG5O-1
MGKSTTKSKKLVGFVATATLATSMIAGASNASAQTTDTLKTAEPVQEKAKDKKEERPESLFPSMDINYDTTIYVGDPFDPMAEVSAYDSKDGDITDKINIVGEVNPFEPGGYNLDYTVTNSRGFSVIKQVHVWVKRGEKPILRLPYRVSINVGDKFDPMTGVSAIDEKDGDITSKIKVDGNVDTSKPGTYEVTYTITNSKGLTIVRKQPVKVKETEGTKNEAPVLTVPFTTTLHVGEEFDPMAGVSATDKEDGNLTNKVKYKGNVDTSKPGKYIVEYWVVDSKGVNATATRSVIVKENEEIPDMEPKLTAPTKTTINVGDKFDPMAGVSATDKEDGDITSKVTVDGSVDTSKPGTYELTYTVLDSKGHTVIAKQTVTVKQKVETTNEAPVLTVPFTTTLRVGEKFDPMAGVSASDKEDGNLTNKIKYKGNVDTSKPGKYIVEYWVVDSKGVNATATQSVIVKENEETPDMEPKLTVPTRTTINVGDKFNPLSGVKAIDNEDGDITDKVTVDGSVDASKPGTYELTYTVKDSKGHTVTAKQTVTVKQKVESKDEDPVLTVPTEVTLHVGDKYNPLSGVKAIDKEDGDITDKVIHLGEVDTSRAGNFEVKFLVRDASGNEVTATQKVTVKDTDTENGSDNSNNNTNSGEGPDNTTTTTTTTTTGNVSDNNNNNTSSNLDNKKDTIKELPKTGANSNNGTAVGILAILAGMLITFGRKFKKAIK

SEQ ID NO: 27133 - protein, 965 aa, Bacillus cereus BAG5O-1; identical to SEQ ID NO: 26880

SEQ ID NO: 27134 - protein, 878 aa, Bacillus cereus BAG5O-1
MVKYSKISKWILGVGLVTITCNGLQIQAETKEKNVKKVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTMWYRNIDNFINEVSRFALIGTVTDKNGWLINNGIYYAGRLGKLHSTPTKGQQVVTDAMRIYPYLGEQYFVAAEQITTNYGGVDANGKTINLDQIRDDGKKKYLPKTYTFDDGAIVFKAGDKVSEEKIKRLYWAAKEVRSQFYRTVGSDKPLENGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGSTRLNSVVPRKSIIGGLSNDPAKRYTASQTLNAKYGTWDFYNYSFALQSYMYNKRPEMFDKVHDLIRANDVSSYDAYRSALSKDNNLNEEYQSYMQMLIDNRDKYTIPQVSDEYLAQHDPKSLSDITSDITNEAKLKDVKVTKNKSQFFNTFTLQGTYTGSSAKGEIEDWKVMNEATNDMLKRISGKEWTGYKTLTAYFINYRVNHAGQFEYDVVFSGVNTEEGTAVEKEPNNSFETANPLFLNTLLRGNLSDQDQGDKFVIDVKDQKDLQISVTNEQNIGLNWVLYSESDLNNYVTYATKRDGNKLLGNYNAKPGKYYLSVYKYGGGTGNYTVEVK

SEQ ID NO: 27135 - protein, 738 aa, Bacillus cereus BAG5O-1; identical to SEQ ID NO: 26889

SEQ ID NO: 27136 - protein, 890 aa, Bacillus cereus BAG5O-1
MKNKKEIAIVALTTGLALTAVAPYGIGHAEETDQLQVQMQEESFRSGELTQPSQKAPENVVKDVLKEKTEQALSPKQVNGETGVDYKVLQKRGSYDGTTLVRMQQTYEEKEVYGHQLTAHVDNKGVIKSVSGDSAQNLKQEELKKPIKLSKEKAKQYIYTKYGNDIKFISEPEVKEVIFVDENNGQASNAYQVTFTAATPSYVSGTYLVNADNGEMLKNMVQESGLKVSEEYVEPLKESRKNNFVSLTGTGKDDLGITRTFGISEQSNGKYSLADYTRGQGIETYDVNYRDITNEEKYYPGILVTSTSPTFTDPKAVSAHFLATKVYDFYKDKYKRNSFDNKGKKVVSVVHAWDSGGTNNPKNWENAFSANINNISMLIYGDPMVKAFDIVGHEFTHAVTSSESNLEFFGESGAINEALSDIMGTAIEKYINNGEFNWTTGEQTGSVFRNMKNPSSINYSNGVPYPDDYSKYNDLNGEDNGGIHFNSSIINKVAYLIAQGGTHNGVTVNGIGEDKMFDIFYYANTDELNMTSNFSELRLACLKVATNKYGANSIEVQAVQKAFDAAKIKGAVTENEKTAENQVPELTVPSTITLHVGDTFDPMRNVTAADKEDGNLTTRVQHKGDVDTSKPGKYIVDYLVVDSQGGNATATQTVIVEENGEILDIEPKLTVPVGVTINVGDSFVPMTEVLAIDKEDGDLTSKVKVDGKVDTSKAGTYVLTYTVTDSKGHEVTAKQTVTVKVREEVKNEKPILKVPATTTINENDQFDPMVGVSATNKKNDDLSSKVKVDGKVDTSKADTYEIIYSVRDSVGNEVKAIQKVLVKDKDTSKANGLANNSNISNNSNSDKKEYTYKELPKTGASTTNSAVMGMLMVIAGTVLTLIRKFRKTHK

SEQ ID NO: 27137 - protein, 458 aa, Bacillus cereus BAG5O-1
MNLKLISKLERLRKSKKGIGAFVLAAGVTAITMVPQSAYAHGFVEKPSSRAALCSQNYGALNLNCGNVKYEPQSLEAPKGFPDGGPIDGKIASAGGLFGGTLDQQTSSRWFKNTIKGGANTFTWKYTAAHSTSKWHYYITKKGWDPNKPLTRAELEPIGTVKHDGSAASNNLTHTINVPTDRNGYHVILAVWDVADTSNAFYNVIDVNLVNNETPDTVAPSQPTGLNASKVAANSVEITWKASTDNIGVKEYQVLRNGEVIDTVPGTTFIDKKLKADTEYTYTIKALDTAGNISKESEKLKVKTTNETPDIEAPTQPKGLHSMGTTATTVDLMWSPSEDNVGVDHYIVYRESAGVMNKIGTADNTSFMDKNLKANTSYKYVVTAVDLAGNESSRSDVLNVTTKSEDSTYEKWDARKAYTKGDRVVYEGKVYEAVQDHQGNGDSNWIFALSLWKPVMNK

SEQ ID NO: 27138 - protein, 553 aa, Bacillus cereus BAG5O-1
MKKILSVLLVVFLTFSAWSNELVKAASPTKGSLTIHKYEQEKEGTTGVEGDGSTNQEVPTNVKPLKGVTFEVKKVASFEKISNDGKIVKEDVKPVTGATPSQVVTDDNGQAVLKDLPLGRYEVKEVAGPPHVNLNPNTYTVDIPLTNKEGKVLNYDVHMYPKNEIKRGAVDLIKTGANDKALAGAAFSVFKKDGTEVKKDLVTDANGHIRVQGLEYGEYYFQETKAPKGYVIDPTKREFFIKNSGTINEDGTITSGTVVKVELKNYEEPTIDKKINGNLEALPINPLTNYNYDIKTLIPEDIKEYKKYVVTDTLDNRLVMQGKPIVKIDGAEVNASVVDVAVEGQKVTATVKDFTKLDGKKEFHLQIKSQVKEGVPSSSEILNIAKIDFTNKNDVIGEKESKSVVVVPTTGIIELSKIDGDNKKKLKGAEFVLKDKNGKIVVVAGKEVIGVSDENGVIKWSNIPYGDYQIFETKAPTYTKEDGKTASYQLLKDPIDVKVSENNQTVKLTIENNKSGWILPVTGGIGTTLFTVLGLTLMVTAAFVFFRKKFANK

SEQ ID NO: 27139 - protein, 1051 aa, Bacillus cereus BAG5X1-1
MELIEKERMIYMKKRNNFMFQKPMKVLAASAILATTLFTPTITNSLTVQAETVAAQTTNQYEQRGFELPGTGSFSSEAKRERRSEQKSYMPTGIYVKPNEQVTIEVSGTQKIRAIIGTHQYDKEWGKEVNLSPGSNTISSPNGGLLGFDNPQDTGTVKVKVTQGGSPVPFFELGKHTKEDWIAMMNKYPDAHAVQLKSEKAVLTVTRDSAQKYIVDQDPVPLLEKYDEMIRAQDKISGLSETDPNPLHRSTRRIWAFVENPNKPDWGMYASLDGAVFTTAGNAIESALDVNKFGWGQMHEAGHARQQSPWTWSDFRGMGEVTVNLYSLAAQKRLFPNQPTRLEKNKDYEKAFTYLKQTDKEYKNIDDLFVKLVMIWQLQLAYGEDFYPNLHKLYRESPEDLLPKTDEDKIQAFIYNTSKVAKQNLLPFFDQWGLKASQETRQKIEALNYPILTAPIWEATDSKPVIVEENEETPNMEPKLTVPVGATMNVGDSFDPMSGVSATDKEEGDLTSKVTVDGKVDTTKPGTYVLTYTVKDSKGHKVTAKQTVTVKEKEETKDEAPVLKVPSETTITEGDKFDPMKDVSATDKEDGDITSEVKYEGNVDTNTPGTYTITYTVKDSAGHLATQTQTITVKEKPAEDKEPELTVPEETVLTVGDQFDPMSGVKAIDKEDGDLTSKVTYSGDQGTDKEGTYKIKYVVEDSKGHRVIKLRTVIVNAAEKPSEDQAPVLKVLFTTTLHVGDTFDPMSGVSATDKEDGNLTSKVKYKGNVDTTKPGKYIVEYSVVDSKGVNATATQTVIVEESGETPDMEPKLTVPVGATMNVGDSFDPMSGVSATDKEDGDLTSKVTVDGKVDTTKPGTYVLTYTVKDSAGHLGTQTQTVTVKEKEKPVEIQGPELTVPSETTVTVGDKFDPMSGVKAIDKEDGDITDKVIQFGEVDTSKTGTYEVKFLVRDSGGNEVTTIQKVVVKDKDNGNNNTNNGNGADNGSTGTKNSNGSDTGNSNISINSTSDKKEDTYKELPKTGASTNNSAALGILMVLAGMVIIFGRKFKRY

SEQ ID NO: 27140 - protein, 875 aa, Bacillus cereus BAG5X1-1
MVKYSKISKLILGVGLVTISCNGLQIQAETKEKNVLQMEPIGIQKSVDELAHSSKVQENASFSKRLKLTDLSQRPLAPNENVKQLAEEKKYSMAELNQLSNKQLTDLLVTIKWYQIPELFQFNSDSLKFYQDDSRMQAIIDKLAEQGQAYAKDDSKGIETLVETLRAAFYLGFYHDELSKLNERSYHDKCLPALKTIAKNPNFKLGTPEQNQVISSYGMLIGNASADVEVVQYAGEIFKQYNDNVATFVEDYTKGNAVYELMKGIDYDIQAYMYNTGKEAKDTMWYRNIDGLINEISRFALIGTVTDKNGWLINNGIYYAGRLGKLHSTPTKGQQVVTDAMRIYPYLGEQYFVAAEQITTNYGGVDATGKTINLDQIREDGKKKYLPKTYTFDDGAIVFKAGDKVSEEKIKRLYWAAKEVRSQFYRTVGSDKPLESGHTDDVLTMVIYNSPDEYQFNRQLYGYETNNGGIYIEGSGTFFTYERTPEQSIYSLEELFRHEFTHYLQGRYEVPGLWGQGEMYQNERLTWFEEGNAEFFAGSTRLDSVVPRKSIIGGLSYDPAKRYTAAQTLNAKYGTWDFYNYSFALQSYMYNNRPEMFDKVHDLIRANDVANYDAYRSALSKDNKLNEDYQSYMQMLIDNRDKYTIPQVSDEYLAQHAPKPLSDVASDITNEAELNNVKVTKNKSQFFNTFTLQGTYTGSAAKGEIEDWKVMNQATNDMLKNLSERGWSGYKTLTAYFVNYRVNDAGQFEYDVVFSGVNTEEGTAVEKEPNDSFGTANLLSLNTLLRGDLSDQDQVDRFVIDVKDPKDLQITVTNEQNLGMNWVLYSESDLNNYVTYATKRDGNKLLGNYNAKPGKYYLSVYKYGGGAGNYTVEVK

SEQ ID NO: 27141 - protein, 162 aa, Bacillus cereus BAG5X1-1
MLKKVSRIVLICGMAFSLSACTETKNSDESKQEDVQDKVYKIGETVDVDGLQVTLDSVQLGYPDYTTDKKKDDILGIVFTVKNNSKKEIPFAFYEFEITDKKGTKFKEYKYDSFTSKKVAPDGKIQDVMLFDVTKENTYIATYRPEFTHENRTIKFELKPNK

SEQ ID NO: 27142 - protein, 333 aa, Bacillus cereus BAG5X1-1
MKGKLLKGVLSFGIGLGALYSGSSAQAEMSTNQNDTLKVMTHNVYMLSTNLYPNWGQNERADLIGAADYMKNQDVVILNEVFDNSASNRLLGNLKKEYPNQTAVLGRSSGSEWDKTLGNYSSSTPEDGGVAIVSKWPIVEKIQYVFEKGCGPDNLSNKGFVYTKVKKNDRFVHVIGTHLQAEDSMCGKTSPASVRTKQLQEIQEFIKNKNIPNNDYVLIGGDMNVNKINAENNSDSEYASMFKTLHASIPSYTGHTATWDATTNSIAKYNFPDSPAEYLDYIITSKDHANPSYIENKVLQSKSPQWTVTSWLKKYTYNDYSDHYPVEATISMK

SEQ ID NO: 27143 - protein, 182 aa, Bacillus cereus BAG5X1-1
MNKKLLTSLLCSTFLFGLSACSSHDTSSNNTKNEQETSKETKDDELSNKDPQKELPTRGDSAGVYISIGSVDSLDVIGNGEIKAQGVFKVLDVRVHNGHEEPITLNSNNFKLIDGTGREYHISNESQLVLKAANTATFKFGVLNPSENLEGNIVFDVPKKTQGLTLKINGDMLDKGIELKVE

SEQ ID NO: 27144 - protein, 878 aa, Bacillus cereus BAG5X1-1
MVKYSKISKLILGVGLVTISCNGLQIQAETKEKNVKNVLQMEPVGIQKSVDELAHSSKVQENASFTKRLKLSDLSQRPLAPNEDVKPLAEEKKYSMAELNQLSNKQLTDLLVTINWYQIPELFQFNSDSLKFYQDDSRMQAIINKLAEQGQAYTKDDSKGIETLVEALRAAFYLGFYHDELSKLNERSYQDKCLPALKTIAKNPNFKLGTSEQNKVISSYGKLIGNASADVETVLYAGEIFKQYNDNLATFIEDRTKGDAIYELMKGIDFDIQTDMYTTGKEPKDTMWYRNIDNFINEVSRFALIGTVSDKNGWLINNGIYYAGRLGKLHSTPTKGQQVVTDAMRIYPFLGEQYFVAAEQITTNYGGLDANGKTVNLDQIREEGKKKYLPKTYTFDDGAIVFKAGDKVSEEKIKRLYWAAKEVRSQFYRTVGSDKPLESGHVDDVLTMVIYNSPDEYQFNRQLYGYETNNGGMYIEGTGTFFTYERTPQQSIYSLEELFRHEFTHYLQGRYEVQGLWGQGEMYQNERLTWFEEGNAEFFAGSTRLDSVVPRKSIIGGLSNDPAKRYTAAQTLNAKYGTFDFYNYSFALQSYMYNNRPEMFDKVHDLIRANDVSSYDAYRSTLSKDNKLNEEYQSYMQMLIDNRDKYTIPQVSDEYLAQHDPKSLSDVTSDITNEAKLKDVKVTKNKSQFFNTFTLQGTYTGSAAKGEIEDWKVMNQATNDMLKRLSGKAWTGYKTLTAYFVNYRVNNAGQFEYDVVFSGLNTEEGTAVEKEPNNSFDTANPLSLNILLRGNLSDQDQGDKFVIDVKDQKDLQISVTNEQNLGLNWVLYSESDLNNYVAYATKRDGNKLLGNYNAKPGKYYLSVYKYGSGTGNYTVQVK

SEQ ID NO: 27145 - protein, 971 aa, Bacillus cereus BAG5X1-1
MKGYSKKVLVGVSFASLMLSSFPGTILAEDTKEEQVSYRNVLKMEPVGVQLPVQELAHSSKVLENKSFEKRLQFADLSQRPPEVQKESKQLAAAKTYTIAELNQLSNQALVDLLVTIDWEQITGLFQFNKDSLAFYQNDSRMQAIIDKLKQQGQAYTKDDSKGIETLVEVLRSGFYLGFYHTELSKLNERSYHDKCLPALKSISQNPNFKLGTLEQNKVVSSYGKLIGNASSDAETISSVANIFKQYNDNLSTFIDNRSAGNAVYDIMQGVDYDIQSYLYDTNKAPKDTMWYQKIDSYINELSRFALIGTVTAKNGWLINNGIYYTGRLGTFHSTGTKGLQVVTDAMKVYPYLGEQYFVAAEQITTNYGGKDANGNVVDLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGIYIEGTGTFFTYERTPQESIYSLEELFRHEFTHYLQGRYEVPGLWGQGKLYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSALSKDANLNKEYQDYMQMLVDNREKYNIPLVSDDYLATHAPKPVSDIAAEITAEAKLSNVSVKKNKSQFFNTFTLQGTHTGTAAKGENEDWKTITQNVNDTLKRLSAKEWTGYKTVTAYFVNYRVNASGQFEYDVVFHGINTEEGAVNKAPVAVINGPYSGNVNEAISFKSDGSKDEDGKITSYKWEFGDGTVSSEKNPTHVYTKEGTYTAKLTVTDDKGAANTNTTSVTVQKKEDNSVEKESNNTFKTANKLQLNQLLRASLGNGDTSDYFEINVETAKNLQINVTKENNIGVNWVLYSEADLNNYVTYAQQQGNKLVGSYYTHPGKYYLHVYQYGGGTGNYTVEVK

SEQ ID NO: 27146 - protein, 120 aa, Bacillus cereus BAG5X1-1
PTGDGNNGENPTTPPTGDGNNGENPTTPPTGDGNNGENPTTPPTDEGNNGNEPKQDGNNAGSGQTTTDNQNTKETTTVSENKEERDLPKTGASVASTIGAGLAFVGAGLLMLFRKKKANR

SEQ ID NO: 27147 - protein, 431 aa, Bacillus cereus BAG5X1-1
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYAGLQSFYNIKR

SEQ ID NO: 27148 - protein, 1093 aa, Bacillus cereus BAG5X1-1
MGKRVILRVFTLLSVLALFLNVFLPRASAEVMTHEKYSMDWSYSNSLGKHIRTEIIKNSSGQIAYCLTLGLKSPNGEDLPEMGKTDNVVYRVLLNGFPQKSIEQLGVANKNEAHYATQLAVWNALGQLDVNELKHENKNVEKAAKSIINAANTSEDTQDIFMNVIPAEKQKAELKGEFFETNLYTVQTNAKSGSYKVVAKNAPNGVKIVSENGEVKDQLSVGEKFRIQIPKDTKTGEFNLSVAANLTKVQAIAYRGTDTVQNATVLLERNEEKLSSDLAVNWEAAGSLKIKKVGENGEVLAGAVFEVFNANNESVGKITTDADGTAALNNLPIGTYTVKEIKAPTGYVSGDKPQTIEVKTGEIGAVQVVNNKVKGNIEIKKLSDSGKVLPNVEFTVFTEDGKEVKKVVTKENGIANVDGLTYGKYYFLETKTPNGYIGNKTKYPFEIKEHNKTLTFTVENTEVKGSVKLLKVDNEDISKKLEGAVFELKDESGKVIGEYKTDKNGEVNVKDLAYGKYSFVEKTSPNGYVLVKEPIVFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTLKGKLMDKETNKPLVVNGKEVTAETKFTPKEANGSITLDFTFDATGLEEKEVVVFEELLKDGKVVTTHSDINDKGQTVKFVKPSVKTTATNKADGGKEIHANDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDATKSVTIQDKVEYKDLIVGKEYVVKGKLMDKATNKPLLVDGKEVTAESKFTAKEKNGSITLDFTFNASALQGKEVVVFEELYQDNVLVAIHVDIEDKGQTVKFKEVKPEQPKPEQPNPDKNTPTSEQPKEQVKEQPQPKKEIQSKIGWLPQTGTNLTSWISMAAGALLLIVGGVIFLKRKNA

SEQ ID NO: 27149 - protein, 738 aa, Bacillus cereus BAG5X1-1
MKKLKPALSVLGSVSMALTLASPALADVKQPNPGSTVEIFKENVNAKKEDKNFTLGSDGEIGSLITQNIEMANNDWDKDGISNDLEINGYKIEFNSQTGKNEAKAWDPEKDKEKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAEVRVHLEYKNVGTASAENVSPHFNIRLGNKIINTVKATQDRYKANYLSTEKGGRNKTEVVIDSLEGQADANIVLSLDELKAVEQGEILSIEVLPTSTMDLSIEKGEEVMHLGDSGRYESRVNAATEQLETDMGNIPKFRLYTPKDKSLADKPVLSYNEVFQHINIDTNKVKHIVNKAKSNNQVSVVSDNNGTDALNALKAGQGDRGYLHKDSVHGAFAKLQQPTLVEGSYDPITQKIRASILPGLFGVSNEISATYRTKWSGPSKTVTLAKRENGYTYESRENIHPIKSEIAADRKVRFQINDAHNLTPTQNIDAEIKANKEFEDYVVDNSGEFVTEGVPYTVSSYGNTAYWGSHHAGNKWEYLWAEKSNDEKVNVIIERVGQPKPGKPIKKDEEVLIKFQNPIYSDYAYLKLQDSYIHLDQKQNASTFKFNHAYPKNFTGHHKQWNILSNGNKLKVEYLIDYMKYGNGENGTDTIAWNLSRAQ

SEQ ID NO: 27150 - protein, 103 aa, Bacillus cereus BAG5X1-1
EETTKELTEEKPEEPKVTEEPNVLEKPEVKEKPEVSNKQEVQDKVEVQNKQEVPSSKENNKQSKLLPQTGGTSTESTSLIAAMFALIFGAMLFRRKKINERES

SEQ ID NO: 27151 - protein, 965 aa, Bacillus cereus BAG5X1-1
MNKKLKINKVMLSISTMALSLGAIQTNVLAEEKVQYNVLHSKPVGIEKPVDEIGHASKTEETLSFQERLKVGDFSQRPASIMKSSEVKQVKESYSMADLNKMNDQELIETLGSIKWNQITDLFQFNEDAKTFYQDKGKMQVIIDELAHRGSTFTKDDSKGIQTFTEVLRSAFYLAFYNNELSALNERSFQDKCLPALKAIAKNPNFKLGTNEQDTVVSAYGKLISNASSDVETVQYASNILKQYNDNFNAHVDDRMKGQAVYDMMQGIDYDIQSYLNEARKEANETMWYGKVDGFINEINRIALLNEVTPENKWLVNNGIYFASRLGKFHSNPNKGLEVVTQAMHMYPRLSEPYFVAVEQITTNYNGKDYSGNTIDLEKIREEGKEQYLPKTYTFDDGSIVFKTGDKVSEEKIKRLYWAAKEVKAQYHRVVGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDTYRETLSKDPKLNKEYQAYMQQLIDNQDKYNVPEVADDYFNEHAPKSLTEVKKEISETLSMKDTKMTKYESQFFNTFTLEGTFTGSVTKGESEDWNAMSKRVNEALEQLSQKEWSGYKTVTAYFVNYRVNSSNQFEYDVVFHGIAKDDGENKAPTVNINGPYNGLVKEGIQFKSDGSNDEDGKIVSYSWEFGDGRTSTEVNPVHAYEREGTYKVALRVKDDKGKESRSETNVTIKDGRLTESEPNNRPEEANRIGLNTTIKGSLIGGDHTDVYTFNVASAKDIDISVLNEHGIGMTWVLHHESNMQNYAAYGQANGNHIEAKFNAKPGKYYLYVYKYDNGDGTYALSVK

SEQ ID NO: 27152 - protein, 880 aa, Bacillus cereus BAG5X1-1
MAKFQVTCVLKGNLPVLSEGEFCFCIDTCELFIGTKKGNVKVSTENKFESLVSKLKSNTFGGFFNLKSSKSLIGETESANVVSGTYFLELERWNVKNDGTDANNTSKGINNALLWASQQGFIEVVLPMGIYLIDENTPIEPQSFMTLNLGGATLKIRDNGLVKYAIVRYQRNQKFSRITNGRIEGDKDTHDYTTIPHTHEWGYGIEVGNTTPIEGSNISYISIDNMEILNCTGDGIAMESTWGQIGEYDFAGTFEVGGISDVNGTPIVDVNKIRSSIKIDLHHESITKWGYFGLYGDGYGGIGSEINTELYDVLFYKADNTFVAATKRIMFFEEVNVPQGADYAKIVLHQSTVPSKDGCKITIRIPEFSKNVFIEKCKIHDCRRLGISVSGAKQIYIRDCEIYKMKGTAPQGAIDIEDGYRLNQYINIERNNMYDNQGYNIVVVGGRYINIIQNKLTNNSLVVGQNVEKVIINHNHLREVSCVLGGEVTFVNNQMYGTRVIIDQGDKEALIGNCLFHNSALVMGRDKAYCIQVNQCEFFSDQDLFHSFSQLGSIIGFSTEPQTISDCVIKGSSVEGTSLTGVSPGVKNGWRLSNVSFIDTKHPQGIITNLPPGVYTGCNFENSGTISFVTKTPQAEYEFNGCSFSWDAYNLFIVESSQTIAMLKVKNSTFRGGRWGSAFFLWDIGGRIEFINNVFEYPNSESTDSIINFWNETFISEYILIENNIFRSNKSMIGVNANQISSSITLIFKDNIVDTVVIKLRDEHIKKDNYINGVFDPYFYSATEPTEGFFRVGQTIKNSNPVAGGYIGWICLNEGNANNTIWEKDIVYKMDDVVSVNGKVYKCKVMSTNGVAEPSQIDSSAEWEYLSELAVFKLFGRIAE

SEQ ID NO: 27153 - protein, 552 aa, Bacillus cereus BAG5X1-1
MKKIFSTFLICILAFSTLFNMTVSAESKSTGTLAIHKYEQGKDGKKGEVGNGKDGQSVPEGVKPLAGVTFEIKRIASFEQTSDGKVIKENISKVTDSTITKVTDANGMAVFNNLPLGRYEVKAVKGPDHIELDTSTFIVDIPMTSADGKDLNYDVHIYPKNETKHGSVELIKKGEEDRVLPDAEFHLFKKNEDGTNTQVKTPHPLVTGLDGKIRVDSLEYGNYYFIEEKAPKGYLTSKEEYPFSIKETGKLVKLEKDVKNYKEPTIEKTINDSSKNAGINLETEYTYDIKTLLPEDIQMYKNYVVTDVLDDRLEVVGTPIVKIDGKKIDESIVNVIVAGQKVIASIEDFSKVTGKELHLQITAKIKGDVQSGVKIPNKAVLDFVNKDDVSSEKDGKPSNEVVVTPTMGNIKIEKVDGKDNNLKLKGARFELRDSKGKVVTVKEKKMDDKTDADGIITWNEIPYGEYQIVETEAPKYIDEDGAVEQYQKLRDPLDIKIDKDHKVIELKVENNKSGWIIPATGGIGTIFFTVVGLLLMVTAAFIFFRKKPVKNS

SEQ ID NO: 27154 - protein, 503 aa, Bacillus cereus BAG5X1-1
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGEGKGLLAVSDYQPVTGVKEVTKKISEKDAEQKSMAYVGGESEQNLWAPTEKEFGYIVEEGVALPVYKVVVHSNNPFGAWETFIDAENGKLIKKVDINRKAEGTGKVFLPNPVVSSGSKTGLKDSNDADSTALTNQLKTVTLKGLDGTGFLIGEYVTISSKAKTKSTNLQFNYTRANDSFEDVMSYYHIDTLQRYIQGLGINNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDATAYSSSDPTCLRRLDTNKVYPKDITNEVHNDGEIWAQGQYEMAQAFGRDVATKIILQSHWSLTPNAKFRDGAKAIKQADALLYGGQHAAEIDRIWAARGISTN

SEQ ID NO: 27155 - protein, 376 aa, Bacillus cereus BAG5X1-1
MKTKQTIAASTLALAMIAGSTPTHAEVNDATAGQSTGDRLAEIKQHRQELDAKLQQHKENVDQTLNELNQVKENVDTKVNELHERKQVADEKIGEIKQHKQELDAKLQQDKQIAEDKIAEIKEHKKQVDEKVAEIKEHKQTVDEKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQEARQTLENKLNELKQSKQTVSDDLTKKKQDLDIKINDFKHTEKKIDDKLAELHTTQQNVDNKINEVSQPKQTTVNNNNTNVPAKNTARELPNAGSEQSSNMALGMLSVLGGILLLTRNKIKKVFIKQL

SEQ ID NO: 27156 - protein, 271 aa, Bacillus cereus BAG5X2-1
MTRKKEFLKVLSMSFLLTAITVNAPQLTTVVQAAGGHGGTDTEVRDKDRDEDRKKDEERKKDEERKKDEERKKDEERKKDEERKKLIEHIVKVEVKEESVAKKEAVETLLTRLPVNILEMYHAVGGKIVIVDGDITKADELKDMKEKQTRDSDGNTVSLDQHYVYAKGGIEPKLVIQASEDYGYQIEKDKNVYYEMGKAIVRDTLKLETITNPTFIDLLNKIKADEDASSLLFSETLQQHTEQFTERYVQDNREEIENVFARVFAYYVEPH

SEQ ID NO: 27157 - protein, 94 aa, Bacillus cereus BAG5X2-1
MVTPITNNQKDAITVDANSFKLVDNKDREFTYSTQALTAFDVGNDGSSDFFLKQLNPGLSQTGKVIFDVPADAQGLVLKARDGMMGKEIKLKVE

SEQ ID NO: 27158 - protein, 159 aa, Bacillus cereus BAG5X2-1
KEEVKEPAKEVEGPKEEVKEPAKEVEGPKEEVKEPVKEVEETKEEVKEPVKEVKEEVKEPTKEVEEAKEEVKEPTKKVEEVKESATGLDQEPKGNNQVVEKEGRKADTLNKQHANKFEEDKKSLPSTGGEASTSTLLSGITLVLSALSMFVFRKRLFKK

SEQ ID NO: 27159 - protein, 105 aa, Bacillus cereus BAG5X2-1
EEPKVTEEPKELEKPEVTEKPEIHVKPEEEKVQEKVQEKVEVQNKQEVHSKVEVQNKSEVSSSEENNKKSKLLPQTGGVSTEATSVMAGMFLLLFGAMLFRRQKN

SEQ ID NO: 27160 - protein, 502 aa, Bacillus cereus BAG5X2-1
MTRKKEFLKVLSMSFLLTAITVNAPQLTTVVQAAGGHGGTDTEVRDKDRDEDRKKDEERKKDEERKKDEERKKDEERKKLIEHIVKVEVKEESVAKKEAVETLLTRLPVNILEMYHAVGGKIVIVDGDITKADELKDMKEKQTRDSDGNTVSLDQHYVYAKGGIEPKLVIQASEDYGYQIEKDKNVYYEMGKAIVRDTLKLETITNPTFIDLLNKIKADEDASSLLFSETLQQHTEQFTERYVQDNREEIENVFARVFAYYVEPHSKDTLKSYASDAFEYMERIDWAKLKEQKKNEPLDFKEDAAAAQEFGNKIKLSEAVLTDLDKKSMERYVFQGPLLNRILRGIEPHPKGDAGKAIDEFIKGIDNLFTKEEAKLTNDVIVYRRTDEREFGFKPGTLFNQDGDVNQKAVEKLKSFEGKTITDKGFMSTSLAINSVPLGGNQETIRLRMKIPTGTSVIYMNNSWYEVVLNRNSSYKITKVNGIVVEDSKIVVNIEVELIPNS

SEQ ID NO: 27161 - protein, 806 aa, Bacillus cereus BAG5X2-1
MKSQNIKKFLKVVPAAFVLSSSLLVTPGSSFAESPTISQVSANDAVPTGLLSYYFKDHNLKDLAFMTNQQTGNLSTFSTELNDLVETQGKEINSAFWKGQIQVDESGEYGFSTSKDQNVKLKINDKELIHNGTSTEKIRLEKGKFYPIEIVYKNGDRSQNFDLKLSWTTPNNKTEQIPEKHLFLPEMKKPAVRTAKASALAAPQATDKLVDTDSDGIPNALETNGYTVDIKNQMLIVTPWVESLHAKKGLTKYYSSANKWSTTSDPYSDFEKVTGNIDKQVKSEARNPLVAAYPVVNVDMEQIVLSKLQNVSLTDAKSKSNTVSRSTSNSKTNSDSVSVGTEISASLFDFGAKLSLDYTHEESSTVSIEDSNSSTSESSWSKTIGLNEGETAYLSAGIRYHNKGTAPIYNVAPTSTLVLGKDQSIVTVKAKENQLANALTPGTYYPAKGLAPITLNRQDDFGSTPITMNLNQVNILEKEKKLRIDTDQVSGTYATNNNGRITQAGNWSEYIPQIQSTTARLVLEDEQAGTVEERRVAAIDPLDPTERTKPIVTLGEALKLAFPSIKEKDGVLYYNDQKLVDNFEIVMDENTAKEVSKQLNEMTTKDIYKVELRAKMNLGIRNSILRSVDGLFENFRGKQLVKSDITRSALDTIVNAEKKLAASNMSKSLRSMQQQRINMANTLIKTNLFNKEYLGRSWYGPRFSSYTETDKRLKLYIGNLGFSWPGVDLTSLGSTGTVAGDTVTHILRDANDKVIKEWKGLPESTPYEELNINDYMIKYEGSIGYYYTVKLLDGTEYVMARNNLTK

SEQ ID NO: 27162 - protein, 140 aa, Bacillus cereus BAG5X2-1
LLQNGQVIATQEVTEATGWKYAFKDLAAYDANGVAYKYEVKEQPIDGYKTEVKGYDITNIKIKDETVVPPQDNTDTKDGTVVPPQENTKDNSEVPPTKESDKTSLLLPKTGGTPTEIISIGGGILLLVSGILLFVRRRVQ

SEQ ID NO: 27163 - protein, 333 aa, Bacillus cereus BAG5X2-1; identical to SEQ ID NO: 26704

SEQ ID NO: 27164 - protein, 1055 aa, Bacillus cereus BAG5X2-1
MERIEKERMIYMQKRKHYMFQKPMKVLATSAILTTTLFTPTITNSLTVQAETVAAQTTNQYEQRDFELPGTGSFSSEAKRERRSEQKTYMPTGIYVKPNEQITIEVSGTQKVRAIIGTHQYDKQWGKEVDLSPGSNTISSPNGGLLGFDNPQDTGTVKVKVTQGGSPVPFFELGKHTREDWITMMNKYPDAHAVQLKSEKAVLTVTRDSAQKYIVDQDPVPLLEKYDEMIRAQDKISGLSETDPNPLHRSTRRIWAFVENPNKPDWGMYASLDGAVFTTAGNAIESALDVNKFGWGQMHEAGHARQQYPWIWNDLRGMTEVTVNLYSLAAQKQLFPNQPTRLEKSGDYDRAFTYIKQTDKDYKNINDLFVKLVMLWQLNLAYGEDFYPNLHKLYRELPENQLPKTDEDKIQAFIYNTSKVAKQNLLPFFDQWGLKASQETRQKIEALNYPILTAPIWEATDSKPVIVEENGETSDMEPKLTVPAGATMNVGDQFDPMSGVSATDKEDGDLTSKVTVDGKVDTTKPGTYVLTYTVKDSKGHKVTAKQTVTVKEKEETKDEAPVLKVPSETTITEGDKFDPMKDVSSTDKEDGDITSEVKYEGNVDTNTPGTYTITYTVKDSAGHLATQTQTITVKEKPAEDNEPELTVPEETVLTVGDQFDPMSGVKAIDKEDGDITSKVTYSGDQGTDKEDTYKIKYVVEDSKGHRIIKLRTVIVKAAEKPSEDQAPVLKVPFTTTFHVGDTFDPMSGVSATDKEDGNLTSKVKYKGNVGTTKPGKYIVEYSVVDSQGVNATATQTVIVEESGETPDMEPKLTVPVGATMNVGDQFGTMSGVSATDKEDGDLTSKVTVDGKVDTTKPGTYVLTYTVKDSAGHLATQTQTVTVKEEEKEKRVEIQGPELTVPSETTVTVGDKFDPMSGVKAIDKEDGDITDKVIQFGEVDTSKTGTYEVKFLVRDSGGNEVTTIQKVVVKDKDNGNNNTNNGNGADNGSTGTNNSNGSDTGNSNISNNSTSDKKEDTYKELPKTGASTNNSAALGILMVLAGMVITFGRKFKKVLK

SEQ ID NO: 27165 - protein, 274 aa, Bacillus cereus BAG5X2-1
TEQFTERYVQDNREEIENVFARVFAYYVEPHLKDTLEMYASDAFKYMEGIDWAKLKEDIKKIETLDFKGDIDGAREWGEQKYNNWTLSLSKEERDAIVSYTGAKYDPINGYLRENQGILKTDKLNKVITAIDSGLQKTTTDQSITVYKRVSENIFNLEYGDLRSLTAPYAINEEVLKKIKDEFTNKEYIGYGFESTSLAKDPSKSYGNDRYPILYKITVPQGIHGAFIEPISKYNDQLEFLIARGHTYKINGFSIMSTNDKPYVQVEISIVPGD

SEQ ID NO: 27166 - protein, 431 aa, Bacillus cereus BAG5X2-1
MSTIIDVYAREVLDSRGNPTVEVEVYTESGAFGRAIVPSGASTGEHEAVELRDGDKSRYLGKGVLNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTDRIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGVKSFYNIKR

SEQ ID NO: 27167 - protein, 553 aa, Bacillus cereus BAG5X2-1
MKRIFSLLLICVLAFSALMNMTVSAESKSTGTLTIHKFEQSKDFKTTTKGNGKEGQTVPEGAKPLEGVTFEIKRIESFEKISNDGTVIKEEAKPVKDAAITKVTNAKGEAVFTNLPLGRYEVKAIKGPEHIELDMTTFIVDIPMTSTNGKELNYDVHIYPKNETKRGSVEFVKKGEGGKVLKDAEFHLFKKNKDGTSTQVKTPSSLVTGEDGKVRVDSLEYGDYYYFIEHKAPTGYLTSKEERPFSIKESGEVVKLDDIKNYKEPTITKSINNGSKVAGINKETDYTYDIKTLLPEDIQSYKKYVVTDILDDRLEIKGLPIVMVDGKKVEDDSVKVVVEGQKVTATIEDFSKINGKELHLQITAKIKSDVESGVKIPNKAVLDFVNKDDVSSEKDGKPSNEVVVTPTTGNIKIEKVDGKDKTLKLEGAKFQLQDKKGNVIKVNGKEMNDITDANGIITWNEIPYGEYQIVETEAPKYKDKDGAVEHYQKLRDPIDITIDEKHQKIELQVENNKSGWIIPATGGMGTILFTVVGLILMAVATFIFFRKKPVKNS

SEQ ID NO: 27168 - protein, 175 aa, Bacillus cereus BAG5X2-1
MKKLLASATAFTLLTVGYSSSAFAEKNPNDKNCGHFKNKQEVMEFWHSNGYSATNDPHDLDRDNDGLPCEVKKGDYDQFLASKQTTKNDENKPQEQTKQENTKQEPVKQDNSQQNNQTTNNKQEQTKQTAVKTETKKQGEKLPNTASNGVTMMLVSAALVLAGSILVFRRKKTNA

SEQ ID NO: 27169 - protein, 738 aa, Bacillus cereus BAG5X2-1
MKQLKPAISVLGSVSMALTLASPALADVKQPNPGGTVEIFKENANVKKEDKNFTLGSDGEIGSLITQNIEMANNDWDKDGISNDLEMNGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRVYTPKDKSIADKPVLSYNEVFQHVNIDTKKVNHIVNKAKSTNNVSVVSANNGTDALNDLKAGQGDRGYLYKDSVHGAFAKLQQPTLVEGSYDSVTQKIRATILPGLFDVSKEIPTIYSKKWNAPSQTVTLVKRENGFTYESRENIHPIKSEIAAHRKVTFEINDAHNLTPTQKIDTEIKANKEFEDYVVDNSGEFVTEGVPYTVASYGNTAYWGSHHAGNKWEYLWAEKSSDEKVNVIIERVGQPKPGKPIKKDEEVLIKFRNPIYSDYAYLKLQDSYIHLDQKQNASTFKFNHAYPKNFTGYHKQWNILSNGNKLKVGYLIDYMKYGNGENGTDTIAWNLSRVQ

SEQ ID NO: 27170 - protein, 965 aa, Bacillus cereus BAG5X2-1
MNKKSKINKVMLSISTMALSLGALQASVSAEEKVPYNVLKTKPVGIEKPVDEIGHVSKAEETLSFQERLKVGDFSQRPASIMKSSEVKQIKESYSMADLNKMNNQELVETLGSINWNQITDLFQFNEDAKAFYKDKGKMQAVIDELAHRGSTFTKDDSKGIQTFTEVLRSAFYLAFYNNELSDLNERSFQDKCLPALKAIATNPNFKLGTYEQDAVVSAYGKLISNASSDVETVQYASNILKQYNDNLHTYVDDRMKGQAVYDMMQGIDYDMQSYLFETRKEAKDTMWYGKIDGFINEINRIALLNEVTPENKWLVNNGIYFASRLGKFHSNPNKGLEVVTQAMHMYPRLSEPYFVAVEQITTNYNGKDYSGNTVDLETIRKEGKEQYLPKTYTFDDGSIVFKTGDKVSEEKIKRLYWAAKEVKAQYHRVIGNDKALEPGNADDVLTIVIYNTPDEYQLNRQLYGYETNNGGIYIEETGTFFTYERTPEQSIYSLEELFRHEFTHYLQGRFEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDSKLNKEYQEYMQQLIDNQDKYNVPEVADDYLAEHAPKSLTAVEKEISDTLPMKEAKMTKHSSQFFNTFTLEGTFTGSVTKGESEDWNEMSKRVNEALEQLAQKEWSGYKTVTAYFVNYRVNSSNEFEYDVVFHGIAKDDGENKAPTVNINGPYNGLVKEGIQFKSDGSNDEDGKIVSYLWEFGDGSTSAEVNPIHAYEREGIYKLALRVKDDKGKESRNETTVTIKDGSLTELEPNNRPEEANRIGLNTTIKGSLIGGDHTDVYTFNVASTKNIDISVLNEYGIGMTWVLHHESDMQNYAAYGQANGNHIEAKFNAKPGKYYLYVYKYDNGDGTYELSVK

SEQ ID NO: 27171 - protein, 503 aa, Bacillus cereus BAG5X2-1
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQSVKGVKEVTTKISEKDAIQKSMAYVGEASEQNLWAPTEKEFGYIVEEGIARPVYKVVVHSNNPFGAWETFIDAENGKLIKKVDINRKAEGTGKVFLPNPVVSSGSKVGLKDNNDADSTALTNQLKTVTLKGLDGTGFLIGEYVTISSKAKTKSTNLQFNYTRANDSFEDVMSYYHIDTLQRYIQGLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAAAYSSSDPTCLRRLDTNKVYPKDVTNEVHDDGEIWAQGQYEMAQAFGGDVATKIILQSHWSLTPNSKFSDGAKAIKQADALLYGGQHAADIDRIWAARGISTN

SEQ ID NO: 27172 - protein, 120 aa, Bacillus cereus BAG5X2-1
MEKVLAIDKEDGDLTSKVKLNGEMNTSKAGTYVLTYTVTDSVGNEVHAIQKVLVKDKDTSKAKGITNNGNIPNSINSDKKESIYKELPNTGASTTNSATMGIWMVIAGTVLTLARKFRKI

SEQ ID NO: 27173 - protein, 684 aa, Bacillus cereus BAG5X2-1
KVENELVDKGSVEITKVDKDSQKVLEGVVFEVQDEKGKVVTEVKTDKNGKAKISDLSVGKYKLVEKESLPGYKQLTEPVSFEIKKGMTEVLSLKIENEMVDKGSVEITKVDKDSQKVLAGVVFEVQDDKGKVVTKVTTDKAGKATVADLSVGKYKLVEVESLPGYKKLEKPVPFEITKGMTKSLAFTVENEMVDTGNVEITKIDKDSKAPLENVVFEVRDSKGKVVAKVKTDKEGKANVSDLSIGKYELVEVETPAGYKPLEKPISFEIEKGRVTALQLTVENELVDVGNVEITKVDKETKDALADAVFEIQDAAGQVVAKITTDKKGHAQVTNLSVGTYKLVEVKAPKGYKQLVDPITFQIEKGMTKSLALTVENEMLDKGNVEVTKVDKDSQKVLEGVVFEVQDEQGKVVTKVTTDKEGKAKVSDLSVGKYKLVETESLPGYKKLTEPVSFEIKKGLTEVLLLKVENEQLDKGSVEITKMAAESKNVLSGAVFEVHDEKGKVVTKVTTDKEGKAKVSDLSVGHYTLVEVEAPKGYEKLTNPIPFEITKGMISPVQLEVLNKLTSLAPPGPEKPETTDPEKPETTDPEKPETTDPEKPETTDPEKPETTDPEKPETTDPEKPETTDPEKPETTDPEKPETTDPEKPEKELPKTGQKMPVEPYMGALLIMMSFGLLVLGRKQQR

SEQ ID NO: 27174 - protein, 587 aa, Bacillus cereus BAG5X2-1
MGRKYVIRILALLSVISLFFNLMLPKASAEIEKIPSLKTTATNKADGGKEMHAKESITIQDKVEYTNLVVGKEYTVKGKLMNKVINKPLLIDGKEVTAETKFTAKETNGVVTLDFPFVGAEQQRREVVVFEELYEDGVLVATHADINDVGQTVRFVEPTIKTTATNKADGGKEMHAKDSITIQDKVEYKDLIVGKEYVVKGKLMNKVTNEPLLIDGKEVIAETKFTAKEKNGFVTLDFPFVGAEQQGREVVVFEEVYQDGVLVAIQSDINDVGQTVRFVEPTIKTTATNKADGGKEMHAKDSITIQDKVEYKDFIVGKEYVVKGKLMNKVMNKPLLIDGKEVTAETKFTAKEKNGFVTLDFPFVGAELQGREVVVYEEVYEDGVLVAVQSDINDVGQTVRFVEPTIKTTATNKADGGKEMYANESVTIQDKVEYKDLIIGKEYVAKGKLMDKATKKPLLVDGKEVAVESKFTAKEKNGSITLDFTFNASKLQGKEVVVFEKLYQDDILVAINVDIEDEGHTVKFKAEKLGKPQQEKPQLEQPKTGKTSKAGTLPATGGNTSFMWFSVGAGLLLLTLGAILFMKRRNA

SEQ ID NO: 27175 - protein, 183 aa, Bacillus cereus BAG5X2-1
MRKSFLLLTLILVLVSVTAACTQDKKDSAVKNGPIEEPTAKNENEELINFEEKEDMSRLEQGILLVGESVKGGYYLTAVKSAYLNDSNDSIVVNVSVKNVRGQTIGLSELKYNLKDEKDGKAYEGKMLDQNPSDIQVKPNETVELKIAFEVPSTADEYMFYIESSLDPLGAHWKIDKLQSQKS

SEQ ID NO: 27176 - protein, 336 aa, Bacillus cereus BAG5X2-1
MKRSKTYLKCLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEASATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTNQSNLQVAYTKHADDYQLRPGYTFGTANWVGNNIKDVDQKTFNKSFTLDWKNKKLVEKK

SEQ ID NO: 27177 - protein, 458 aa, Bacillus cereus BAG5X2-1
MNLKFTSKFERLRKSKKGIGACVLAAGMTAITMIPQSAYAHGFVEKPSSRAALCSQNYGALNLNCGNIMYEPQSLEAPKGFPDGGPIDGKIASAGGLFGGILDQQTSNRWFKNTIMGGANTFTWKYTAAHSTSKWHYYITKKGWDPNKPLTRAELEPIGTVNHDGSAASNNLTHTINVPTDRNGYHVILAVWDVADTSNAFYNVIDVNLVNNETPDTVAPSQPTGLNASKVSANSVALTWKASTDNIGVKEYQVLRNGEVIDTVPGTTFTDKKLKANAEYTYTIKALDSAGNISKESEKLKVKTTNETPDTEAPTQPKGLHSMSKTATTVDLMWSPSEDNVGVDHYIVYRESAGVMNKIGAADNTSFMDKDLKTNTSYKYVVTAVDLAGNESSRSDVLNVTTKSEDSTYEKWDARKAYTKGDRVVHEGKVYEAVQNHQGNGDSNWIFALSLWKPVLNK

SEQ ID NO: 27178 - protein, 455 aa, Bacillus cereus BAG5X2-1
MNNRFLKQIQNMKMNKKSLGAVALTAGIIGTTLIPQNAYAHGFVEKPGSRSALCSPTYGALNVNCGSVMYEPQSLEAPKGFPQAGPVDGQIASAGGKFGGVLDQQIADRWFKNIITGGENTFTWKYTAPHLTSKWHYYITKKGWNPNKALTRADFEPIGTVLHDGSAASNHLTHKINVPTDRSGYHVILAVWDVADTANAFYNVIDINLINDVKPDIEAPSTPNGIQTQNVTANSIELTWNASTDNVGVKGYQIFRNGEMIDTVPGTHFIDKKLQPSTKYSYTVKAIDAAGNVSKESAMLTVKTTVEAPDTEAPTQPKGLHSMGTTASSVDLMWSPSDDNIGVDHYDIYRETEGLMKKIATSNTTAYMDKNLLSNTTYKYVVKAVDVAGNESVQSDIFTITTKTESASYEGWDAKKAYEKGDRVLHEGKVYEAVQSYQGNGDPNWIYALSLWKTV

SEQ ID NO: 27179 - protein, 563 aa, Bacillus cereus BAG5X2-1
MIEVVKGIREMKKIFSVLLVFFLTFSTWSSVLVKAASPSKGTLTIHKYEQEKDGAPGLEGDGSANQEVPTNAKPLKGVTFEVKRVASFEKISNDGKIVKEDVKPVIGATPTQVVTDDNGQAVLKELPLGRYEVKEVAGPPHVNLNPNTYTVDIPLTNKEGKVLNYDVHMYPKNEIKRGAVDLVKTGANEKALAGAVFSLFKKDGTEVKKELATDGNGHIRVQGLGYGEYYFQETKAPKGYVLDPTKHEFFIKTSGTINEDGTITSGTVVKVEVQNYEEPNIDKKINGDLEALPINPLTNYNYDIKTLIPEDIKEYKKYVVTDTLDNRLMIQGKPVVKIDGAEVNASIVEVAVEGQKVTATVKDFTKLDGKKEFHLQIKSQVKEGVLSGSEILNTAKIDFINKNDVFGEKESKPVVVVPTTGIIELTKVDGADNKKLKGAEFVLKDKNGKIVVVAGKEVTGVSGENGVIKWTNIPYGDYQIFETKAPTYTKEDGKTASYQLLKDPIDVKISENNQTVRLTIENNKSGWMLPVTGGIGTTLFTVIGLVLMVTAAFVFFRKKVANN

SEQ ID NO: 27180 - protein, 372 aa, Bacillus cereus BAG5X2-1
MKTKQTIAASTLALAMIAGANSAHAEVTDATPQQSTGDRLAEIKQHRQELDAKLQQHKENVDQTLNELNKVKENVDTKVNELHERKQVADEKINEMKQRKQELDAKLQQDKQIAEDKIAEIKEHKKQVEDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQKAREDLLNKINEIKQAKQTVSDDLTKKKQDLDIKINDFKHTEKKIDDKLAEVHTTKQNVDNKINEVSQAKQTETKTGTTNTNNNARELPNAGSEQSNNMALGMLSVLGGVLLVTRNKIKALFSK

SEQ ID NO: 27181 - protein, 1004 aa, Bacillus cereus BAG5X2-1
MCERSLIFSQYRIKSKNSKIMVRDTKKCKVGESMKGYSKKVLVGVSFASLMLGSFQGSTLAESKKGEQVSYRNVLKMEPVGVQLPVQELAHSSKVLENKSFEKRLQFADLSQRPPEVKKESKQLAAAKTYTIAELNQLSNQQLVDLLVTIDWEQITGLFQFNKDSLAFYQNDSRMQAIIDKLKQQGQVYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSTLSKDANLNKEYQDYMQMLVDNREKFNVPLVSDDYLATHVPKPVSDIAAEITAEAKLSNVSVKKNKSQFFNTFTLQGTYTGTTAKGEYEDWKTITQNVNDTLKRLSAKEWTGYKTVTAYFVNYRVNASGQFEYDIVFHGMNTEEGAVNKAPVAIINGPYSGNVNAAISFKSDGSKDEDGKIVAYKWEFGDGTVSNEQNPTHVYTTEGTYTAKLTVTDDKGLTNTVTTNVTVQKKEDNSVEKEPNNSFQTANKLQLNQVLRASLGNGDTSDYFEINIETAKNLQINVTKENNIGVNWVLYSEADLNNYVTYAQQEGNKLVGSYYTYPGKYYLHVYQYGGGTGNYTVEVK

SEQ ID NO: 27182 - protein, 770 aa, Bacillus cereus BAG5X2-1
MKKSKKMLAGATLAIGVIAPQVLPTTAHADENTGESTVKLRILETSDIHVNLMNYDYYQTKTDNKVGLVQTATLVNKAREEVKNSVLFDDGDALQGTPLGDYVANKIKNQENSVDPNYVHPLYRVMNLMKYDVISLGNHEFNYGLKYLKGVISKTKIPVINSNVYIDDHDNDDTNDKHYFEPYHIFEKEVEDESGQKQKVKIGVIGFVPPQVMNWDKANLEGEVKAKDIVKTARELVPKLKDEEHADIVVALAHSGVDKSGYSVDMENASYYLTEVPGVDAVLMGHSHTEVQDIFNGVPVVMPGVFGSNLGIIDMQLKKVNGKWEVQKKDQPKPELRKIADSKGNPLVQSDQKLVNEIKDEHEKTIEYVNTPVGKTKAPINSYFSLVQDDPSVQIVTNAQKWYVEQELKKPEYEKIKDIPVLSAGAPFKAGGRNGAAYYTDIPAGTLAIKNVADLYVYPNTLYAVKVNGAQVKEWLEMSAGQFNQINPKPKGKIEQQLVNTGYPTYNFDIIDGLKYEIDVTQPAKYDKDGKVVNANTNRIVNMTYEGKPVADDQEFIVATNNYRGSSKTFPGVSEGEVIYQSQDETRQIIVKYMQETPAINPTADQNWTFKPIVADKLITTFDSSPKAKEYIKKDGKISYVGPSENEFAKYAIDITKKNDDDKETGGENPTTPPTGEGNNGGNPTTPPTGEGNNGGNPTTPPTDEGKNAGSGQTTTDNQNSKETTTTVSEKKEERDLPKTGTSVASTIGAGLAFVGAGLLLLFRRKKANR

SEQ ID NO: 27183 - protein, 723 aa, Bacillus cereus BAG6O-1
MKKLKPALSVLGSVSMALTLASPALADIKQPNAGSTIEMFKEDANAKEGKDLIYGTDGKKGKMSTEKIEIQNDDWDQDGISNDLEIKGYKIEFNRQTGKNEAQAWDPERDKDKLKFITNPMSANSDGDPFTDAYEVQYYGSNSDTEFNPMVANIPNLQVGIKRIGVTPLAAITDSNGGSIDKGWEKSVSTQHSFGVGAGVEGGVEGSAAGPVPSGKASLNVSYGYSKTSTDTERYSSNIDWSTAKTVDSAKAAKVSLQLEYKNTGTASAQNVSPHFNIRLGDKIISTVKATQDRYKANQLSTEKGGRNTTEVLIDSVDNQADVNIYLSLDELKAVEQGAILSVEVLPTSTMELYIEKDGEFMNLGDSGKFESRVNASTTILETDIGNKPKFRMYAPEGVGSDTNLTFNEVLKHVKVDSKKINEFIDNSRGDQVIIAKENLENAKKSYVSKGAKVGVFTKIQQPELSYSAYDPFTKKFYAAVVPGLFGASNEISVSFENKNSKQTQQVTLVRKGNVYESKEAVSLNDFNPSQKVTFEINDAQKKLPTQKISTVVTYNKEYENYLTHRFSDELIVEGTPYTLQLSGNPVLSYKGNDKWQYLASGGNYTQPVNVIIERKGQPKPGQPIKAGEELHIKVQNSAYSGYEYLKLQDKYIHFDQKQNASTFKFNHAHSPGYLDYQREWHLQSDGNKLGFSTYDAGYISYGNDRQTYGGRLEDKWSLVKAK

SEQ ID NO: 27184 - protein, 719 aa, Bacillus cereus BAG6O-1
MGNSTTKSKKLVGFVATATLATSMIAGASNASAQTTDTLKTAEPVQEKAKDKKEERPESLFPSMDINYDTTIYVGDPFDPMAEVSAYDSKDGDITDKINIVGEVNPFEPGGYNLDYTVTNSRGFSVIKQVHVWVKRGEKPILRLPYRVSINVGDKFDPMTGVSAIDEKDGDITSKIKVDGNVDTSKPGTYEVTYTITNSKGLTIVRKQPVKVKETEGTKNEAPVLTVPFTTTLHVGEEFDPMAGVSATDKEDGNLTNKVKYKGNVDTSKPGKYIVEYWVVDSKGVNATATRSVIVKENEEIPDMEPKLTAPTKTTINVGDKFDPMAGVSATDKEDGDITSKVTVDGSVDTSKPGTYELTYTVLDSKGHTVIAKQTVTVKQKVETTNEAPVLTVPFTTTLRVGEKFDPMSGVSASDKEDGNLTNKIKYKGNVDTSKPGKYIVEYWVVDSKGVNATATQSVIVKENEETPDMEPKLTVPTRTTINVGDKFNPLSGVKAIDNEDGDITDKVTVDGSVDASKPGTYELTYTVKDSKGHTVTAKQTVTVKQKVESKDEDPVLTVPTEVTLHVGDKYNPLSGVKAIDKEDGDITDKVIHLGEVDTSRAGNFEVKFLVRDASGNEVTATQKVTVKDTDTENGSDNSNNNTNSGEGPDNTTTTTTTTGNVSDNNNNNTSSNLDNKKDTIKELPKTGANSNNGTAVGILAILAGMLITFGRKFKKAIK

SEQ ID NO: 27185 - protein, 965 aa, Bacillus cereus BAG6O-1; identical to SEQ ID NO: 26880

SEQ ID NO: 27186 - protein, 502 aa, Bacillus cereus BAG6O-1; identical to SEQ ID NO: 26882

SEQ ID NO: 27187 - protein, 553 aa, Bacillus cereus BAG6O-1; identical to SEQ ID NO: 27138

SEQ ID NO: 27188 - protein, 878 aa, Bacillus cereus BAG6O-1; identical to SEQ ID NO: 27134

SEQ ID NO: 27189 - protein, 370 aa, Bacillus cereus BAG6O-1; identical to SEQ ID NO: 27118

SEQ ID NO: 27190 - protein, 55 aa, Bacillus cereus BAG6O-1; identical to SEQ ID NO: 27116

SEQ ID NO: 27191 - protein, 553 aa, Bacillus cereus BAG6O-1
MKKILSLLFIFVLMFSNLPSMVANAATPTNGTLTIHKYEQEKNGTKGAEGDGSANQTVPDGAKALPGVTFEIKQITSFKKITNDGKIATEAVKTVTNATPIQVTTDANGQAVFPNLPLGRYEVKEIAGPPHVNLNKNTYTVDVPMTSKDGVALNYDVHMYPKNEIKRGAVVLTKTGAEDKALAGAEFSIFKADGTKVKTGLVTGTGGKIRVDGLEYGDYYFQETKAPTGYVLDPKKYPFSIKESGTINANGTMTSGVVVPVAVKNYQEPDIDKKINNDLEILPINPLKDYNYDIKTLIPEDIKDYKNYVVTDDIDDRLIIQGKPVVKIAGVVVDSSVVEVVVNGQQVTATVKDFSKLDGKKEFHLQIKSQIKEGVPSGTEIPNTAKIDFTNKNNVKGKKKTKPVIVVPKTGSIALTKVDSADGKTLAGAEFELRDKDGKVVVVQGQPVKGVSDANGMITWNNIAYGDYQIVETKAPTYTKEDGSTGSYQILRDPIDVKIDENKQTIKLKVENNKSGWILPSTGGMGTILFSVVGIALMAVAAFVFFRKKTVNN

SEQ ID NO: 27192 - protein, 213 aa, Bacillus cereus BAG6O-1; identical to SEQ ID NO: 26884

SEQ ID NO: 27193 - protein, 825 aa, Bacillus cereus BAG6O-1
MGKATVKSKKLVGIVATATLATSMIAGTSNASAQTTDSLKVSEPVQERAEDKKLTLFVPPQNVVFVGDTFDPMKDVWAKDKNGKDITSRVTYTGDDKVDLTKMGEYELTFTVSDDEGNTVVQKQRVVVRYKHVTNTAPTILILRDKITLNIGDTFDPMEGVTGSDSEEGILTHKITYDNGLDTSKPGTYYITYYLMDSQGKMDLKTRTITVIDQSPVITTPDEFVITEGEQFDPMAGVKATDPEDGDITSKVEYEYYTGSVNKPGTYKVYYKVKDSFGNTANTVATLIVREKIKPVDEAPELKVPTATTITEGDKFNPMSGVSATDKEDGNITSKVTVDGSVDASKPGTYELTYTVSDSKGHTVTAKQTVTVKQKVEIKNEAPELTVPFTSTLRVGEKFDPMAGVSATDKEDGNLTNKVKYKGNVDTSKPGKYIVEYWVVDSKGVNATATQSVIVKENEETPDMEPKLTVPTGATINVGDKFDPMAGVKAIDNEDGDITDKVTVDGSVDASKPGTYELTYTVSDSKGHTVTAKQTVTVKQKVEPTDEAPVLTVPAEATINVGDKFNPLAGVKATDNEDGDITDKVTVDGSVNTSKSGTYELTYTVSDSKGHTVTAKQTVTVKQKVEPTDEVPVLTVPAEVIINVGDNYNPLAGVKAIDNEDGDITDKVIHMGEVDTSKAGNFEVKFLVRDASGNEVTATQKVIVKDKDTEDGSDNDNNNTNSGNGSDNSNNNTNSGNSSDNSNNNTNSGNSSDNNNNNTNSGNVSDNNNTSSNNNTISTLENKKDTIKELPKTGASSNNATAAGILAILAGMLITFGRKLKKTTK

SEQ ID NO: 27194 - protein, 136 aa, Bacillus cereus BAG6O-1
MKKKLVPICAMALLTVGYSSTASANAGSMPKEEVTQVQQDQMKKEAAMQQQNQDKMKKEAAMQQQNQDKMKKEAAMQQQNQDKMKKDQMKQEAAKKVTKGEKLPNTASNNILMMALSAGLLAIGSVFGFTRRKNKA

SEQ ID NO: 27195 - protein, 162 aa, Bacillus cereus BAG6O-1; identical to SEQ ID NO: 26879

SEQ ID NO: 27196 - protein, 333 aa, Bacillus cereus BAG6O-1; identical to SEQ ID NO: 26881

SEQ ID NO: 27197 - protein, 173 aa, Bacillus cereus BAG6O-1
KGEGTDPKGEVTDPKGEGTDPKGEGTDPKGEVTDPKGEVTDPKGEVTDPKGEVTDPKGEVTDPKGEVTEPKGEVTEPKGEVTEPKGEVTEPKSEVTEPKGEVTKPKSEVTDPKGEGIDRVNSQITKNNALNKQIVKKEQILPATGHDTNWLSVFGGGLMLIGAYLYRRLKRVN

SEQ ID NO: 27198 - protein, 738 aa, Bacillus cereus BAG6O-1
MKQLKPAISVLGSVSMALTLASPALADVKQPNPGGTVEIFKENVNVKKEDKNFTLGSDGEIGSLITQNIEMANNDWDKDGISNDLEMNGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRVYTPKDKSLADTPVLSYNEVFQHVNIDTKKVNHIVNKAKSTNSVSVVSANNGTDALNDLKAGQGNRGYLHKDSVHGAFAKLQQPTLVEGSFDSVTQKIRATILPGLFGVSKEIPTTYSKKWNAPSQTVTLVKRENGFTYESRENIHPIKSEIASHRKVTFEINDAHNLTPTQKIDTEIKANKEFEDYVVDNSGEFVTEGVPYTVASYGNTAYWGSHHAGNKWEYLWAEKSSDEKVNVIIERVGQPKPGKPIKKDEEVLIKFRNPIYSDYAYLKLQDSYIHLDQKQNASTFKFNHAYPKNFTGYHKQWNILSNGNKLKVGYLIDYMKYGNGENGTDTIAWNLSRVQ

SEQ ID NO: 27199 - protein, 458 aa, Bacillus cereus BAG6O-1; identical to SEQ ID NO: 26890

SEQ ID NO: 27200 - protein, 890 aa, Bacillus cereus BAG6O-1
MKNKKEIAIVALTTGLALTAVAPYGIGHAEETDQLQVQMQEESFRSGELTQPSQKAPENVVKDALKEKTEQALSPKQINGETGVDYKVFQKRGSYDGTTLVRMQQTYEGKEVYGHQLTAHVDNKGVIKSVSGDSAQNLKQEDLKKPIKLSKEEAKQYIYTKYGSNIKFISEPEVKEVIFVDENNGQASNAYQVTFAAATPSYVSGTYLVNADNGEMLKNMVQESGLKVSEEHVEPLKESKKNNFVSLTGTGKDDLGITRTFGISEQSNGKYALADYTRGQGIETYDVNYRDITNEEKYYPGILVTSTSPTFTDPKAVSAHFLATKVYDFYKDKYKRNSFDNKGKKVVSVVHAWDSGGTNNPKNWENAFSANINNISMLIYGDPMVKSFDIVGHEFTHAVTSSESNLEFFGESGAINEALSDIMGTAIEKYINNGKFNWTTGEQTGSVFRNMKNPSSINYSNGVPYPDDYSKYNDLNGEDNGGIHFNSSIINKVAYLIAQGGTHNGVTVNGIGEDKMFDIFYYANTDELNMTSNFSELRLACLKVATNKYGANSIEVQAVQKAFDAAKIKGAVTENEKTAENQVPELTVPSTITLHVGDTFDPMRNVTAADKEDGNLTTRVQHKGDVDTSKPGKYIVDYLVVDSQGGNATATQTVIVEENGEILDIEPKLTVPVGVTINVGDSFVPMTEVLAIDKEDGDLTSKVKVDGKVDTSKAGTYVLTYTVTDSKGHEVTAKQTVTVKVREEVKNEKPILKVPATTTINENDQFDPMVGVSATNKKNDDLSSKVKVDGKVDTSKADTYEIIYSVRDSVGNEVKAIQKVLVKDKDTSKANGLANNSNISNNSNSDKKEYTYKELPKTGASTTNSAVMGMLMVIAGTVLTLIRKFRKTHK

SEQ ID NO: 27201 - protein, 455 aa, Bacillus cereus BAG6O-1; identical to SEQ ID NO: 26887

SEQ ID NO: 27202 - protein, 431 aa, Bacillus cereus BAG6O-1; identical to SEQ ID NO: 26893

SEQ ID NO: 27203 - protein, 971 aa, Bacillus cereus BAG6O-1; identical to SEQ ID NO: 27110

SEQ ID NO: 27204 - protein, 965 aa, Bacillus cereus BAG6O-2
MNKKLKINKVMLSISTMALSLGAIQTNVLAEEKVPYNVLHSKPVGIEKPVDEIGHASKAEETLSFQERLKVGDFSQRPASIMKSSEVKRVKESYSMADLNKMNDQELIETLGSIKWNQITDLFQFNEDAKTFYQDKGKMQVIIDELAHRGSTFTKDDSKGIQTFTEVLRSAFYLAFYNNELSALNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNEVTPENKWLVNNGIYFASRLGKFHSNPNKGLEIVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNEKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDTYRETLSKDPKLNKEYQAYMQQLIDNQDKYNVPEVADDYLTEHAPKSLTEVKKEISETLSMKDTKMTKYESQFFNTFTLEGTFTGSVTKGESEDWNAMSKRVNEALEQLPQKEWSGYKTVTAYFVNYRVNSSNQFEYDVVFHGIAKDDGENKAPTVNINGPYNGLVKEGIQFKSDGSNDEDGKIVSYSWEFGDGRTSTEVNPVHAYEREGTYKVALRVKDDKGKESRSETNVTIKDGRLTESEPNNRPEEANRIGLNTTIKGSLIGGDHTDVYTFNVASAKDIDISVLNEHGIGMTWVLHHESNMQNYAAYGQANGNHIEAKFNAKPGKYYLYVYKYDNGDGTYALSVK

SEQ ID NO: 27205 - protein, 163 aa, Bacillus cereus BAG6O-2
MLKKVSRIVLICGMSFSLSACTETKNSDESKQEDVQDKVYKIGETVDVDGLQVTLDSVQLGYPDYTTDKKKDDILGIVFTVKNNSKKEIPFAFYEFEITDKKGTRFKEYNNYDSFISKKLAPDEKIQDIMLFDVAKENTYIATYRPEFTHENRTIKFELKPNK

SEQ ID NO: 27206 - protein, 152 aa, Bacillus cereus BAG6O-2
NATNRPATIKVDLLQNSQVVATQEVSETTGWKYAFKDLAAYDAEGKAYKYEVKEQPVDGYKSEVKGYDITNIKIKDETVVPPQDNTDTKDGTVVPPQENTKDNSEVPPTKESDKTSLLLPKTGGTPTEIISIGGGILLLVSGILLFVRRRVQ

SEQ ID NO: 27207 - protein, 1053 aa, Bacillus cereus BAG6O-2
MERIEKERMIYMQKRNNFMFQKPMKVLATSAILTTTLFSPIMTNGLTVHAETIAAQTTNQYEQREFELPGTGSFSSEAKRERRSEQKTYMPTGIYVKPNEQITIEVSGTQKVRAIIGTHQYDKQWGKEVNLSPGSNTISSPNGGLLGFDNSQDTGAVKVKVTQGGSPVPFFELGKHTKEDWITMMKMYPDAHAVQLKSEKAVLTVTRDSAQKYIVDQDPVPLLEKYDEMIRAQDKISGLSETDPNPLHRSTRRIWAFVENPNKPDWGMYASLDGAVFTTAGNAIESALDVNKFGWGQMHEAGHARQQSPWTWSDFRGMGEVTVNLYSLAAQKRLFPDQPTRLEKNKDYEKAFTYLKQTDKDYKNIDDLFVKLVMIWQLQLAYGEDFYPNLHKLYRELPEDLLPKTDEEKIQAFIYNTSKVAKQNLLPFFDQWGLKASQETRQKIEALNYPILTAPIWQATDSKPVIVEKNGETPDMEPKLTVPVGATMNVSDQFDPMSGVSATDKEDGDITDKVTVDGKVDTSKPGTYELTYTAKDSKGHKVTAKQTVTVKEKEETKDEAPVLKVPSETTITEGDKFDPMKDVSATDKEDGDITSEVKYEGNVDTNTPGTYTITYTVKDSAGHLETQTQTITVKEKPAEDKEPELTVPEETVLTVGDQFDPMSGVKAIDKEDGDLTSKVTYSGDQGTDKEGTYKIKYVVEDSKGHRVIKLRTVIVKAVEKPSEDQAPVLKVPFTTTLHVGDTFDPMSGVSATDKEDGNLTSKVKYKGNVDTTKPGKYIVEYSVVDSKGVNATATQTIIVEESGETPDMEPKLTVPVGATMNVGDQFDPMSEVSATDKEDGDLISKVTVDGKVDTTKPGTYVLTYTVKDSAGHLETQTQTVTVKEKEKPVEIQGPELTVPSETTVTVGDKFDPMSGVKAIDKEDGDITDKVIQFGEVDTSKTGTYEVKFLVRDSGGNEVTTIQKVVVKDKDNGNNNTNNGKGADNGRTGTNNSNGSDTGNSNISINSTSDKKEDTYKELPKTGASTNNSAALGILMVLAGMVITFGRKFKKVLK

SEQ ID NO: 27208 - protein, 333 aa, Bacillus cereus BAG6O-2; identical to SEQ ID NO: 27142

SEQ ID NO: 27209 - protein, 1093 aa, Bacillus cereus BAG6O-2
MGKRVILKVFTLLSVLALFLNVFLPRASAEVMTHEKYSMDWSYSNSLGKHIRTEIIKNSSGQIAYCLTLGLKSPNGEDLPEMGKTDNVVYRVLLNGFPQKSIEQLGVANKNEAHYATQLAVWNALGQLDVNELKHENKNVEKAAKSIINAANTSEDTQDIFMNVIPAEKQKAELKGEFFETNLYTVQTNAKSGSYKVVAKNAPNGVKIVSENGEVKDQLSVGEKFRIQIPKDTKTGEFNLSVAANLTKVQAIAYRGTDTVQNATVLLERNEEKLSSDLAVNWEAAGSLKIKKVGENGEVLAGAVFEVFNANNESVGKITTGADGTAALNNLPIGTYTVKEIKAPTGYVSGDKPQTIEVKTGEIGAVQVVNNKVKGNIEIKKLSDSGKVLPNVEFTVFTEDGKEVKKVVTKENGIANVDGLTYGKYYFLETKTPNGYIGNKTKYPFEIKEHNKTLTFTVENTEVKGSVKLLKVDNEDISKKLEGAVFELKDESGKVIGEYKTDKNGEVNVKDLAYGKYSFVEKTSPNGYVLVKEPIVFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQLGKEYTLKGKLMDKETNKPLVVNGKEVTAETKFTPKEANGSITLDFTFDATGLEEKEVVVFEELLKDGKVVTTHADINDKGQTVKFVKPSVKTTATNKADGGKEIHANDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTASNKADGGKEIHANDSITIQDKVEYKDLIVGKEYVVKGKLMDKATNKPLLVDGKEVKAESKFTAKEKNGSIILDFTFNASALQGKEVVVFEELYQDNVLVAIHVDIEDKGQTVKFKEAKPEQPKPEQPNPDKNTPTSEQPKEQVKEQPQPKKEIQSKIGWLPQTGTNLTSWISMAAGALLLIVGGVIFLKRKNA

SEQ ID NO: 27210 - protein, 878 aa, Bacillus cereus BAG6O-2
MVKYSKFSKLIIGVGLVTISCSGLQIQAETKEKNVKNVLQMEPVGLRKSVDELAHPSNVQENGSFTKRLKLADLSQRPPMPNENAKQLVEEKKYSMAELNQLSNKQLTDLLVTIQWYQIPELFQFNNDSLKFYQDDSRMQAIIAKLAEQGQAYTKDDSKGIETLVEVLRSGFYLGFYHQELSKLSERVYHDKCLPALKTIAKNPNFKLGTTEQNKVISSYGMLIGGASADVEVIQYAGEIFKQYNDNLSTFIEDRTKGDAVYNLMKEVDYEVQSYMNATGKEPKDMLWYGKIDGFINEINRFALIGTVTDKNGWLINNGIYYASRFGKFYSTPTKGQQVVTEAMGIYPYLGQQYFVAAEQIATNYGGIDANGKTVNLDQIREDGKKHYLPKMYTFDDGAIVFKAGDKVSEEKIQRLYWAAKEVRSQFYRTVGSDKPLESGHADDVLTMVIYNSPDEYQFNRQLYGYETNNGGIYIEGTGTFFTYERTPQQSIYSLEELFRHEFTHYLQGRYEVPGLWGQGEMYQNERLTWFEEGNAEFFAGSTRLDSVVPRKSIIGGLSNDPAKRYTAAQTLNAKYGTWDFYNYSFALQSYMYNNRPDMFDKVHDLIRTNDVSGYDAYRSTLSKDNKLNEEYQTYMQMLIDNRDKYTIPQVSDDYVAQHNPKPLSDVAADVTNEAKLKNVKVTKNKSQFFNTFTLQGTYTGSAAKGENEDWKVMNQATNDMLKHLAEKEWSGYKTLTAYFVNYRVNAAGQFEYDVVFSGVNTEEGTAVEKEPNNSFDAANPLSLNALLRGNLSDQDQVDRFSIDVKDPKDLQITVTNEQNLGLNWVLYSESDLNNYVTYATKRDGNKLLGNYNAKPGKYYLSVYKYGGGAGNYTVEVK

SEQ ID NO: 27211 - protein, 182 aa, Bacillus cereus BAG6O-2
MNKKLVTSLLCSTFLFGLSACSSHDTSSRNTKNEQETSKETKNDELSNKDPQKELPTRGDSSDVYISIDSVASLDVIGNGEVKAQGVFKVLDVVVYNRQEEPITLNSNNFKLIDGTGREYHISNESQLTLKAANTATFKFGVLNPSENSEGNIVFDVPKKTQGLTLKINGDMLDKGIELKVE

SEQ ID NO: 27212 - protein, 552 aa, Bacillus cereus BAG6O-2
MKKIFSTFLICILAFSTLFNMTVSAESKSTGTLAIHKYEQGKDGKKGEVGNGKDGQSVPEGVKPLAGVTFEIKRIASFEQTSDGKVIKENISKVTDSAITKVTDANGMAVFNNLPLGRYEVKAVKGPDRIELDTSTFIVDIPMTSADGKDLNYDVHIYPKNETKHGSVELIKKGEEDRVLPGAEFHLFKKNEDGTNTQVKTPHPLVTGSDGKIRVDSLEYGNYYFIEEKAPKGYLTSKEEYPFSIKETGKLVKLEKDVKNYKEPTIEKTINDSSKNAGMNLETEYTYDIKTLLPEDIQTYKNYVVTDVLDDRLEVVGTPIVKIDGKKIDESIVHVIVAGQKVIASIEDFSKVTGKELHLQITAKIKGDVQSGVKIPNKAVLDFVNKDDVSSEKDGKPSNEVVVTPTMGNIKIEKVDGKDNNLKLKGARFELRDSKGKVVTVKEKKMDDKTDADGIITWNEIPYGEYQIVETEAPKYIDEDGAVEQYQKLRDPIDIKIDKDHKVIELKVENNKSGWIIPATGGIGTIFFTVVGLLLMVTAAFIFFRKKPVKNS

SEQ ID NO: 27213 - protein, 503 aa, Bacillus cereus BAG6O-2
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGEGKGLLAVSDYQPVTGVKEVTKKISEKDAEQKSMAYVGGESEQNLWAPTEKEFGYIVEEGVALPVYKVVVHSNNPFGAWETFIDAENGKLIKKVDINRKAEGTGKVFLPNPVVSSGSKTGLKDSNDADSTALTNQLKTVTLKGLDGTGFLIGEYVTISSKAKTKSTNLQFNYTRANDSFEDVMSYYHIDTLQRYIQGLGINNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACVGEWDATAYSSSDPTCLRRLDTNKVYPKDITNEVHNDGEIWAQGQYEMAQAFGRDVATKIILQSHWSLTPNAKFRDGAKAIKQADALLYGGQHAAEIDRIWAARGISTN

SEQ ID NO: 27214 - protein, 431 aa, Bacillus cereus BAG6O-2; identical to SEQ ID NO: 27147

SEQ ID NO: 27215 - protein, 769 aa, Bacillus cereus BAG6O-2
MKKLKPILGAVSSLTMALTITSPALAETKPEQGGKVETFQEDTNLKEGQNIIYGDSGKKGIMIMEEPQENNDWDDDGIPNDVEEKGFKIVFNEKTGKNEAQLYDLVKDFRKKRFITNPKSANSDGDPFTDSYEVEHYDSDSDTDFNPMIANVPNLQIAVKRIDITPVASITDSNGESRTKSWEKSLSVQHSFNVGLAVEGGAEGSAVGPVPSGKGSLNVGYGYSNTKTETESISNSFDWSTATTVDSAKAANVRFHLEYKNTGTASAGDVSPHFNIRLGNKIINTVKATQDRYKANLLTTAKGGNNKTEILMDSIEGQADVKISLTLDELKAVEQGAPLSIEVLPTSTMNVYTMKDGKFENLGDWSHFASNVNASTTLVETNLGSIPKFRVYTPRTDKTKPASVDYNLSLDEFFENSGIGKGAWVAKHIVNGQPKENLVRYGPNRSLLERGVSLGFFDYRALQPTLSYSSYDYSKKKIYASVIPGIFNLNKEIFVTVRNKKGESQKVTLVRNQNSNVYESKENEPVDIAVNRASLGESHAKFELIDVKDNKTEVFTPLVSNKSYLDAIDKIVVDNSGEPIVEGKQYYLKSATNFTNGVNESWSAGTLSQSINGRYVHFSLKGNNWDGLRLGPIQQAIHGPDVQATPVILERKGKSRPEEPFKKDEEVFMKFTNSSHSNYQYLNIGNGYDYSWLDTDHNKSAIKLDKLTNQKNFYIKSDSNYIISRENQWTSSVADNGIAPLVGAGERVLKSEHTTSPGNYHQWELESIK

SEQ ID NO: 27216 - protein, 878 aa, Bacillus cereus BAG6O-2
MVKYSKISKLILGVGLVTISCNGLQIQAETKEKNVKNVLQMEPVGIQKSVDELAHSSKVQENASFTKRLKLSDLSQRPLAPNEDVKSLAEEKKYSMAELNQLSNKQLTDLLVTINWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTMWYRNIDNFINEVSRFALIGTVSDKNGWLINNGIYYAGRLGKLHSTPTKGQQVVTDAMRIYPFLGEQYFVAAEQITTNYGGLDANGKTVNLDQIREEGKKKYLPKTYTFDDGAIVFKAGDKVSEEKIKRLYWAAKEVRSQFYRTVGSDKPLESGHVDDVLTMVIYNSPDEYQFNRQLYGYETNNGGMYIEGTGTFFTYERTPQQSIYSLEELFRHEFTHYLQGRYEVQGLWGQGEMYQNERLTWFEEGNAEFFAGSTRLDSVVPRKSIIGGLSNDPAKRYTAAQTLNAKYGTFDFYNYSFALQSYMYNNRPEMFDKVHDLIRANDVSSYDAYRSTLSKDNKLNEEYQSYMQMLIDNRDKYTIPQVSDEYLAQHDPKSLSDVTSDITNEAKLKDVKVTKNKSQFFNTFTLQGTYTGSAAKGEIEDWKVMNQATNDMLKRLSGKAWTGYKTLTAYFVNYRVNNAGQFEYDVVFSGLNTEEGTAVEKEPNNSFDTANPLSLNILLRGNLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 27217 - protein, 127 aa, Bacillus cereus BAG6O-2
NPTTPPTGDGGNGENPTTPPTGDGGNGENPTPPPTGDGNNGENPTAPPTDEGNNGNEPKQDGNNAGSGQTTTDNQNSKETVSENKEADKEERDLPKTGASVASTIGAGLAFVGAGLLMLFRKKKANR

SEQ ID NO: 27218 - protein, 971 aa, Bacillus cereus BAG6O-2
MKGYSKKVLVGVSFASLMLSSFPGNILAEDTKEEQVSYRNVLKMEPVGVQLPVQELAHSSKVLENKSFEKRLQFADLSQRPPEVQKESKQLAAAKTYTIAELNQLSNQALVDLLVTIDWEQITGLFQFNKDSLAFYQNDSRMQAIIDKLKQQGQAYTKDDSKGIETLVEVLRSGFYLGFYHTELSKLNERSYHDKCLPALKTIAQNPDFKLGTLEQNKVVSLYGKLIGNASSDAETVTSAANIFKQYNDNLSIFIDNRSVGNAVYDIMQGVDYDIQSYLYDTEKAPKDTLWYQKIDSYINELSRFALIGTVTAKNGWLINNGIYYIGRLGTFHSTGTKGLQVVTDTMKLYPYLGEQYFVAAEQITTNYGGKDANGKVVDLDQIREEAKKKYLPKTYTFDDGTIVLKAGDKVTEEKVKRLYWAAKEVKAQFHRTVESDQPLEKGNPDDVLTMVIYNSPAEYQFNRQLYGYETNNGGIYIEGTGTFFTYERTPGESIYSLEELFRHEFTHYLQGRYEVPGLWGQGKLYENERLSWFEEGNAEFFAGATRTDNVVPRKSMIGGLSSNPAERYTAERTLNAKYGTWDFYNYSFALQSYMYNKRYDMFDKIHDLIRKNDVTAYDAYRSALSKDANLNKEYQDYMQMLVDNRDKYNVPLVSDDYVATHAPKPVSDIAAEITAEAKLKNVSVKKNKSQFFNTFTLQGTYTGTAAKGENEDWKTITQNVNDTLKRLSAKEWTGYKTVTAYFVNYRVNASGQFEYDVVFHGINTEEGAENKAPVSVINGPYSGNVNEATSFKSDGSKDEDGKIASYKWEFGDDTVSSEQNPTHVYTKEGTYTAKLTVTDDKGAANTNTTSVTVQKKEDNSVEKESNNTFKTANKLQLNQLLRASLGNGDTSDYFEINVETAKNLQINVTKENNIGVNWVLYSEADLNNYVTYAQQQGNKLVGSYYTHPGKYYLHVYQYGGGTGNYTVEVK

SEQ ID NO: 27219 - protein, 774 aa, Bacillus cereus BAG6X1-1; identical to SEQ ID NO: 26964

SEQ ID NO: 27220 - protein, 412 aa, Bacillus cereus BAG6X1-1
MKKAKGIVKSVAVASVIMSGSLGVQATSAFADSKGTVENLQNGGKIYNSFKTTYDMKQNIKNSIKVSFIEDPYADKKIAIVTTDGSNIDAKYTINGGYYNAGLKWPSAYHTEAEITSVDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDTFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNHKALEEQMSSINNVNNQLNKGKGKLSFSMNGNQLKATSSNAGYGISYEDRNWGIFVNGEKVYTFNEKTTVGNISNDINKLNIKGPYIEIKQI

SEQ ID NO: 27221 - protein, 563 aa, Bacillus cereus BAG6X1-1; identical to SEQ ID NO: 26966

SEQ ID NO: 27222 - protein, 738 aa, Bacillus cereus BAG6X1-1
MKQLKPAISVLGSVSMALTLASPALADVKQPNPGGTVEIFKENANVKKEDKNFTLGSDGEIGSLITQNIEMANNDWDKDGISNDLEMNGYKIEFNSQTGKNEVKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTTNAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRLYTPKDKSLADKPVLSYNEVFQHVNIDTKKVNHIVNKAKSTNNVSVVSANNGTDALNNLKAGQGDRGYLHKDSVHGAFAKLQQPTLVEGSYDSVTQKIRATILPGLFGVSQEIPTTYSKKWNAPSQTVTLVKRENGFTYESRENIHPIKSEIAAHRKVTFEINDAHNLTPTQKIDIEIKANKEFEDYVVDNSGEFVTEGVPYTVASYGNTAYWGSHHAGNKWEYLWAEKSSDEKVNVIIERVGQPKPGKPIKKDEEVLIKFRNPIYSDYAYLKLQDSYIHLDQKQNASTFKFNHAYPKNFTGYHKQWNILSNGNKLKVGYLIDYMKYGNGENGTDTIAWNLSRVQ

SEQ ID NO: 27223 - protein, 183 aa, Bacillus cereus BAG6X1-1
MRKSFILLTLILVLVSFTAACTQDKKDSAVENGPIEEPTAKNENEELINFEEKEDMTRLEQGILLVGESVKGGYYLTAVQNAYLNASNDSVVVNVSVKNVRGQTIGLSELKYNLKDEKAGKAYEGKVLDQNPSGIQVTPNETVELKIAFEVPSIADEYMFYIESSLDPLGARWKIDKLQSQKN

SEQ ID NO: 27224 - protein, 222 aa, Bacillus cereus BAG6X1-1
VEEVKEEVKEPTKEVEEAKEEVKEPTKEVEETKEEVKEPTKEVEEAKEEVKEPTKEVEEAKEEVKEPTKEVEETKEEVKEPVKEVEETKEEVKEPVKEVKETKEEVKEPVKEVKETKEEVKEPVKEVEETKEEVKKPTKEVEEVKESATGLDQEPKENNQVVEKEGRKADTLNKQHTNKSEEGKKSLPSTGGEASTSTLLSGITLVLSTLSMFVFRKRLFKK

SEQ ID NO: 27225 - protein, 333 aa, Bacillus cereus BAG6X1-1; identical to SEQ ID NO: 26954

SEQ ID NO: 27226 - protein, 103 aa, Bacillus cereus BAG6X1-1; identical to SEQ ID NO: 26973

SEQ ID NO: 27227 - protein, 2980 aa, Bacillus cereus BAG6X1-1
GDAQQPAVEKKNGDAEQPVVEKKNADAQQPTENPVENPDPSPKQITENILTGVKLTDKDGKPFNDTDNRPNPDSTANIEFTWEILESLKVKKGDYYTFQLPEYFIVHNTITETLVDGTGQVIGEFVVGLDGKVTMTFNEYVEDHPNIAGDLKVGTEFNKVKITGTTEQKIPFPIKEKDVIIELDFKPNVKESVNKKGVPDRPINTNQINWKVEMNKTKDKLTNAVFQDNIPNGASLNEDSIKVYYLEVDINGNTTRGAEVPKEEYELTSSPDKLNIAFKKETNKAYEIEYATKITDESITSFKNNAKVSSDNQDSVSTNATVTVSRGTHLEKTSKYNPKTQTIEWTITYNGDQRDIKKADALLKDVLDKSHKVDKNSIVVKNASYDNTGKLVTGDNATNFTVKETDDGFDLQFTEDINSAYVITYTSKATSDVIKDGEIENKIIADGKWSKTNKVTLKQQNIIKKHNKKDTDYNKKTTTWTIIVNDNNYVLNDAVITDTFDFGGLALQENSFKITDGSRELNPNLDYTLHVTDKGFEVKLTGDYKSNMDKTLTITYTTDFNYENLSKEKDNKSFKNTANLSWIDINDNKNNSSSDDTFDPDYYTKGNGFKYGSYNAQTKEIKWDIGFNYNNRTIKDPSIVDVLRDNQKLIPESIEIRHMKLTGGAHGFELGDPVPSSEYTIETPTKDNNNTLTVHFKNEINSAYYISFKTSLAGEQINKRYDNYADVKDGSKTVTTIHGAFEIKNGGSGVTKTAKQNDKYIDWSISINASQSTIENAVVTDDPTDNQILDEKSLHLYPTTVAVDGTLTKDTTNELKEGTDYKLKVTTDNNTGKQQFKVDFLHTIDHAYILEYRSLINADNNETVSNKVKITGNRLTLTQVETTEEKVVKVSSGSGGGSANKGRGSLQIIKVDDKDQKVRLAGAEFTLYDQTGTTAIRPITTGDDGVAKFNNLRRDKYMIKETKAPKGYVISKELREGILVELGSEEITKYTLTNKKFVGKVVLTKTDAKSGEKLEHAVFSLLDQNKQVIPEHKKLTTNDKGQITVDNLKPGTYYLQETTAPEHYKLDGRLIEFKIEEDQTTVINRPATNSLIPGSAILTKVDKDGKTLAGAEFSVRDRHNNVIRGYEKLTTNDQGQIEAKDLLPGDYQFVEEKAPKDYDIDKKPIEFTIVKSQKKAVTVTATNHLIKGGVTLTKVDDIDGTALKGAVFKIVDAHDEKKVIRENVKTGADGTVTVKDLEPGTYKFIETKAPQDYTLNTDPITFTIDKSQQSLATVTATNSLKTGEVELLKVDEFGEKKPLEGAVFKLVDANNNEVPPHTNLTTDKKGKFKVSNLRPGTYKFIETSAPEHYVLRAEPIEFTIDRSQKETLLVKAENALKPGDVELTKVDDIDGTALEGAVFKIVDAHDEKKIIRENVKTGADGKAIATGLRPGDYKFIEVTAPKYYDKNTTPIEFTIKESQGTSPITVTAKNSLTKGGIELTKVNAADERETLEGAVFKIVNRDTNEDVRTDLVTNSKGMLAVDDLRPGNYKLIETKAPTYYDVNVESIEFTIEKGQQKLLPLTFKNSLTKGKVKLIKEDDVESSIALAGAVFTLKDATGKEIAKDLKTDDYGVLVIPDLAPGDYQFIETSAPEHYKLDQTPIKFTIKKGSKDDLPVPVIVKNSLLTGGVTLTKVDDVDGVTLKGAEFIIVDAHDTKKVVRKGLTTDEQGKVSASDLRPGDYQFIEVKAPKDYDLSKNPIPFTIGKSQQENITVTATNSLTKGGVILTKIDDIDRTMLKDAVFKIVDMDGKEVRTNLVTNDNGEISVSNLRPGDYQFIEIAAPEHYVLDETPIPFKIERNQTAKITVTGKNTLKKGSVELTKIDDIDTDTKLANAVFNLLDADGELVEEGLKTNDEGKIIVENLRPGTYQFVETIAPEHYDLNKKPIEFTIKKSQTETLHVTAKNALTKGAVELSKVDDIDGTTLEGAVFNIVDMRGTVIHKDLVTNGKGKIEINDLRPGDYQFIETEAPKHYVLDETPINFTIEKGQKKTISLTANNSLKQGSIELIKVDDLNDQTKLADAVFNLLDQNGKVLKTDLKTNSEGKIIVENLRPGTYQFVETTAPKHYDLDKKPIVVTVEKSQKDIATVTMKNSLTKGGVDLTKVDDVDGTTLEGAVFNIVDMKGTVIREKLTTNSQGKISVSDLRPGDYQFIETNAPKHYDLNKEPIPFTIEKGQAEPISVTAKNSLTKGAVELSKVDDIDGTALEGAVFKIVDDKNNDVRTDLTTVKDGKISVPDLRPGDYQFIEIKAPEHYKLDSTPLKFTIKKSQAEKLQVTATNSLIEGAVELIKVDDINPDTKLADAVFNIIDAKGKVVRTNLTTDKDGKISASNLRPGDYQFVETKAPKDYDLNKTPIPFTIEKSQTAHVSVTAKNALTKGGVELTKVDSLDAKETLEGAVFKITDMNGNDIRKNLVTNKDGKIIAKDLQPGDYQFIETKAPKHYDLNEEPIKFTIERSQTKHVFVTATNSLTKGSVELIKVDDVEENTTLEGAVFKIVNKDGHDVRTDLTTDKNGRLVVDELPPGDYEFIETKAPNHYDLNETPIKFTVKKGQEKIASVTATNSLTKGAVELSKVDDFDGSVLKDAVFKIVDMNGHDVRSNLTTDKDGKISVSDLRPGDYQFIETKAPKHYDLNQNPIKFTVEKSQTTKASVTATNSLTKGAVELIKLDDVDNSTLEGAIFKIVDMNGNDVRSDLTTDKDGKISVSDLRPGDYQFIETKAPTGYDLSAKPIPFTITKGQSQVTSVTALNSLTTGSMELTKVDMDHHGTLEGAIFNILDQDGKVVREGLQTDGHGKLIVNDLKPGNYQLVETKAPEGYQLDASPINFTIKKAQATPLQITVSNKKIDSSSGGDDKPVTPPNKEEETGKETSEELEKGNPETHGKGTSEELEKENPETQINKQQDDRNKGKELPNTGHKNDPTQTVGILLLLAGLLSILATKRKKYY

SEQ ID NO: 27228 - protein, 431 aa, Bacillus cereus BAG6X1-1; identical to SEQ ID NO: 26715

SEQ ID NO: 27229 - protein, 971 aa, Bacillus cereus BAG6X1-1
MKGYSKKVLVGVSFASLMLGSFQGSTLAESTKGEQVSYRNVLKMEPVGVQLPVQELAHSSKVLESKSFEKRLQFADLSQRPPEVKKESKQLAAAKTYTIAELNQLSNQQLVDLLVTINWEQITGLFQFNKDSLAFYQNDSRMQAIIDKLKQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALIGTVTEKNGWLINNGIYYTGRVGTFHSTGTKGLQVVTDAMKMYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSDIAAEITAEAKLSNVSVKKNKSQFFNTFTLQGTYTGTTAKGEYEDWKTITQNVNDTLKRLSAKEWTGYKTVTAYFVNYRVNASGQFEYDVVFHGMNTEEGAVNKAPVAVINGPYNGNVNEAISFKSDGSRDEDGKIVAYKWEFGDGTVSNEQNPTHVYTKEGTYTAKLTVTDDKGLTNTVTTNVTVQKKEDNSVEKEPNNSFQTANKLQLNQVLRASLGNGDTSDYFEINVETAKNLQINVTKENNIGVNWVLYSEADLNNYVTYAQQDGNKLVGSYYTYPGKYYLHVYQYGGGTGGYTVEVK

SEQ ID NO: 27230 - protein, 372 aa, Bacillus cereus BAG6X1-1; identical to SEQ ID NO: 26970

SEQ ID NO: 27231 - protein, 587 aa, Bacillus cereus BAG6X1-1
MGRKYVIRILALLSVISLFFNLMLPKASAEIEKIPSLKTTATNKADGGKEMHAKESITIQDKVEYTNLVVGKEYTVKGKLMNKVINKPLLIDGKEVTAETKFTAKETNGFVTLDFPFVGAEQQGREVVVFEELYEDGVLVATHADINDVGQTVRFVEPTIKTTATNKADGGKEMHAKDSITIQDKVEYKDLIVGKEYVVKGKLMNKVTNKPLLIDGKEVTTETKFTAKEKNGFVTLDFPFVGAEQQGREVVVFEEVYQDGVLVAIQSDINDVGQTVRFVEPTIKTTATNKADGGKEMHAKDSITIQNKVEYKDLIVGKEYVVKGKLMNKVMNKPLLIDGKEVTAETKFTAKEKNGFVTLDFPFVGAEQQGREVVVFEEVYQDDVLVAVQSDINDVGQTVRFVEPTIKTTATNKADGGKEMYANEFVTIQDKVEYKDLIIGKEYVAKGKLMDKATKKPLLVDGKEVAVESKFTAKEKNGSITLDFTFNASKLQGKEVVVFEKLYQDDILVAINVDIEDADHTVKFKAEKLGKPQQEKPQLEQPKTGKTSKAGTLPATGGNMYFTWFSVGAGLLLLTLGAILFMKRRNA

SEQ ID NO: 27232 - protein, 179 aa, Bacillus cereus BAG6X1-1; identical to SEQ ID NO: 26965

SEQ ID NO: 27233 - protein, 72 aa, Bacillus cereus BAG6X1-1
EKPETTDPEKPGTMDSEKPGTTDSEKPGTMNPEKPEKELPKTGQKMPVEPYMGALLIMMSFGLLVLGRKQQR

SEQ ID NO: 27234 - protein, 209 aa, Bacillus cereus BAG6X1-1; identical to SEQ ID NO: 26963

SEQ ID NO: 27235 - protein, 455 aa, Bacillus cereus BAG6X1-1
MNNRFLKQLQNMKMNKKSLGAVALTAGIIGTTLIPQNAYAHGFVEKPGSRSALCSPTYGALNVNCGSVMYEPQSLEAPKGFPQGGPLDGQIASAGGKFGGILDQQTANRWFKNTITGGENSFTWKYTAPHLTSKWHYYITKKGWNPNKALTRADFEPIGTVQHDGSAASNHLTHKINVPTDRSGYHVILAVWDVADTANAFYNVIDVNLINDVKPDIEAPSSPNGIQTQNVTANSIELTWNASTDNIGVKGYQIFRNGVMIDTVPGTHFIDKKLQPSTEYSYTVKAIDVAGNVSKESAALSVKTKVEAPDTEAPTQPKGLHSMGTTASSVDLMWSPSDDNIGVDRYDIYRETEGSMKKIATSNTTSYMDKNLLSNTTYKYVVKAVDVVGNESVQSDIFTITTKTESASYEGWDAKKAYEKGDRVLHEGKVYEAVQSYQGNGDPNWIYALSLWKTV

SEQ ID NO: 27236 - protein, 458 aa, Bacillus cereus BAG6X1-1; identical to SEQ ID NO: 26968

SEQ ID NO: 27237 - protein, 965 aa, Bacillus cereus BAG6X1-1
MNKKSKINKVMLSISTMALSLGAIQTNVSAEEKVPYNVLHSKPVGIEKPVDEVGQISKAEETLSFQERLKVGDFSQRPASIMKSSEVKQMKESYSMADLNTMNNQELVETLGSIKWNQITDLFQFNEDAKAFYKDKGKMQAIIDELAHRGSTFTKDDSKGIQTFTEVLRSAFYLAFYNNELSDLNERSFQDKCLPALKAIAKNPNFKLGTNEQDAVVSAYGKLISNASSDVETVQYASNILKQYNDNFHTYVEDRMKGQAVYDMMQGIDYDMQSYLFETRKEAKDTMWYGKIDGLINEINRIALLNEVTPENKWLVNNGIYFASRLGKFHSNPNKGLEVVTQAMHMYPRLSEPYFVAVEQITTNYNGKDYSGNTVDLETIRKEGKEQYLPKTYTFDDGSIVFKTGDKVSEEKIKRLYWAAKEVKAQYHRVIGNDKALEPGNADDVLTIVIYNTPDEYQLNRQLYGYETNNGGIYIEETGTFFTYERTPEQSIYSLEELFRHEFTHYLQGRFEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDSKLNKEYQEYMQQLIDNQDKYNVPEVADDYLAEHAPKSLTAVEKEISDTLPMKEAKMTKHSSQFFNTFTLEGTFTGSVTKGESEDWNEMSKRVNEALEQLAQKEWSGYKTVTAYFVNYRVNSSNEFEYDVVFHGIAKDDGENKAPTVNINGPYNGLVKEGIQFKSNGSNDEDGKIVSYLWEFGDGSTSAEVNPIHAYEREGIYKVALRVKDDKGKESRNETTVTIKDGSLTELEPNNRPEEANRIGLNTTIKGSLIGGDHTDVYTFNAASTKNIDISVLNEYGIGMTWVLHHESDMQNYAAYGQANGNHIEAKFNAKPGKYYLYVYKYDNGDGTYELSVK

SEQ ID NO: 27238 - protein, 503 aa, Bacillus cereus BAG6X1-1
MFNKKIVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQSVKGVKEVTTKISEKDAIQKSMAYVGEASEQNLWAPTEKEFGYIVEEGIARPAYKVVVHSNNPFGAWETFIDAENGKLIKKVDINRKAEGTGKVFLPNPVVSSGSKVGLKDNNDADSTALTNQLKTVTLKGLDGTGFLIGEYVTISSKSKTKSTNLQFNYTRANDSFEDVMSYYHIDTIQRYIQGLGFKNINNRSIKVNVNGTTADNSFYSPTTKALTFGTGGVDDAEDAGIIAHEYGHSIQDNQVPGFGSSVEGGAMGEGFGDFLGATYEDAVSTTGYGKACVGEWDAAAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 27239 - protein, 743 aa, Bacillus cereus BAG6X1-2
MKDSKEFKRIQYVRYADDFLIGIIGSKKDAETIKKDLTLFLQEKLLLELSQEKTLITHSSKTARFLGYDISIEIRIEYVREEDTNKDIDMQLYWETDKLKKEILPQKYIFSTDSSKKERTAANKSLANKNLFGYELSDDEEEENIDLDTDDDSIPDVWEMKGYTIKGMIAVEWKDSLTAQGYKKYVSNPFKSNTAGDPYTDYEKAANKMDSATNKVARNPLVASYPSIGITMDNFTISKNNDISQTTGEDTSTSLTKGTSNSTTYETSKGIDVTATESVEVSMTPSASVSLSVSKTFNESNSTTATVDESTTASTGNTWSESIGINTAESAYLGARVRYINTGTAPAYQLKPDVTLGMGTNHTLTSGIVDEKYKANILNPDSVFPKKESLPILVNKHENMPISINFDQLKELEKKKELRLDSTQYDAVVSPNGIGAMEKWEKFTNDIEHTTAKMIFVTPDEAVERRIAAQTDPTDPEDKNPEIDVEQALEIGFEKLKKTETGYQYGDYTFDKLHMIYDEDTAEKFKEQASHQKDEKLDPNKMKLNAKMNMQISPDGLVTNTKTKKTYYFENGRMADFYDGAEDNSNPLGEWTNSKLELDGKNSNSGIGNYYSYGDIGEGTSYTTLFFKDEILKKINPNAKYNVSVSLKEDPLFPNPPENKMVKIQLLDESGLSFATEQSLVDSTGYRRTTIASPFSSGKMVGIRITFVGYPGRKAAIRMDDLAITEVGVKGKLEDVIKIQMKK

SEQ ID NO: 27240 - protein, 91 aa, Bacillus cereus BAG6X1-2
MLEITFPAKNHGKKEAYFGSEELKIADANGNQFKEYFGADDAFMNENISPGNQITGKMYYDVAESEKYIDTYKPNFTFDEKSVKFEFTAAQ

SEQ ID NO: 27241 - protein, 165 aa, Bacillus cereus BAG6X1-2
MKTMTKKMISALCMTSILFSAGCTGVKETKKESVERQSSQTEIGKEKGSNIKKMKVTAAKIIKDETVSEQEKVVQVQFDIKNEGTEDFGIGAGDFIIEDEKGKTYSLYGKEDNFGGVIPAGKNLKGNGYYSVAKETKELKVVYQPVVKQATDEKTIEWKIGNPKK

SEQ ID NO: 27242 - protein, 112 aa, Bacillus cereus BAG6X1-2
MKRKRLILSFGIMVIFFVGPVVSHATESQDYQSNGKVSFFGKYVNPGSEGTSESGNSSSSVSGEKDPTHALEKIPQTGDTSHFEITILGALFTVSAIFLIRKYKNIQWRASL

SEQ ID NO: 27243 - protein, 431 aa, Bacillus cereus BAG6X1-2
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGLKSFYNIKR

SEQ ID NO: 27244 - protein, 769 aa, Bacillus cereus BAG6X1-2
MKKLKPILGAVSSLTMALTITSPALAETKPEQGGKVETFKEDANLKEGQNVIYGDAGKKGIMIMEKPQENNDWDDDGIPNDVEEKGFKIVFNEKTGKNEAQLYDLVKDFGEKRFITNPKSANSDGDPFTDSYEVEHYDSDSDIDFNPMIANVPNLQIAVKRIDITPVASITDSNGESRTKSWEKSLSVQHSFNVGLAVEGGAEGSAVGPVPSGKGSLNVGYGYSNTKTETESISNSFDWSTATTVDSAKAANVRFHLEYKNTGTASAGDVSPHFNIRLGNKIINTVKATQDRYKANLLTTAKGGNNKTEILMDSIESQADVKISLTLDELKAVEQGAPLSIEVLPTSTMNVYTMKDGQFVNLGDWSHFASNVNASTTLVETNYGSIPKYRVYTPRTGKENPANINHNLSLDELFAHTGIADKGWVANYVVNGRLNEDRVRYGPDRTLFERGKNLGFFDNRALQPTLSYSSYDYSKKKIYASVIPGIFNLNKEIFVTVRNKKGESQKVTLVRNQNSNVYESKENEPVDIAVNRASLGESHAKFELIDVKDNKTEVFTPLVSNKSYLDAIDKIVVDNSGEPIVEGKQYYLKSATNFTNGVNESWSAGTLSQSINGRYVHFSLKGNNWDGLRLGPIQQAIHGPDVQATPVILERKGKSRPEEPFKKDEEVFMKFTNSSHSNYQYLNIGNGYDYSWLDTDHNKSTIKLDKLTNQKNFYIKSDSNYITSRENQWTSSVADNGIAPLVGAGERVLKSEHTTSPGNYHQWELESIK

SEQ ID NO: 27245 - protein, 878 aa, Bacillus cereus BAG6X1-2
MVKYSKFSKLIIGVGLVTISCSGLQIQAETKEKNVKNVLQMEPVGLRKTFDELAHPSNVQENGSFTKRLKLADLSQRPPMPNENAKQLVEEKKYSMAELNQLSNKQLTDLLVTIQWYQIPELFQFNNDSLKFYQDDSRMQAIIAKLAEQGQAYTKDDSKGIETLVEVLRSGFYLGFYHQELSKLSERVYHDKCLPALKTIAKNPNFKLGTTEQNKVISSYGMLIGGASADVEVIQYAGEIFKQYNDNLSTFIEDRTKGDAVYNLMKEVDYEVQSYMNATGKEPKDMLWYGKIDGFINEINRFALIGTVTDKNGWLINNGIYYASRFGKFYSTPTKGQQVVTEAMGIYPYLGQQYFVAAEQIATNYGGIDANGKTVNLDQIREDGKKHYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPQQSIYSLEELFRHEFTHYLQGRYEVPGLWGQGEMYQNERLTWFEEGNAEFFAGSTRLDSVVPRKSIIGGLSNDPAKRYTAAQTLNAKYGTWDFYNYSFALQSYMYNNRPDMFDKVHDLIRTNDVPGYDAYRSTLSKDNKLNEEYQTYMQMLIDNRDKYTIPQVSDDYVAQHAPKPLSEVASDITNEAKLKNVKVIKNKSQFFNTFTLQGTYTGSTAKGENEDWKVMNQATNDMLKHLAEKEWSGYKTLTAYFVNYRVNDAGQFEYDVVFSGVNTEEGTAVEKEPNNSFDAANPLSLNTLLRGNLSDQDQVDRFSIDVKDPKDLQITVTNEQSLGLNWVLYSESDLNNYVTYATKRDGNKLLGNYNAKPGKYYLSVYKYGGGAGNYTVEVK

SEQ ID NO: 27246 - protein, 503 aa, Bacillus cereus BAG6X1-2
MLNKKMVAMAMTVPLVMGTISTASALEKQQQVKVEAYSPQKKAIEYLKGNADQYGLKPDLSDLQYISTTETSVASYVRFQQVVNGAPVFSKQITVTINGQGQGVLAVSDYQPVQNVKEITKKISEKEAEQKSMAYVGGESEQNLWAPTEKEFGYIIEEGIAIPVYKVVVHSNKPFGAWETFVDAENGKLIKKVDINRKAEGTGKVFLPNPIVSSGSLAGLKDNKDADSAALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACIGEWDATAYSSSDPTCLRRLDTNKVYPKDITNEVHNDGEIWAQGQYEMAQAFGRDVATKIILQSHWSLTPNAKFRDGAKAIKQADALLYGGQHAADIDRIWAARGISTN

SEQ ID NO: 27247 - protein, 179 aa, Bacillus cereus BAG6X1-2
TPEEEKIEEETTEELEESVKPEEPKVTEEPNMLEKPEVTDKPEIWVKSEEEKVEVETTEEWKEEGLEVKEQPEVPNKPEVKEQPGVPSKPEVKEQPEVSNKPEVKEQSEVLNKPEAQGKVEAQSKQDVQNKSEVPSSKENNKQSKLLPQTGGVSTESTSIIAGMFALILGAMMFRRKKN

SEQ ID NO: 27248 - protein, 163 aa, Bacillus cereus BDRD-Cer4; identical to SEQ ID NO: 26501

SEQ ID NO: 27249 - protein, 949 aa, Bacillus cereus BDRD-Cer4
MALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDTYTVPEVADDYLAEHETKSLAAVKKEISDTLPMKDTKMTKHNSQFFNTFTLEGTYTGSVTKGESEDWKEMSKRVNESLEQLAQKEWSGYKTVTAYFVNYRVNSSNEFEYDVVFHGIAKDDGENKAPTVNINGPYSGLVKEGIQFKSDGSNDEDGKIASYLWEFGDGSTSVEVNPVHVYEREGSYKVSLRVKDDKGKESRSETTVTIKDGSLTESEPNNRPEEANRIGLNSTIKGNLIGEDHTDVYTFNVASAKDIDISVLNEYGIGMTWVLHHESDMQNYAAYGQANGNHIEAKFNAKPGKYYLYVYKYDNGDGTYSLSVK

SEQ ID NO: 27250 - protein, 333 aa, Bacillus cereus BDRD-Cer4; identical to SEQ ID NO: 26499

SEQ ID NO: 27251 - protein, 180 aa, Bacillus cereus BDRD-Cer4
MGYSSSAFAAKSPNDTKNCGHFKSQQDAQAFWDQNGYGVGNDPHRLDNDKDGIPCEDYKYPKSTNTTTENKETTKPQEQPKQENTKQENTKQEPVKQENTKQENSKQNNQTTNNKQEQTKPQTTAKETKKNTNTVVKKETKKQGEKLPNTASNGVTMMLASLGLALAGSVLMFRRKKTNA

SEQ ID NO: 27252 - protein, 201 aa, Bacillus cereus BDRD-Cer4
MKVENEQLDKGSVEITKMAAESKEVLSGAVFEVHDEKGKVVVKVTTDKDGKAKITDLSVGNYTLVEVEAPKGYEKLTNPIPFEITNGMINAVQLEVLNKLNHLAPPGPETPDPEKPGTPDPEKPGTPDPEKPGTPNPEKPGTPDLEKPGTPDPEKPGTPNPEKPEKELPKTGQKMPVEPYMGALLVMMSFGLLVLGRKQQR

SEQ ID NO: 27253 - protein, 336 aa, Bacillus cereus BDRD-Cer4; identical to SEQ ID NO: 26375

SEQ ID NO: 27254 - protein, 179 aa, Bacillus cereus BDRD-Cer4; identical to SEQ ID NO: 26496

SEQ ID NO: 27255 - protein, 503 aa, Bacillus cereus BDRD-Cer4
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKARTKSTNLQFNYTRANDSFEDVMSYYHIDTLQRYIQSLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 27256 - protein, 163 aa, Bacillus cereus BDRD-Cer4; identical to SEQ ID NO: 26493

SEQ ID NO: 27257 - protein, 893 aa, Bacillus cereus BDRD-Cer4
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLMAQGGTHNGVNVNGIGEDRMFDIFYYANTDELNMTSNFSELKLACLKVATNKYGANSIEVQAVQNAFDAAKITGTVKENEKTAENQAPELTVPFTITLRVGDTFDPMRNVKAVDKEDGDLTNKVKHKGDVDTSKPGTYIVEYMVVDSQGRNATATQTVIVEGNGETSDLEPKLTVPVGATIHVGDSFVPMAEVLAIDKEDGDLTSKIKVDGEVDTTKAGTYVLTYTVTDSKGHEVTAKQTVTVKVREEVKNDKPILKVPATTSITEGDQFDPLVGVSATDKEDGDLISKVAYEGTIDTTKAGTYEIIYSVRDSVGNEVNAIQKVLVKDKETSKANGLANKENKSNISNNSNSDKKEYTYKELPKTGVSTTNSAAIGILIIIVGTVLTLVRKFRKIQK

SEQ ID NO: 27258 - protein, 563 aa, Bacillus cereus BDRD-Cer4
MIEVVKGIREMKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGAVFSLFKKDGTEVKKELATDANGHIRVQGLEYGEYYFQETKAPKGYVIDPTKREFFVKNSGTINEDGTITSGTVVKIEVKNNEEPTIDKKINGKLEALPINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDSANKNKLKGAEFVLKDNNGKIVVVAGKEVTGVSDENGVIKWSNIPYGDYQIFETKAPTYTKEDGTKTSYQLLKDPIDVKISENNQTVKLTIENNKSGWILPVTGGIGTTLFTVIGLTLMLTAAFVFFRKKFARN

SEQ ID NO: 27259 - protein, 117 aa, Bacillus cereus BDRD-Cer4
MDSELKLKGAVFQVLDKEGKEVSRLITDEKGKVISNQLAIGKYTIKEIKAPNGYMLLRDPIEIEITEAVKTQKITVKNAKNNWVIPNTGGSGTTIFYVIGIMLMFAVLYFYKKNRIL

SEQ ID NO: 27260 - protein, 291 aa, Bacillus cereus BDRD-Cer4
MASITDAIAPFPDPLNITKRYAISIGPGNYIEPLIHLKANVQLVGTSTLLTRLQIPFDINDPSWFDLNFSQDPRSGFVNLTLLSGPLDFNFQTAQSVSGKLFFVSVNITPTPIFTALSTSVNQVNIRDSMLSGGYTQNGINMAMFASFVSSGNITINSQATTDTQVNLVGGGINGNVIINVLPGHIPIDPLNLTSFAITENIFNPSPNSGNLFVNGANNVITRVRATVDSLPIRSRINLIGTSTSLIRVDDAFDLAYTPINPANWAPLPPTTVQEALDRIAALMAITIGTP

SEQ ID NO: 27261 - protein, 457 aa, Bacillus cereus BDRD-Cer4
MNMNNRFLKQLQNMKMNKKSLGAVALTAGIISTTLIPQNAYAHGFVEKPGSRSALCSSTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVIGTHFIDKKLQPSTEYSYTVKAIDAAGNVSKESTALTVKTTVEIPDTEAPTQPKGLHSMGTTASSVDLMWSPSDDNIGVDHYDIYRETEGSMKKIATSNTASYMDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 27262 - protein, 878 aa, Bacillus cereus BDRD-Cer4
MVKYSKISKWILGVGLVTITCNGLQIQAETKEKNVKNVLQMEPVGIQKSVDELAHPSKVQENESFTKRLKLADLSQRPLAPTDNIKPLAEEKKYSMAELNQLNNKQLTDLLVTIKWYQIPELFQFNSDSLKFYQDDSRMQAIINKLAEQGQAYTQDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNQLNEEYQSYMQMLIDNRDKYTIPQVSDEYLTQHDPKSLSDVTSDITNEAKLKDVKVTKNTSQFFNTFTLQGTYTGSVAKGEVEDWKVMNEATNDMLKRLSGKEWTGYKTLTAYFVNYRVNNAGQFEYDVVFSGVNTEEGTAVEKEPNNSFETANPLSLNILLRGTLSNQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 27263 - protein, 380 aa, Bacillus cereus BDRD-Cer4; identical to SEQ ID NO: 26482

SEQ ID NO: 27264 - protein, 91 aa, Bacillus cereus BDRD-Cer4; identical to SEQ ID NO: 26481

SEQ ID NO: 27265 - protein, 837 aa, Bacillus cereus BDRD-Cer4; identical to SEQ ID NO: 26480

SEQ ID NO: 27266 - protein, 824 aa, Bacillus cereus BDRD-Cer4; identical to SEQ ID NO: 26479

SEQ ID NO: 27267 - protein, 412 aa, Bacillus cereus BDRD-Cer4; identical to SEQ ID NO: 26477

SEQ ID NO: 27268 - protein, 1062 aa, Bacillus cereus BDRD-Cer4
MTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLIKVQAIAYRGTDTVQNATVLLERNEEKLSSDLAVNWEAAGSLKIKKVGENGEVLAGAVFEVFNVNNESVGKITTGADGMAELNNLPIGTYTLKEIKAPTGYVSDDKPQTIEVKTGETGAVQIVNNKVKGSIEIKKLSDSGKILPNVEFTVFTEDGKEVKKVVTKENGIANVEGLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIETKATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPFIKTTATNKADGSKELDASKSVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEQPNSGKNTTTPEQPNEQVKEQPQLKKEIQSKIGWLPQTGTNLTSWISMAAGALLLIVGGVIFLKRKNA

SEQ ID NO: 27269 - protein, 971 aa, Bacillus cereus BDRD-Cer4
MKSYSKKMLVGVSFASLMLGSFQGGSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGHPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDVNLNKEYQDYMQMLVDNREKYNVPLVSDDYLANHASKPVSDIAAEITAEAKLKNVSVKKNKSQFFNTFTLQGTYTGIAAKGEYEDWKTITQNVNDTLKRLSAKEWTGYKTVTAYFVNYRVNASGQFEYDVVFHGINTEEGAENKAPVAVINGPYSGNVNEAISFKSDGSKDEDGKIISYKWEFGDGTVSNEQNPTHVYIKEGTYTAKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYSGGTGNYTVEVK

SEQ ID NO: 27270 - protein, 297 aa, Bacillus cereus BDRD-Cer4
MSSWSNNVNGYCGCNNQNGVHVDSCCFSCDGTVPKVGPTGPTGATGGTGPTGATGATGGTGPMGATGVTGDTGPTGATGITGATGPTGATGITGATGPTGATGPTGATGSTGATGATGSTGVTGPTGATGSTGPTGTTGSTGPTGATGATGSTGSTGATGTSITATYAFANNTSGTAISVVLGGTNVPLPNNQNIGPGITVSGGNTVFTVANAGNYYISYTINITASLLVSSRITINGGALAGTINSPAVATTSFSATIITTLAAGDAISLQLFGLLAVATLSTTTPGAVLTIIRLS

SEQ ID NO: 27271 - protein, 1249 aa, Bacillus cereus BDRD-Cer4
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGPGGVQGLQGPIGPTGATGAQGIQGIQGLQGPIGATGPEGSQGIQGVQGLPGATGPQGIQGAQGIQGTPGPSGNTGATGATGATGQGITGPTGITGPTGITGPSGGPPGPTGPTGATGPGGGPSGSTGATGATGNTGATGSTGVTGATGSTGPTGSTGAQGLQGIQGIQGPIGPTGPEGSQGIQGIPGPTGVTGEQGIQGVQGIQGATGATGDQGPQGIQGVIGPQGVTGATGDQGPQGIQGVPGPSGETGPQGVQGIQGPMGDIGPTGPEGPEGLQGPQGIQGVPGPVGATGPEGPQGIQGIQGPVGATGPQGPQGIQGIQGVQGITGATGVQGATGIQGIQGEIGATGPEGPQGVQGAQGAIGPTGPMGPQGVQGVQGIQGATGAQGVQGPQGIQGIQGPTGATGDMGATGATGEGTTGPTGVTGPTGVTGPSGGPAGPTGPTGPSGPAGVTGPSGGPPGPTGATGATGVTGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGSQGPTGIQGIQGEIGPTGPEGPEGLQGPQGIQGVQGPVGATGPEGPQGIQGIQGVQGATGPQGPQGIQGIQGVQGITGATGAQGATGIQGIQGEIGATGPEGPQGVQGIQGAIGPTGPMGAQGVQGIQGIQGATGAQGVQGPQGIQGVQGPTGATGDTGATGATGEGTTGPTGVTGPTGVTGPSGGPAGPTGPTGPSGPAGVTGPSGGPPGPTGATGATGVTGDTGATGSTGVTGATGATGVTGLQGPQGIQGVQGEIGPTGPQGIQGPQGIQGVTGATGAQGPQGIQGPQGDIGPTGSQGIQGPQGPQGIQGATGATGAQGPQGIQGPQGEIGPTGPQGPQGIQGPQGIQGPTGATGATGATGPQGIQGPQGIQGPQGIQGPTGATGATGSQGPTGDTGPTGAGATGATGATGVSTTATYAFANNTSGTAISVLLGGTNVPLPNNQNIGPGITVSGGNTVFTVANAGNYYIAYTINLTAGLLVSSRITVNGSPLAGTINAPTVATGSFSATIIANLPAGAAVSLQLFGVVAVATLSTATPGATLTIIRLS

SEQ ID NO: 27272 - protein, 68 aa, Bacillus cereus BDRD-Cer4; identical to SEQ ID NO: 26816

SEQ ID NO: 27273 - protein, 95 aa, Bacillus cereus BDRD-Cer4
MKPEDPKEPKEPEVKPEDPKEPKEPEVKPEDPKEPKEPEVKPEVRLEKLIKEPQVKTERELPKTGAASPWMMSVGAGISFLVGGVLFVLGRRRKQ

SEQ ID NO: 27274 - protein, 431 aa, Bacillus cereus BDRD-Cer4; identical to SEQ ID NO: 26472

SEQ ID NO: 27275 - protein, 84 aa, Bacillus cereus BDRD-Cer4
MYSVSFSIVFVIQAISSSILNLTINDSIQFAIETRVGGASGVRATSARTDLLPLNQGDVLRVRIREATGDIIYSNASLVVIKVD

SEQ ID NO: 27276 - protein, 234 aa, Bacillus cereus BDRD-Cer4; identical to SEQ ID NO: 26488

SEQ ID NO: 27277 - protein, 127 aa, Bacillus cereus BDRD-Cer4
MGPVGPSDGPVGPVGPVGPVSLLGPVGPVSPVEPVGPVGPVGPVGPVGPVGPVSPVSPVEPVGPVGPVEPVGPVGPVEPVGPVGPVEPVGPVGRVNGGIAGKVGPSKSGFIKVEDNNSSIIISPLKN

SEQ ID NO: 27278 - protein, 949 aa, Bacillus cereus BDRD-ST196
MALSLGAIQTNVSAEEKVPYNVLHSKPVGIEKPVDEIGHASKAEETLSFQERLKVGDFSQRPASITKNSAVKQAKESYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLSEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGATRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHTSQFFNTFTLEGTFTGSVTKGESEDWKAMSKRVNEALEQLTQKEWSGYKTVTAYFVNYRVNSSNQFEYDVVFHGIAKDDGENKAPTVNVNGPYNGLVKEGIQFKSDGSNDEDGKIVSYLWDFGDGSTSTEVNPVHAYEREGTYKVALVVKDDKGKESRSETTVTIKDGSVTESEPNNRPEEANRIGLNTTIKGSLIGGDHTDVYTFNVASAKDIDISVLNEYGIGMTWVLHHESNMQNYAAYGQANGNHIEAKFNAKPGKYYLYVYKYDNGDGAYALSVK

SEQ ID NO: 27279 - protein, 333 aa, Bacillus cereus BDRD-ST196
MKGKLLKGVLSFGIGLAALYSGSSVQAEMSTNQNDTLKVMTHNVYMLSTNLYPNWGQNERADLIGAADYIKNQDVVILNEVFDNSASNRLLGNLKKEYPNQTAVLGRSSGSEWDKTLGNYSSSTPEDGGVAIVSKWPIVEKIQYVFEKGCGPDNLSNKGFVYTKVKKNDRFVHVIGTHLQAEDNMCGQTSPASVRTKQLQEIQEFIKNKNIPNNEYVLIGGDMNVNKINAENNSDSEYASMFKTLHASIPSYTGHTATWDATTNSIAKYNFPDSPAEYLDYIITSKDHANPSYIENKVLQSKSPQWTVTSWLKEYTYNDYSDHYPVEATISMK

SEQ ID NO: 27280 - protein, 182 aa, Bacillus cereus BDRD-ST196
MNKKLLTSLLCSTFLFGLSACSSHDTSSSNTKNEQETSKETKNDELSNKDPQKELPTHGDSSDVYISIRSADSLDVIGNGEVKAQGVFKVLDVAVYNRQEEPITLNINNFKLIDGTGREYHISNESQLVLKAANTATFKFGVLNPNENSEGNIVFDVPKNTQGLTLKINGDMLGEGIELKVE

SEQ ID NO: 27281 - protein, 188 aa, Bacillus cereus BDRD-ST196
MFEVHDEKGKVVARVTTDKEGKAKVSDLSVGNYTLVEVEAPKGYEKLTNPIPFEITKGMINSVQLEVLNELSHLAPPGPEKPDPEKPEKPDPEKPEKPDPEKPEKPDPEKPETTDPEKPGTTDPEKPGTTNPEKPGTMNPEKPGTTNPEKPEKELPKTGQKMPVEPYMGALLVMMSFGLLVLGRKQQR

SEQ ID NO: 27282 - protein, 562 aa, Bacillus cereus BDRD-ST196
MVYTIGEWNLMKKIFSTFLICILAFSTLMNMTVSAESKNTGTLTIHKYEQGKDAKPGVEGNGKEGQSVPEGAKPLKDVTFEIKRIASFEQTSDGKVVTENINQVTDSVITKITDTNGMAVFNNLPLGRYEVKAVKGPDHIELDKSTFIVDIPMTSADGKDLNYDVHIYPKNETKRGSVELIKKGEEGRVLPGAEFHLFKKNEDGTKTQVKTPHPLVSGSDGKIHVESLEYGNYYFIEEKAPEGYLTSKEEYPFSIKETGKLVKLEKDVKNYKEPTIEKTINDNSKNAGINRKTEYTYDIKTLLPEDIQTYQNYVVTDVLDDRLEVVGTPIVMIDGKKVDESIVNVIVAGQKVIASVEDFSKVTGKELHLQITAKIKGDVQSGVEIPNKAVLDFVNKDDVSSEKDGKPSNEVVVTPTMGNIKIEKIDGKNKSLKLEGARFELRDKKGNIVVVNKKKMDDITDADGIITWNEIPYGEYQIVETEAPKYMDEDGAVEQYQKLRDPIEIKIDEKHQKIELQVENNKSGWIIPQTGGIGTVLFTAVGLLLMVTAAFIFFRKKPVKNS

SEQ ID NO: 27283 - protein, 503 aa, Bacillus cereus BDRD-ST196
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGQGQGILAVSDYQAVQSVKEIANKISEKDAEQKSMAYVGGESEQNLWAPTEKEFGYIIEDGVAIPVYKVLVHSNKPFGAWETFIDAENGKLIKKVDINRKAEGTGKVFLPNPVVSSGSKTGLKDNNDADSTALTNQLKTVTLKGLDGTGFLIGEYVTISSKAKTKSTNLQFNFTRANDSFEDVMSYYHIDTLQRYIQGLDINNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDATAYSSSDPTCLRRLDTNKVYPKDITNEVHNDGEIWAQGQYEMAQVFGRDVATKIILQSHWSLTPNAKFRDGAKAIKQADALLYGGQHAAEIDRIWTARGISTN

SEQ ID NO: 27284 - protein, 359 aa, Bacillus cereus BDRD-ST196
MDLPGALDLLGTLDLLDPTEPTGSTGPTGPGCIEPLPIFTQIVYVNKAGNDVTADGSECAPFLTVTAAMASITDAIAPFPDPLNITKRYAIKIGPGTYIEPLIHLKANIQLIGTSTLLTRLQIPFDINDPTWFDLNFSQDPRSGFVNLSLISGPLDFNFQTAQSVSGKLFFVSVNITPTPIFTALSTSVNQVNIRDSMLSAGYTQNGINMVMFASFVSNGNITINSEATTDTQVNLVGGGINGNVIINVQSGHIPIDPLNLTSFAITENIFNPSPNSGNLNVNGVNNVITRVKATVDSLPIRSRITLIGTNTSLIRVDDAFDLAYAPINPINWAAPPPTTVQEALDRIASLLAGTIGTP

SEQ ID NO: 27285 - protein, 748 aa, Bacillus cereus BDRD-ST196
MGNNSKYKTRKILAATATVTMLTTGMVSSSDVFAEETKQQKKISTSLQEEKSVKSENRIYTVPGKGDVEVLKQQERKSMAFSPYEPTGLYAKPNEQITINVEGNQNIQAYIGTYSYDASWREDSKIKSFTLKPGINTIQSPNGGMIYFYNKQQGGTIRTTVTTGGTTTPFFELGKHTKQDLINMLDQYPNAHAVELKGERVLITASPARVKKYLLGSNTDPVQLLKKMDEATRIQDKVAGLSGEQVDKHYIHYVEENHSPDYYMYATSYRTAYVGDAIQYVLDINKFIKDGWGPWHEAGHLRQQSPWKFYNMTEVQNNIYSLSVEKAFTSNQSFRLQQEGAYTKAFQYLEQPNKNYDEVSDVFVKLVMLWQLQLAYGEDFYPKLHQLYRDMSSSELPQTDENKKQLFMISASKVAKQNLIPFFEKWGLRPNNDTIQKMAALGYPILTAEIWKGTDSNPIKPDVPNENNILEGSQFAWSLKGISDFEFAKINFNKSTEEMQIDLKAGIPHHYFNETYASIKVQNASGKVVYNKDIYGNKQQNAESQKVPVKVGDYIELTHLEGVHRATFMNVDNSKQEGFGKKAIYEVTKDGLKTVNQIVNPKPDTEAPTQPQELYASNLTSNSVELKWNPSTDNVSVKEYQVLRDGQLIQTVQGTTYTDQNLTVNKEYKYAVKAVDTAGNTSIQSNILPVKTKDQNTSYEKWDPKKAYTKGDKVEHQGKVYEAIQNHQGNGDPNWIFALSLWKLLTIK

SEQ ID NO: 27286 - protein, 458 aa, Bacillus cereus BDRD-ST196
MNLKLTSKLERLRKSKKGIGACVLAAGVTAITMIPQSAYAHGFVAKPSSRAALCSQNYGALNLNCGNVMYEPQSLEAPKGFPDGGPIDGKIASAGGLFGGILDQQTSNRWFKNTIKGGANTFTWKYTAAHSTSKWHYYITKKGWDPNKPLTRAELEPIGTVNHDGSAASNNLTHTINVPTDRNGYHVILAVWDVADTSNAFYNVIDVNLVNNETPDTVAPSQPTGLNASKVSANSVALTWKASTDNIGVKEYQVLRNGEVIDTVPGTTFTDKKLKANAEYTYTIKALDSAGNISKESEKLKVKTTNETPDTEAPTQPKGLHSMSTTATTVDLMWSPSEDNVGVDHYIVYRESAGVMNKIGAADNTSFMDKDLKTNTSYKYVVTAVDLAGNESSRSDVLNVTTKSEDSTYEKWDARKAYTKGDRVVHEGKVYEAVQNHQGNGDSNWIFALSLWKPVLNK

SEQ ID NO: 27287 - protein, 455 aa, Bacillus cereus BDRD-ST196
MNNRFLKQLQNLKMNKKSIGAVALTAGIIGTTLIPQNAYAHGFVEKPGSRSALCSPTYGALNVNCGSVMYEPQSLEAPKGFPQGGPVDGQIASAGGKFGGILDQQAAERWFKNTITGGENTFTWKYTAPHLTSKWHYYITKKGWNPNKALTRADFEPIGTVQHDGSAASNNVTHKINVPTDRSGYHVILAVWDVADTVNAFYNVIDVNLINDVKPDTEAPSIPNGIQAQKVTANSIELTWNTSTDNVGVKGYQIFRNGEMIDTVLGTHFIDKKLQPSTEYSYTVKAIDAAGNVSKESTAFTAKTTVEAPDTEAPTQPKGLHSMGTTASSVDLMWSPSDDNVGVDHYDIYRETEGSMKKIATSNTTSYMDRNLLANTTYKYVVKAVDVVGNESVQSDTFTITTKTESASHEEWDAKKAYKKGDRVLHEGKVYEAVQNYEGHGDPNWIFALSLWKAV

SEQ ID NO: 27288 - protein, 862 aa, Bacillus cereus BDRD-ST196
MTISCNGLQIQAETKEKNVKSVLQMEPVGIQKSVDELAHSSTVQENASFTKRLKLSDLSQRPLAPNEDVKPLAEEKKYSMAELNQLSNKQLTDLLVTIKWYQIPELFQFNSDSLKFYQDDSRMQAIINKLAEQGQTYTKDDSKGIETLVEALRAAFYLGFYHDELSKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTMWYRNIDNFINEVNRFALIGTVTNKNGWLINNGIYYAGRLGKLYSTPTKGQQVVTEAMRIYPHLGEQYFVAAEQITTNYGGVDANGKTISLDQIREEGKKKYLPKTYTFDDGAIVFKTGDKVSEEKIKRLYWAAKEVRSQFYRTVGSDKPLESGHVDDVLTMVIYNSPDEYQFNRQLYGYETNNGGMYIEGTGTFFTYERTPEQSIYSLEELFRHEFTHYLQGRYEVQGLWGQGEMYQNERLTWFEEGNAEFFAGSTRLDSVVPRKSIIGGLSYDPAKRYTAAQTLNAKYGTWDFYNYSFALQSYMYNNRPEMFDKVHDLIRANDVSSYDAYRSTLSKDNKLNEDYQSYMQMLIDNRDKYTIPQVSDEYLAQHDPKSISDVTSDITNEAKLKDVKVTKNKSQFFNTFTLQGTYTGSAAKGEIEDWKVMNQATNDMLKRLSGKEWTGYKTLTAYFVNYRVNNAGQFEYDIVFSGVNTEEGTAVEKEPNNSFDTANPLSLNTLLRGNLSDQDQGDKFVIDVKDQKDLQISVTNEQNLGMNWVLYSESDLNNYVAYATKRDGNKLLGNYNAKPGKYYLSVYKYGGGTGNYTVQVK

SEQ ID NO: 27289 - protein, 728 aa, Bacillus cereus BDRD-ST196
MKKLNSALSVLGSVSMALTLASPALADVKQPNPGSTVEIFKENANAKKEDKNFTLGSDGEIGSLITQNIEMANNDWDKDGISNDLEINGYKIEFNSQTGKNEAKAWEPEKDKGKPKFISNPMNANTDGDPFTDMYEVENYNSDSETNFNPIVANMPNLQIGVKRIEVIPIATITDNNGGSVSRGWEKSVATQHSFNIGAGVEGGAMGSPAGPVPTGSASLNVGYGYSKTTTETESYTNNFDWSTAKTVDTAKAAKVRVHLEYKNVGTAGAENVSPHFNIRLGNKIINTVKATQDRYKANQLSTEKGGRNTTEVVIDSLDGQADANIVLSLDELKAVEQGELLSVEVLPTSTMEVSIEKDGQFMSVGDSGRIEARVNAATEQLETDIGNIPKFRVYTPKDKSLADKPVLSYNEVFQHINIDTNKVKHIVNKAKSNNQVSVVSDKTLSDLKMGKGDRGYLHNDAVHGAFQNIQQPRLVESSYDPVAKKMRASILPGLFGVSDEISATYRTKWSGPSKTVTLVKRENGYTYESKENIHHIQTEFAPSLPVKFEINDAHKLTPTNKSDSLVKYNTEFENYVADASGELVVEGTPYNISGSGTYWGSHHAHNRWEYLWVEQNDAEKVNVIIERVGQPKPGQPIKKDEEVFIKFQNSVHSGYSYLKLQDGYIHLDQKQNVSTFKFDHAVMNYNTQYYKRWKIQSNGQDIKADYAIDYMKYGNGVHNGWSLSRAK

SEQ ID NO: 27290 - protein, 374 aa, Bacillus cereus BDRD-ST196
MALPLPLVGAIGPTGGYEGPVGPPGIQGIQGPRGTTGAQGIQGAVGDTGAQGITGPIGLQGSQGLIGNQGPIGDIGVQGLEGIQGVQSPTGSQGLQGPQGIQGEIGERGQTGAQGMQGEMGETGISGVTGSQGSQGAKGIQGITGSQGISGIKGITGVIGPQGPQGATGATGVIGSQGIQGVQGPQGVTGSTGPTGIQGIRGVTGATGSTGVTGPTGATGLTGSTGATGSPAISTGGGYFFSTSTSTIAANANIPINSGSTVYGTGVSLTSATTVTVSTPGIYLVSYYFQGDATGGNETVSVRLLLNGTQITGSFIQNVTTSTVVIEPAISNTLLVNVASANSTLILQNGPLGVGHVTTIAGTITASLNVVRIL

SEQ ID NO: 27291 - protein, 84 aa, Bacillus cereus BDRD-ST196
MYSVSFSIVFVIQAISSSILNLTINDSIQFAIETRVGGGSGVRTTSARTDLLPLNQGDVLRVRIREATGDIIYSNASLVVSKVD

SEQ ID NO: 27292 - protein, 971 aa, Bacillus cereus BDRD-ST196
MKGYSKKVLVGVSFASLMLGSFQGSILAEDTKGEQASYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTQDDSKGIETLVEVLRSGFYLGFYNTELSKLNERSYHDKCLPALKTIANNPNFKLGTLEQNKVVSSYGELIGNASSDVETITSAAKIFKQYNDNFSTLVDNLSAGNAIYDIMQGVDYDIQSYLYDTRKAPKDTVWYQKIDSYINELSRFALMGTITEKNGWLINNGIYYTGRLGTFHSTGTKGLQVVTDAMKIYPYLGEQYFVAAEQITTNYGGKDANDNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSDIAAEITAEAKLSNVSVKKNKSQFFNTFTLQGTYTGTAAKGENEDWKTITQNVNDTLKRLSAKEWTGYKTVTAYFVNYRVNASGQFEYDVVFHGINTEEGAVNKAPVAVINGPYSGHTNEAISFKSDGSKDEDGKIISYKWELGDGTVSNEQNPTHVYTKEGTYTAKLTVTDDKGLTNTATTSVTVQKKEDNSVEKEPNNSFQTANKLQLNQVLRASLGNGDTSDYFEINVETAKNLQINVTKENNIGVNWVLYSEADLNNYVTYAQQQGNKLVGSYYTYPGKYYLHVYQYGGGTGNYTVEVK

SEQ ID NO: 27293 - protein, 142 aa, Bacillus cereus BDRD-ST196
MGVTGTSITATYAFANNTSGAAISVLLGGTNVPLPNNQNIGPGITVSGGNTVFTAANAGNYYISYTINITASLLVSSRITINGAPLAGTINSPALATTSFSATIITTLAAGSAISLQLFGLLAVATLSTTTPGAVLTIIRLS

SEQ ID NO: 27294 - protein, 326 aa, Bacillus cereus BDRD-ST196
MYQRNCFSCDGRRNSGSIGSTGATGPTGATGPTGNAGAGLQSTTAFSLAAAPNYKKGQVVTYTSSGYVVKKDAPQGFPNVSQDYIVLVEGGPTGSTGSTGATGTSGSTGSTGSTGSTGSTGSTGSTGSTGTTGVTGSTGATGTTGVTGSTGATGVTGSTGTTGPAGSSTAKSIVFQGTNAGFQRIAGSPGIDSNVIPYVTAGAGNIVGFATSININNLPAAVYTIDICRNVPTNLSAPTSSYILSTITLTTTDKITGTMTFSIKPTDIGSRQPQVYNPTPAPGPATVTWTSITTGNLFSRGDAISLYITPGITASAVYSIFLITDI

SEQ ID NO: 27295 - protein, 164 aa, Bacillus cereus BDRD-ST196
MKKKLLPICAMALLTVGYSSVASADTGTLTKEESAQMQQDKAKKEEAIKEQQKSEVEKKEAAQVQEKSDMAKKEEAIKAGQKNDTAKKEVTPQVQEKEALAKKEAAIKAGQKNDAAKQEVAKPAVQGEKLPNTASNNVAMTALSACLVGIGTLFGLKRRNKVKA

SEQ ID NO: 27296 - protein, 431 aa, Bacillus cereus BDRD-ST196; identical to SEQ ID NO: 26767

SEQ ID NO: 27297 - protein, 140 aa, Bacillus cereus BDRD-ST196
MTGVSTTATYSFANNTSGSAISVLLGGTNIPLPNNQNIGPGITVSGGNTVFTVTNAGNYYIAYTINITAALLVSSRITVNGSPLAGTINSPAVATGSFNATIISNLAAGSAISLQLFGLLAVATLSTTTPGATLTIIRLS

SEQ ID NO: 27298 - protein, 424 aa, Bacillus cereus BDRD-ST196
MVRREETEKLVKDLPSEILEMYDKVGGKIKIVDGSLAEYPDLKGRKAINDNGKEVSLDQYYAYSIKGKAPEVFIRASEDYEESIDKRKIVYTEIGKSMVQDVLKSEVLMDSSFLQAVNQMRLDKDTEAEFFSQNLREYKGSFDETYVKEHIKDFQDIFAKAFAYSRIPEFKEFFNTYAPGMFDYFDKLDWGKLKDQVQEKEQVKNEALDFAKDGKAALQWAKENLKGYAEKLNADEKAEIDFYTTSNYSTINSYLRDSEGSKYQDKEGLKKRIDLISSGLQKLSLPTDIVVYRRTGTDTFKPDPNNPILKFDFNNPKDIESFKKQYEGSLNEEKAFLSTSLVRDPDLYGSFMQKRILMRITLPKGTHAGFLPALELGTYQGENEMLLDHGYQYKIDKIGTVETELSTGKRRTDVFVEATVLPKN

SEQ ID NO: 27299 - protein, 744 aa, Bacillus cereus BDRD-ST196
MKRVVQIDVKEENVVRREETEKLVKDLPSEILEMYDKVGGKIKIVEGSLAEYPDLKGRKAINDNGKEVSLDQYYAYSIEGKAPEVFIRASEDYEESIHKRTSVYNEIGKSLVRDVLKTEVLMDSSFLQAVNQMRLDKDTEAEFFSQNLRTYKGSFDETYVKEHIKDFQDIFAKAFAYSRIPEFKEFFNTYAPDMFDYFDKIDWKKQGNPDAFVFAHETNLKGIQVDEGKEAIKNSGLVSEHVEGFKEIAKNNHTYIFFRPVNKLSTELIKQGAATKGLNVHGKSSDWGPMAGFIPYDANFSKVYGNQDKVDRGYNDNKHSVEDNKGSITTMKLELNSERLNELVKENIIENPFTEHSEIGLEDEEHWMGISLPQNSKGVGVYEFRIYSKEQIYNSAGQKFELRYRKSGSENTFEPIEVMARVIDGVSKPLTADYDMFALAPTLKEIKQKIPSSDWQAAVGESKPLEKLKKITDLLIRFGLMRKLDAEQGTLTDWQKNIINQLNDSAIKSGYTGGTVVNHGTEQDNTEFPEQDKELFIITPDGKTVLTKSWEDTQKFIRQNITNGDYLYYFNRSYNKIAAGNKAHIEWADPVTKAKSYTIPTQKELVEELYAIKKSTGKILSVDSLHKVDELGKSFEDYYNPANGFLGEEDKRKISIFRAFQSLEKVEELLDSYQLSDELYKRYFETLKNRIMSQIFIVQIEGNITIEKLNEKIDFNNKDENTTFDKFEKAINQNNYGTKNNFIS

SEQ ID NO: 27300 - protein, 955 aa, Bacillus cereus BDRD-ST196
MMLGISTVAISFGSIQTQVSAEEKTPYNVLQKKPIGIETSTDEIAHSTKADETLSYEERLKVGDFSQRPTPVVKRAAAKQFQQKYSVAELNRMSDDELIDTLANVSWDQITDLSQFNQETKVFYQNKERMQVIIDELGRRGSTFTKDDTKGIETFVEVLYCGVYLGFNNKELNYLNERSFHDKCLPALKAIAKNPNFKLGTNKQDAVVSAYGKLIRNASCDAETVQYSRNILNQYNDNISTYVSDPNKGAAVYNLIQGVDEDIQPYLNLNDTKKKADETIWYGKIDGFINEVSRMALLNHVTSENSWLINNGVYYAGRLGKFHSNPNKGLEVVTQAMHMYPRLSEAYFNAVEQISTNYSGKDYYGNTVDLQKIREEGQQQYLPKTYTFDDGSIVFKTGDKVTEEKVKRLYWAAKEVKAQYHRVIGNDAALEAGKADDVLTIVIYNDPYEYKRNSQLYGYDTNNGGIYIEGKGTFFTYERTPQQSSYTLEELFRHEFTHYLQARYEVPGSWGQGELYQNERMTWFNEGNAEFFAGSTRTNNVVPRKSVIKGLSSNPAERYTAERTLFSKYGSWDFYNYSFALQSYLYTHQFETFDKIQNFIRANDVKGYDAYREALSKDPNLNKEYQDYMKQLIDNQDTYNTPQVSDDYLAEHAPKPLADVKKEIENVARIKDATMTKHKSQFFNTFTLEGTYTGGVTKGESEDWKTMSKQINQSLEQLTQKEWSGYKTVTAYFVNYRVNANNQFEYDVVFHGVATGEEEKQTIKVNMNGPYNEMLNEKVEFHIDGTESIGGKIVSYLWDFGDGTTSTEANSTHVYGKEGTYTARLTVKDNKGKVGRGQTTVTVKKDEPVGHGYDSVKAIRFNKLFKGNMDMPNMAYMYTFNVTSPKEVDISFIDEQGIGIKWDLYHESDLGNPVITGQTDGNNIKGKFEAKPGKYYVVAFFEEENRNGTYSLLVK

SEQ ID NO: 27301 - protein, 289 aa, Bacillus cereus BDRD-ST196
MTITAAMASIIDASPAKRYAISIGPGTYTEPLIHLKANVQLIGTSTLLTRLAIPFDINDPSWFENGFQNDNRSGFVDLTLLTGPLDFNFVTASSFSGKLFFVSVNITPTPIFTALTTSVNQVNIRDSMLSAGYTQNGINMVMFASFVSSGNITINSQATTDTQVNLVGGGINGNVIINVQSGHIPIAPLNLTSFAITENIFNPSPNSGNLIVNGVNNVITRVRATVDSLPIRSPVTLIGTNTSLIRVDDVFDLAYTPINPVNWAVPPPTTVQEALDRIAALLAGTIGTP

SEQ ID NO: 27302 - protein, 183 aa, Bacillus cereus BDRD-ST196
MRKLFILLTLILALASVTAACTQDKKDSAVENGPIEEPTAKNENEELINFEEKEDMSRLEQGILLVGESVKGGYYLTAVQNAYLNASNDSVVVNVSVKNVRGQTIGLSELKYNLKDEKDGKAYEGKVLDQNPSDIQVKPNETVELKIAFEVPSTADEYMFYIESSLDPLGAHWKIDKLQSQKN

SEQ ID NO: 27303 - protein, 163 aa, Bacillus cereus BDRD-ST24; identical to SEQ ID NO: 26501

SEQ ID NO: 27304 - protein, 949 aa, Bacillus cereus BDRD-ST24
MALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDMQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHAPKSLTEVKKEISDTLPMNDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSVEVNPVHVYEREGSYKVSLRVKDDKGKESRSETTVTIKDGSLTESEPNNRPEEANRIGLNSTIKGNLIGEDHTDVYTFNVASAKDIDISVLNEYGIGMTWVLHHESDMQNYAAYGQANGNHIEAKFNAKPGKYYLYVYKYDNGDGTYSLSVK

SEQ ID NO: 27305 - protein, 333 aa, Bacillus cereus BDRD-ST24; identical to SEQ ID NO: 26499

SEQ ID NO: 27306 - protein, 183 aa, Bacillus cereus BDRD-ST24
MRKLSILLTFILVLVSVTAACTQDKTDSAVENGPIEEPTAKNENEELINFEEKEDMSRLEQGILLVGESVKGGYYLTAVQSAYLNASNDSVVVNVSVKNVRGQTIGLSELKYNLKDEKDGKIYKGKVLDQNPSDIQVKPNETVELKIAFEVPRTADEYMFYIESSLDPLQTYWKIDKLQSQTN

SEQ ID NO: 27307 - protein, 336 aa, Bacillus cereus BDRD-ST24; identical to SEQ ID NO: 26375

SEQ ID NO: 27308 - protein, 179 aa, Bacillus cereus BDRD-ST24; identical to SEQ ID NO: 26496

SEQ ID NO: 27309 - protein, 503 aa, Bacillus cereus BDRD-ST24
MFNKKMVAMAMTVPLVMGTISTVSALEKQQQVKLEAYSPQKKATEYLKENAAQYGLKTDLSDLQYISTIETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKARTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 27310 - protein, 163 aa, Bacillus cereus BDRD-ST24; identical to SEQ ID NO: 26493

SEQ ID NO: 27311 - protein, 725 aa, Bacillus cereus BDRD-ST24
MVNVLKQYNDNLSTYVTDYAKGQAVYEIVKGIDYDIQSYLQDTNKKLNETMWYGKIDNFINEVSRIALVGNITNENSWLINNGIYYAGRLGKFHSNPNKGLEVITQAMNLYPRLSGAYFVAVEQMKTNYGGKDYSGNAVDLQKIREEGKQQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTVKQTLFSKYGSWDFYKYSFALQSYLYNHQFETFDKLQDLIRANDVKKYDSYRESLSNNTQLNAEYQAYMQQLIDNQDKYNIPQVTNDYLIQHAPKPLAEVKNEIVDVANIKDAQITKYESQFFNTFIVEGKYTGGTSKGESEDWKAMSKQVNQTLEQLSQKGWSGYKTVTAYFVNYRVNAANQFEYDIIFHGVATEEKEKTTTIVNMNGPYSGIVNEEIQFHSDGTKSENGKVISYLWNFGDGTTSTEANPTHVYGEKGTYTVELTVKDSRGKESKEQTKITVKQDPQIGESLEEEKVLPFNKLVKGNLITPDQTDVYTFNVTDPKEVEISVVNEQNIGMTWVLYHESDMQNYVACGEDEGNTIKGKFVAKPGKYYLNVYKFDDKNGEYSLLVK

SEQ ID NO: 27312 - protein, 893 aa, Bacillus cereus BDRD-ST24
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLMAQGGTHNGVNVNGIGEDRMFDIFYYANTDELNMTSNFSELKLACLKVATNKYGANSIEVQAVQNAFDAAKITGTVKENEKTAENQAPELTVPFTITLRVGDTFDSMRNVKAVDKEDGDLTNKVKHKGDVDTSKPGTYIVEYMVVDSQGRNATATQTVIVEGNGETSDLEPKLTVPVGATIHVGDSFVPMAEVLAIDKEDGDLTSKIKVDGEVDTTKAGTYVLTYTVTDSKGHEVTAKQTVTVKVREEVKNDKPILKVPATTSITEGDQFDSLVGVSATDKEDGDLISKVAYEGTIDTTKAGTYEIIYSVRDSVGNEVNAIQKVLVKDKETSKANGLANKENKSNISNNSNSDKKEYTYKELPKTGVSTTNSAAIGILMIITGTVLTFVRKFRKIQK

SEQ ID NO: 27313 - protein, 563 aa, Bacillus cereus BDRD-ST24
MIEVVKGIREMKKIFSVLLVFFLTFSTWSSVLVKADSPSKGTLTIHKYEQEKDGAQGLEGDGSANQEVPKDAKPLKGVTFEVKKVASFEKISNDGKIVKEDVKPVMGATPNQVVTDDNGQAVLKDLPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPTIDKKINGKLEALPINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDGANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 27314 - protein, 455 aa, Bacillus cereus BDRD-ST24
MNNRFLKQLQNMKMNKKSLGAVALTAGIISTTLIPQNAYAHGFVEKPGSRSALCSSTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVIGTHFIDKKLQPSTEYSYTVKAIDAAGNVSKESTALTVKTTVEIPDTEAPTQPKGLHSMGTTASSVDLMWSPSDDNIGVDHYDIYRETEGSMKKIATSNTTSYMDKNLLANTTYKYVVKAVDVAGNESVQSDIFTITTKTEIASYEAWDAKKAYKKGDRVLHEGKVYEAVQSYQGNGDPNWIYALSLWKTV

SEQ ID NO: 27315 - protein, 878 aa, Bacillus cereus BDRD-ST24
MVKYSKISKWILGVGLVTITCNGLQIQAETKEQNVKNVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKIIASYGKLIGNASADVETVLYAGEIFKQYNDNLATFIEDRTKGDAIYELMKGIDFDIQTDMYTTGKEPKDTMWFRNIDNFINEVNRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDVTSDITNEAKLKDVKVTKNKSQFFNTFTLQGTYTGSVAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 27316 - protein, 380 aa, Bacillus cereus BDRD-ST24
MHMKEKRYKNMKTKQTIAASTLALAMIAGANPAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNSTKNNNAKELPNAGSEQSNNMALGMLSVLGGILLITRNKIKTLFSK

SEQ ID NO: 27317 - protein, 696 aa, Bacillus cereus BDRD-ST24
MLVKNQDKCSKFQAPIPFPPPGITGPTGPTGPTGALGGPTGPQGIQGVQGPIGPTGPQGIQGVQGVQGENGPTGPTGLTGPQGSQGNQGPMGERGPQGIQGVQGIQGERGPTGPTGIQGIQGIPGPIGPTGPTGIQGIQGMQGEIGPTGPTGIQGIQGVQGEIGPTGPTGNTGIQGVQGNLGGSGLQGVTGIQGIQGPIGPTGPTGSQGIQGEQGPMGPQGETGVQGLQGPQGEMGQVGPTGIQGIQGVQGVIGPTGPTGLQGDRGPTGPTGATGITGPTGSATGPTGATGPTGPPGGPTGPTGPAGSPGGPTGPTGATGATGATGATGATGIQGVQGIQGPTGATGVTGLQGVQGPMGATGPTGDQGIQGPQGIQGVTGPTGPQGLQGIQGPVGATGPTGPQGVQGAQGPIGPTGPQGIQGIQGEQGVRGATGPTGLQGLQGVTGQVGATGPTGATGPQGLQGIQGPQGVTGQVGATGATGATGPQGPQGIQGPQGITGPTGVTGQTGLTGATGPTGNQGIRGVTGPTGATGATGVTGATGPTGATGPTGSSAISTGGGYFFSTSTSTIAANATIPINSGSTVYGTGVSLTSATTVTVATPGIYLVSYYFQGDATGGNETVSVRLLLNGTQLTGSFIQNVTTSTVVIEPAISNTLLVNVTSANSTLVLQNGPLGVGHVTTIAGAITASLNVVRIL

SEQ ID NO: 27318 - protein, 539 aa, Bacillus cereus BDRD-ST24
MTGPAGPPGPPGGPTGPTGATGSTGVSGGIGPIGGQGVQGITGPTGHQGVRGAQGAQGVVGAVGVQGAQGPQGNQGITGPTGAEGSQGIQGPLGVTGPTGAEGPKGIQGIQGVIGPTGAQGMVGIQGIAGPVGVTGAEGAQGAQGIRGATGPAGAQGIQGVQGIQGETGAAGTQGPQGVQGIQGTTGLTGIQGAQGPQGVQGIIGPTGAIGLQGPQGLQGITGPTGAQGVQGIQGIQGVIGPTGAQGIRGPQGNTGEVGITGPQGVQGAQGSQGPQGPQGNVGIIGEAGETGATGATGATGPQGVQGVQGITGIQGITGTTGNTGATGPQGIQGIQGIQGLQGPTGASGVTGASGSIGPVGAQGSQGQNGAVGPTGATGSVGAIGFSGIVGVTGATGLPSGGGYFFSTATSAIAANALIPINSGSTIFGSGISLTSATTVTLSTPGIYLVSYYFQGDPTAGNETISVRLTLNGTQVAGSFIFYVTGGTFILEPAVSNTMVIEVTSSNATLSLQNGPLAIGHVTTLSGVITASLNVLKIV

SEQ ID NO: 27319 - protein, 166 aa, Bacillus cereus BDRD-ST24
MVSIVIELFNGFRVVPLAGPGMVKLIFVLTTAEKPIPTSEVIVPNMGRIPKPVAPVGPVIPIPVGPVTPVGPVIPIPVGPVAPVGPVIPIPVGPVAPVGPVIPIPVGPVTPVGPVIPIPVKPVAPVGPVIPVGPVGNVNGGIDGSVGPIKFGSRAGPCKILYSSFI

SEQ ID NO: 27320 - protein, 84 aa, Bacillus cereus BDRD-ST24; identical to SEQ ID NO: 27275

SEQ ID NO: 27321 - protein, 939 aa, Bacillus cereus BDRD-ST24
MTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKTQTIEVKTGETGAVQIVNNKVKGNIEIKKLSDSGKVLPNVEFTVFTEDGKEVQKVVTKENGIANVEGLTYGKYYFLETKTPNGYIGNKTKYPFEIKEHNKTLTFTVENTEVKGSVKLLKVDNEDISKKLEGAVFELKDESGKVVGEYKTDKNGEINVKDLAYGKYSFVEKASPHGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIETKATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGSKELDASKSVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEQPNSGKNTTTPEQPNEQVKEQPQLKKEIQSKIGWLPQTGTNLTSWISMAAGALLLIVGGVIFLKRKNA

SEQ ID NO: 27322 - protein, 971 aa, Bacillus cereus BDRD-ST24
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLENGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSVKEWTGYKTVTAYFVNYRVNASGQFEYDVVFHGINTEEGAENKAPVAVINGPYSGNVNEAISFKSDGSKDEDGKITLYRWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYSGGTGNYTVEVK

SEQ ID NO: 27323 - protein, 234 aa, Bacillus cereus BDRD-ST24
MTYEGKPVADKQEFIVATNNYRGSSQTFPGVSKGEVVYQSQDETRQIIVKYMQKIKDIDPAADQNWTFKPIVADKLNTTFDSSPNAQKYIKKDGKISYVGPSENEFAKYAIDITKKNDDKETGEGNPTTPPTGGGENPTTPPKGDGENPTTPPTEEGNNGNEPKQDGNNTGSGQTTTDDQNTKETTTVSENKEAEKDERDLPKTGASIASTIGAGLAFVGAGLLLLFRRKKANR

SEQ ID NO: 27324 - protein, 309 aa, Bacillus cereus BDRD-ST24
MSSWSNNVNGYCGCNNQNGVHVDSCCFSCDGTVPKVGPTGPTGATGATGPTGATGVTGDTGPTGATGITGATGPTGATGITGATGPTGATGITGATGATGATGATGSTGATGVTGDTGPTGATGPTGITGATGPTGATGVTGATGPTGATGPTGATGPTGATGDTGPTGATGTSITATYAFANNTSGTAISVLLGGTNVPLPNNQNIGPGITVSGGNTVFTAANAGNYYISYSINITAALLVSSRITINGAPLAGTINSPALATTSFSATIITTLAAGSAISLQLFGLLAVATLSTTTPGAVLTIIRLS

SEQ ID NO: 27325 - protein, 48 aa, Bacillus cereus BDRD-ST24; identical to SEQ ID NO: 26815

SEQ ID NO: 27326 - protein, 347 aa, Bacillus cereus BDRD-ST24
MYPRNFFSCDGRRNSGSNGNTGPTGNTGPSGNTGPTGNTGPTGNTGPTGNTGPTGNTGPTGNTGPTGNTGPTGNTGPTGNTGPMGNTGPMGNTGPTGNAGPSGAGFQSTTTFSLAAAPNYKKGQVVTYTGSGYVVKKDAPQGFPNISPDYIVLVESGPTGSTGPTGITGPTGNTGPTGITGPTGSADSASAKSIVFQGTNAGFQRIAGSPGIDSNVIPYVTAGAGSIVGFSASININNLPAAIYTINICRNVPTNLTTPSSSYILSTITLTTTDKITGTMVFSIKPTDSGAGQIQVFNPTPAVGPATVTWTSITTGNPVARGDAISLYITPGITASAVYSIFLITDI

SEQ ID NO: 27327 - protein, 431 aa, Bacillus cereus BDRD-ST24
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEVAVYDGIKSFYNIKR

SEQ ID NO: 27328 - protein, 69 aa, Bacillus cereus BDRD-ST24
MKPEDPKEPKEPEVKPEVRLEKLIKEPQVKTERELPKTGAASPWMMSVGAGISFLVGGVLFVLGRRRKQ

SEQ ID NO: 27329 - protein, 202 aa, Bacillus cereus BDRD-ST24
MKKPFYKKWWFWVIVVIVVLGAYGNSTKDKEETKTASTEPKQEAKQETKKDEPKKEEAKTEPKKEEPKKELSKEGESSKVKIAVGSVESTDSVGGQYLSEKAQGVFKVVEISITNNQKDAITVDANSFKLVDNQDREFKYSTQAQTAFDVGNGGKSDFFLKQLNPGLTQTGKIIFDVPADAQGLVLKARGGMMGKEIKLKVE

SEQ ID NO: 27330 - protein, 965 aa, Bacillus cereus BDRD-ST26; identical to SEQ ID NO: 26426

SEQ ID NO: 27331 - protein, 338 aa, Bacillus cereus BDRD-ST26
MEGWNVKGKLLKGVLSLGIGLGVLYGGSSAQADTSTDQNNILKVMTHNVYMLSTNLYPNWGQSQRADLIGAADYIKNQDVVILNEVFDNSASDRLLGNLKKEYPNQTAVLGRSNGNEWDKTLGSYSSSTPEDGGVAIVSKWPIVEKVQYVFANGCGPDNLSNKGFVYAKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFVENKVLQPKSPQWTVTSWLKKYTYDDYSDHYPVAATISMK

SEQ ID NO: 27332 - protein, 91 aa, Bacillus cereus BDRD-ST26
MKPEEEKVEEPNKSEVKEQPKVSNKPEIQGKVEAENKQDVQNKNEVSSSKESNKQSKLLPQTGGAAAESTSILAGMFALILGAIMFRRQKN

SEQ ID NO: 27333 - protein, 187 aa, Bacillus cereus BDRD-ST26; identical to SEQ ID NO: 26434

SEQ ID NO: 27334 - protein, 553 aa, Bacillus cereus BDRD-ST26; identical to SEQ ID NO: 26419

SEQ ID NO: 27335 - protein, 503 aa, Bacillus cereus BDRD-ST26; identical to SEQ ID NO: 26421

SEQ ID NO: 27336 - protein, 455 aa, Bacillus cereus BDRD-ST26; identical to SEQ ID NO: 26424

SEQ ID NO: 27337 - protein, 382 aa, Bacillus cereus BDRD-ST26
MHMKEKRYKNMKTKQTIAASTLALAMIAGANSAHAEVTDATPQQSTGDRLAEIKQHKQELDAKLQQHKENVDQTLNELNKVKENVDTKVNELHERKQVADEKINEIKQRKEEFDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPHTGNTLEELKKIKGNLDSLSANLELAKQDVKNKLAALQEARQDLINKINEIKQSKQTVSDDLSKKKQDLDIKINDFKHTEKKIEDKLAELHTTKQNVDNKINEVSQSKQTETKTGTTNANNNARELPNAGSEQSNNMALGMLSVLGGVLLIARNKIKTLFSK

SEQ ID NO: 27338 - protein, 849 aa, Bacillus cereus BDRD-ST26
MLVKDQDKCSKFQAPIPFPASGITGPTGPTGPTGSLGGPTGPQGIQGVQGPIGPTGPTGIQGVQGVQGENGPTGPTGLTGPQGSQGNQGPMGERGPQEIQGVQGIQGERGPTGPTGIQGIQGIPGPIGPTGPTGIQGVQGVQGEIGPTGPTGIQGIQGVQGEIGPTGPTGNTGIQGVQGDLGNSGLQGVTGIQGIQGPIGPTGPTGSQGIQGEQGPMGPTGATGVQGLQGPQGEMGLTGPTGSQGIQGVQGVIGPTGLTGLQGDPGPTGPTGPTGVTGPTGSATGPTGATGPTGPPGGPTGPTGPAGSPGGPTGPTGATGATGATGATGATGIQGVQGVQGPTGATGLTGLQGVPGPMGATGPTGDQGIQGPQGVMGVTGPTGLQGLQGIQGPVGATGPTGPQGVQGAQGPIGQAGPQGIQGIQGEQGVRGATGPTGLQGLQGIQGIQGPTGPQGIQGVQGLSGITGPTGPQGIQGIQGPQGNIGPTGSTGIQGVQGPEGPTGPTGATGPQGIQGIQGIQGPTGPQGIQGIQGIQGPIGPTGPTGPQGIQGIQGPIGPTGPTGPQGIQGITGSTGPTGATGATGQAGVTGPQGPQGIQGPQGVTGQTGATGETGATGSQGPQGIQGPQGITGSTGATGPTGATGPTGPQGIQGPQGVTGATGATGATGVIGATGPTGIQGIQGITGATGRTGVTGPTGLTGATGSSAISTGGGYFFSTSTSTIAANANIPINSGSTVYGTGVSLTSATTVTVATPGIYLVSYYFQGDATGGNETVSVRLLLNGTQVAGSFIQNVTISTVVIEPAISNTLLVNVTSANSTLILQNGPLGVGHVTTIAGAITASLNVVRIL

SEQ ID NO: 27339 - protein, 824 aa, Bacillus cereus BDRD-ST26
MALPLPLIGATGPTGNSGPIGPTGGHEGPVGPTGVTGPTGATGPQGPQGIKGIQGPRGTTGAQGIQGAIGDTGEQGITGPTGLQGAQGLIGNQGLIGDIGVQGLEGVQGAIGPAGSQGIQGPQGIQGEIGERGQTGAQGIQGVIGEAGITGVTGPQGSQGAQGIQGEEGTTGIQGEEGPQGIQGITGEQGHQGDQGIQGVVGPTGSTGPQGPQGISGIKGITGVTGPQGPQGVQGIQGVSGSTGFQGAKGVRGITGATGSTGTQGVEGPPGGPTGATGPIGPSSGVTGPSGPPGPPGGPTGPTGETGARGITGGTGAIGAQGLQGITGPTGPQGVRGAQGAQGVVGAVGFQGAQGPQGFQGITGATGVEGPQGIQGPQGAIGPTGAEGPKGVQGIQGVTGPTGAQGMQGLQGIQGPTGVAGAAGAQGAQGIQGATGPAGAQGIQGAQGIRGETGAAGVQGIQGVQGIQGITGLTGPQGAQGPQGVQGIIGPTGAIGSQGPQGIQGIVGPTGAQGSQGMQGIQGITGPTGAQGIRGPQGNLGENGITGPQGVQGAQGIEGPEGPQGNIGATGVTGETGVTGEAGATGAQGIQGVQGIMGIQGSTGMTGPTGATGVTGIQGSQGIQGPQGPTGARGATGVSGSVGPAGAQGSQGPIGAVGPTGATGSAGSIGFLGIAGATGATGLPSGGGYFFSTSTSAIAANALIPINSGSTVFGSGVSLTNATTVTLSTPGIYLVSYYFQGDPTAGNETISVRLTLNGTQVAGSFIFYVTGGTFILEPAVSNTMVIEVTASNATLSLQNGPLAIGHVTTLSGVITASLNVLKIV

SEQ ID NO: 27340 - protein, 971 aa, Bacillus cereus BDRD-ST26; identical to SEQ ID NO: 26826

SEQ ID NO: 27341 - protein, 788 aa, Bacillus cereus BDRD-ST26; identical to SEQ ID NO: 26557

SEQ ID NO: 27342 - protein, 48 aa, Bacillus cereus BDRD-ST26
MATGSFSATIIANLPAGAAISLQLFGVGAVATLSTATPGATLTIIRLS

SEQ ID NO: 27343 - protein, 153 aa, Bacillus cereus BDRD-ST26
MFQGTNAGFQRIAGSPGIDSNVIPYVTAGFGSIVGFTASINVNNLPAAAYTIDICRNVPTNLTAPTSSYILTTITLTTTNKITGTIVFSIKPTDTGSGQIQVFNPTPVVGPATVTWTSITTGNLVSRGDAISLYINPGITASAVYSVFLITDI

SEQ ID NO: 27344 - protein, 431 aa, Bacillus cereus BDRD-ST26; identical to SEQ ID NO: 26428

SEQ ID NO: 27345 - protein, 564 aa, Bacillus cereus BDRD-ST26; identical to SEQ ID NO: 26430

SEQ ID NO: 27346 - protein, 456 aa, Bacillus cereus BDRD-ST26; identical to SEQ ID NO: 26352

SEQ ID NO: 27347 - protein, 203 aa, Bacillus cereus BDRD-ST26
MKKPFYKKWWFWVIVVIIVLGAYGNSSKDTEETKTASTEPKQEAKQETKKDEPKKDEVKKEEPKKEGPKKELSKEGESSKVKIAVGSVESTDSVGGQYLSEKAQGVFKIVEVSITNNQKDAITVDANSFKLVDNQDREFKYSTQAQTAFDVGNGGKSDFFLKQLNPGLTQTGKIIFDVPADAQGLVLKARGGMMGKEIKLKVE

SEQ ID NO: 27348 - protein, 949 aa, Bacillus cereus BGSC 6E1
MALSLGALQAPVLAEEKVPYNVLKTKPVGIEKPVDEIGHVSKAEETLSFQERLKVGDFSQRPASITNKAAVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLAQKEWSGYKTVTAYFVNYRVNSSNQFEYDVVFHGIAKDDEENKAPTVHINGPYNGLVKEGIQFKSDGSKDEDGKIVSYLWDFGDGSTSAEVNPLHVYEREGSYKVALIVKDDKGKESKSETTVTVKDGSLTESEPNNRPEEANRIGLNTTIKGSLIGGDHTDVYTFNVASAKNIDISVLNEYGIGMTWVLHHESDMQNYAAYGQVNGNHIEANFNAKPGKYYLYVYKYDNGDGTYELSVK

SEQ ID NO: 27349 - protein, 338 aa, Bacillus cereus BGSC 6E1
MEVWNVKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSSTPEDGGVAIVSKWPIVEKIQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYDDYSDHYPVEATISMK

SEQ ID NO: 27350 - protein, 178 aa, Bacillus cereus BGSC 6E1; identical to SEQ ID NO: 26603

SEQ ID NO: 27351 - protein, 109 aa, Bacillus cereus BGSC 6E1
MISPVQLQVLNKLTSLAPPGPEKPETTDPEKPETTDPEKPGTTDPEKLETTDPEKPGTTNPEKPETMNPEKPEKELPKTGQKMPVEPYMGALLIMMSFGLLVLGRKQQR

SEQ ID NO: 27352 - protein, 503 aa, Bacillus cereus BGSC 6E1; identical to SEQ ID NO: 26407

SEQ ID NO: 27353 - protein, 412 aa, Bacillus cereus BGSC 6E1; identical to SEQ ID NO: 26409

SEQ ID NO: 27354 - protein, 455 aa, Bacillus cereus BGSC 6E1; identical to SEQ ID NO: 26414

SEQ ID NO: 27355 - protein, 382 aa, Bacillus cereus BGSC 6E1
MHMKEKRYKNMKTKQTIAASTLALAMMAGASSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDELSKKKQDLDIKINDFKHTEKKIDDKLAEIHTTKQNVDNKINEVSQSKQTETKTGTTNANNNARELPNAGSEQSNNMALGMLSVLGGILLVTRNKIKTLFSK

SEQ ID NO: 27356 - protein, 194 aa, Bacillus cereus BGSC 6E1
MVSIVTELFNGFRVVPLAGPGIVKLTFVLTIAEKPIPTSEVIVPNTGRIPKPVAPVGPVIPVGPVIPIPVGPVIPVGPVIPIPVGPVTPVGPVIPIPVGPVTPVGPVIPIPVGPVTPVGPVIPIPVGPVTPVGPVIPIPVGPVTPVGPVIPIPVGPVIPVGPVGNVNGGIGGSVGPIKFGSRAVPYKIIYFSFM

SEQ ID NO: 27357 - protein, 84 aa, Bacillus cereus BGSC 6E1; identical to SEQ ID NO: 26403

SEQ ID NO: 27358 - protein, 971 aa, Bacillus cereus BGSC 6E1
MKGYSKKVLVGVSFASLMLGSFQGGALAEGTKGEQVSYRNVLKMEPVGVQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGMNTEEGAVNKAPVAVINGPYSGNVNEAISFKSDGSKDEDGKIVAYKWEFGDGTVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 27359 - protein, 774 aa, Bacillus cereus BGSC 6E1
MLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTTPPTGEGDNGENPTTPPTGEGNNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 27360 - protein, 359 aa, Bacillus cereus BGSC 6E1
MTGSTGPTGSTGPTGETGSTGSTGAPGNTGATGSTGVTGNTGSTGSTGVTGSTGPTGSTGPTGNTGPTGETGATGSTGVTGSTGVTGNTGVTGETGPTGSTGVTGSTGATGSTGVTGNTGATGNTGATGSTGVTGNTGATGETGPTGSTGATGNTGATGETGPTGSIGATGNTGATGNTGETGVTGPTGSTGVTGSTGPTGSTGTTGNTGVTGDTGPTGATGVSTTATYAFANNTSGSVISVLLGGTNISLPNNQNIGPGITVSGGSTVFTVANAGNYYIAYTINLTAGLLVSSRITVNGSPLAGTINSPTVATGSFSATIIASLPAGAAVSLQLFGVVALATLSTVTPGATLTIIRLS

SEQ ID NO: 27361 - protein, 160 aa, Bacillus cereus BGSC 6E1; identical to SEQ ID NO: 26412

SEQ ID NO: 27362 - protein, 50 aa, Bacillus cereus BGSC 6E1
MEKLIKEPQVKVERELPKTGAASPWMVSVGAGISFLVGGVLFVLGRRRKQ

SEQ ID NO: 27363 - protein, 431 aa, Bacillus cereus BGSC 6E1; identical to SEQ ID NO: 26106

SEQ ID NO: 27364 - protein, 564 aa, Bacillus cereus BGSC 6E1; identical to SEQ ID NO: 26416

SEQ ID NO: 27365 - protein, 1510 aa, Bacillus cereus BGSC 6E1
MESSIALAGAVFTLQDANGTEIAKDLKTDAHGVLVIPDLAPGDYQFIETAAPEHYKLDQTPIKFTIKKGSKEDLPVPVTVKNSLLTGGVTLTKVDDVDGTTLEGAEFIIVDAHDTEKVVRKGLTTDEHGKVSASDLRPGDYQFIEVKAPKDYTLGNDPIPFTIGKSQKENITVTATNSLKKGAVTLTKIDDIDRTMLKGAIFKIVDMDGNEVRTNLVTNKNGKIYVPDLRPGDYQFIETKAPEHYVLDETPIPFTIERNQTKEINVTGKNTLKKGSVELTKIDDIDTDTKLANAVFNLLDADGEIVEEGLKTNAEGKIVVENLRPGTYQFVETIAPEHYDLNKTPIEFTIKKSQTETLHVTAKNALTKGAVELSKVDDIDGTKLEGAVFNIVDMKGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKRPIVVTVEKSQKNIATVTMKNSLTKGGVELSKVDDVDGTTLEGAVFNIVDMKGTVIRENLTTNSQGKISVSNLRPGDYQFVETKAPKHYDLNKEPIPFTIEKGQAEPISVTAKNSLTKGAVELSKVDDIDGTALEGAVFKIVDMNGNDVRTGITTDAKGKISISDLHPGDYQFIETTAPKHYKLDATPIKFTIEKSQAEKLQVTAKNSLIEGAVELIKVDDINPDTKLSDAVFNIIDAKGQVVRTNLTTDKDGKVSASNLRPGDYQFVETKAPKDYDLNKTPIPFTIEKSQPTHVSVTAKNGLTKGGVELTKVDSLNAKETLEGAVFKITDMNGNDIRTNLVTNKDGKIIAKDLQPGDYQFIETKAPKHYDLNEDPIKFTIERSQTKHVFVTATNSLTKGSVELIKVDDVEENTTLEGAVFKIVNKDGHDVRTDLTTDKNGRLVVDELPPGDYEFIETKAPTHYDLNETPIKFTVKKGQEKIASVTATNSLTKGAVELSKVDDVDGSALKDAVFKIVDMNGNNVRSNLTTNKDGKISVSDLRPGDYQFIETKAPTHYDLNQTPINFTVEKSQTTTASVTAKNSLTKGAVELTKVDDIDGATLEGAVFKIVDQNGLDVRTDLTTDKDGKISVSDLRPGDYQFVETKAPTHYDLNQNPINFTVEKSQTTTASVTAKNSLTKGAVELTKVDDIDGATLEGAIFKIVDMNGNDVRSDLTTNKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPETHGKETSEELENGNPETHGKETSEELENGNPKTQTNKQQDDQNKGKELPNTGHKKDSTQTVGILLLLAGLLSILATKRKKYY

SEQ ID NO: 27366 - protein, 114 aa, Bacillus cereus BGSC 6E1
MKGIDYDIQSYMYKNGKEPKDTIWYRNIDSFINEINRFALIGTVTDKNGWLINNGIYYAGRFGKLHSTPTKGQQVVTDAMGIYPYLGEQYFVAAEQITTNYGGVDANGKTINLD

SEQ ID NO: 27367 - protein, 431 aa, Bacillus cereus BGSC 6E1
MMEQLFLKQVIKVSEEKIKCLYWAAKEVRSQFYRIVGSDKLLESGHADDVLTMVIYNSPDEYQFNHQLYGYETNNGEIYIEGKGTFFTYERTPEQSIYSLEKLFRHEFTDYLQGRYVVPGLCGQGEMYQNERLTWFEEGNAEFFAGATRLDSVIPRKSIIGGLSYDPAKRYTAAQTLNAKYGTWDFYNYSFALQSYMYNNRPEMFDKVQDLIRANDVSSYAAYRSTLSNDSNLNEEYQSYMQTLIDNRDKYTIPQVSDEYLVQHNPKSLSDVTSEITNEASLKNVKVTKNKSQFFNTFTLQGTYAGGSAKGEVEDWKVMNEATNDMLKRLSGKEWTGYKTLTAYFVNYRVNNAGQFEYDVVFSGVNTEEGTAVEKEPNNSFDIANSLSLNTLLRENLSDQDQVDRFVIDVKDPKDLQITVTNEHNHLKKST

SEQ ID NO: 27368 - protein, 460 aa, Bacillus cereus BGSC 6E1
MLPNVEFTVFTEDGKEVKKAVTNENGIAKVEGLTFGKYYFLETKTPNGYIGNKTKYPFEIKEHNKTLTFTVENTEVKGSVKLLKVDTEDISKRLEGAVFELKDASGKAIGEYKTDKNGEINVKDLPYGKYSFVEKTSPNGYVLVKEPISFEIKEHGKIIELLAVNHLIKGDLEITKVDVADGNNKLQNAEFTIYNEAGKEVVKGKTDDKGIAKFEKLPFGKYTYKETVAPNGYILNEETFSFEIKENGQIIKHIVKDEKIPLIKTTASDKKDGTKEMHTSKSVTIQDKVEYKDLILGKEYVVKGKLMDKATNKPLLVDGKEVTVESKFTTKEKNGSITLDFTFNASALQGKEVIVFEELYQDNVLVAIHVDIEDKGQTVKFKEVKPEQPKPEQPHQDKNTSTSEQPKEQVKEQPQPKKEVQSKIGWLPQTGADLTSWISMAAGALLLIVGGVIFLKRKNA

SEQ ID NO: 27369 - protein, 187 aa, Bacillus cereus BGSC 6E1
MEVEKKSKVWEYIGWGSFILVGSFLFFCALILVFGDPKTKYQAQEVTAQGHEVKDAEKDVKKEYSVGETIKLGDHRLTVTDVKKSSGGEYDKPKQGHEYVLVAVNIYNGGKEDISYNPFDFEMRNSQGNITRAVPSIINQNTQLSAGQLAPNGQVAGTVVFEQPIGEKLKLQFTPNFWSKKKIIVNL

SEQ ID NO: 27370 - protein, 234 aa, Bacillus cereus BGSC 6E1
METLAVLIFLASIVLFVLFIIAIFKKKPKAKLFISSIVCLVLAMILIPTKDKEEKPKAKETTQQASTEVKEEPKKEEVKKEEPKKKEEPKKEEPKKEEPKKELSKEGESSKVKIAVGSVESVDSVGGEYLNEKAQGVFKVVEISITNNQKDAITVDANSFKLMDNQDREFKYSTQAQTAYDIGNGGKSDFFLNQLNPGLTQTGKIIFDIPADAQGLVLKARGGMMGKEIKLKVE

SEQ ID NO: 27371 - protein, 176 aa, Bacillus cereus BGSC 6E1
MYKKLGTIALTGALAFSLAACAETEVKEVSKNDAPKQEEKKDKKETAENKVYKIGDTVEVNGLQLTFSSAKFVEPNEYFKPEKGKVLEIAFNAKNNGKKDVYFGTSELKIADVEGNQFKEYFDGGDTFVNENIAPGNQITNKMTFDVPEGDKFVCTFKPTFTFDEKSVKFEFDVAK

SEQ ID NO: 27372 - protein, 748 aa, Bacillus cereus BtB2-4
MGNNSKYKTRKILAATATVTMLATGMISSPDVFAEEMQQQKKLSTSLQEEKSVKSENRIYTVPGKGDVEVLKQQERKSMAFSPYEPTGLYAKPNEQITINVEGNQNIQAYIGTYSYDASWREDSKVKSFTLKPGINTIQSPNGGMIYFYNKQQGGTIRTTVTTGGTTTPFFELGKHTKQDLINMLDQYPNAHAVELKGERVLITASPARVKKYLLGSNTDPVQLLKKMDEATRIQDKVAGLSGEQVDKHYIHYVEENHSPDYYMYATSYRTAYVGDAIQYVLDINKFIKDGWGPWHEAGHLRQQSPWKFYNMTEVQNNIYSLSVEKAFTSNQSFRLQQEGAYTKAFQYLEQPNKNYDEVSDVFVKLVMLWQLQLAYGEDFYPKLHQLYRDMSSSELPQTDENKKQLFMISASKVAKQNLIPFFEKWGLRPNNDTIQKVAALGYPILTAEIWKGTDSNPIKPDVPNENNILEGSQFAWSLKGISDFEFAKINFNKSTEEMQIDLKAGIPHHYFNETYASIKVQNASGKVVYNKDIYGNKQQNAESQKVPVKVGDYIELTHLEGVHRATFMNVDNSKQEGFGKKAIYEVTKDGLKTVNQIVNPKPDTEAPTQPQELYASNLTSNSVELKWNPSTDNVSVKEYQVLRDGQLIQTVQGTTYTDQNLTVNKEYKYAVKAVDAAGNTSIQSNILPVKTKDQNTSYEKWDPKKAYTKGDKVEHQGKVYEAIQNHQGNGDPNWIFALSLWKLLTIK

SEQ ID NO: 27373 - protein, 965 aa, Bacillus cereus BtB2-4
MNKQSKINKVLLSISTMALSLGAIQTNVSAEEKVPYNVLHSKPVGIEKPVDEIGHASKAEETLSFQERLKVGDFSQRPASITKNSAVKQAKESYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNQVTPENKWLVNNGIYFASRLGKFHSNPNKGLEVVTQAMHMYPRLSESYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHISQFFNTFTLEGTFTGSVTKGESEDWKAMSKRVNETLEQLTQKEWSGYKTVTAYFVNYRVNSSNQFEYDVVFHGIAKDDGENKAPTVNVNGPYNGLVKEGIQFKSDGSNDEDGKIVSYLWDFGDGSTSTEVNPVHAYEREGTYKVALRVKDDKGKESRNETTVTITDGSLTESEPNNRPEEANRIGLNTTIKGSLIGGDHTDVYTFNVASAKDIDISVLNEHGIGMTWVLHHESNMQNYAAYGQANGNHIEAKFNAKPGKYYLYVYKYDNGDGAYALSVK

SEQ ID NO: 27374 - protein, 333 aa, Bacillus cereus BtB2-4
MKGKLLKGVLSFGIGLGALYSGSSAQAEMSINQNNTLKVMTHNVYMLSTNLYPNWGQNERADLIGAADYMKNQDVVILNEVFDNNASNRLLGNLKKEYPNQTAVLGRSNGNEWDKTLGNYSSSTPEDGGVAIVSKWPIIEKIQYVFEKGCGPDNLSNKGFVYTKVKKNDRFVHVIGTHLQAEDNMCGQTSPASVRTKQLQEIQEFIKNKNIPNNEYVLIGGDMNVNKINAENNSDSEYASMFKTLHASIPSYTGHTATWDATTNSIAKYNFPDSPAEYLDYIITSKDHANPSYIENKVLQSKSPQWTVTSWLKEYTYNDYSDHYPVEATISMK

SEQ ID NO: 27375 - protein, 103 aa, Bacillus cereus BtB2-4
EGNNGENPTTPPTGEGNNGENPTTPPTGEGNNGNEPKQDGNNTGSGQTTTDNQNSKETTTVSENKEERDLPKTGTSVASTIGAGLAFVGAGLLMLFRRKKANR

SEQ ID NO: 27376 - protein, 113 aa, Bacillus cereus BtB2-4
PVDGYKSEVHGYDITNTKIKEDPKDPSVDPKDPSVDPKDPSVDPKDPSTDPKDPSVDPKDPSTDSKVPPTKENTKTSVWLPNTGGTSMEIISYIVGMLLMALGGFVFVRQRMR

SEQ ID NO: 27377 - protein, 1053 aa, Bacillus cereus BtB2-4
MERIEKERMIYMQKRNNFMFQKPMKVLVTSAILTTTLFSPIMTNGLTVHAETIAAQTTNQYEQREFELPGTGSFSSEAKRERRSEQKTYMPTGIYVKPNEQITIEVSGTQKVRAIIGTHQYDKQWGKEVNLSPGSNTISSPNGGLLGFDNSQDTGAVKVKVTQGGSPVPFFELGKHTKEDWITMMKMYPDAHAVQLKSEKAVLTVTRDSAQKYIVDQDPVPLLEKYDEMIRAQDKISGLSETDPNPLHRSTRRIWAFVENPNKPDWGMYASLDGAVFTTAGNAIESALDVNKFGWGQMHEAGHARQQSPWTWSDFRGMGEVTVNLYSLAAQKRLFPDQPTRLEKNKDYEKAFTYLKQTDKDYKNIDDLFVKLVMIWQLQLAYGEDFYPNLHKLYRELPEDLFPKTDEEKIQAFIYNTSKVAKQNLLPFFDQWGLKASQETRQKIEALNYPILTAPIWQATDSKPVIVEKNGETPDMEPKLTVPVGATMNVSDQFDPMSGVSATDKEDGDITDKVTVDGKVDTSKPGTYELTYTAKDSKGHKVTAKQTVTVKEKEETKDEAPVLKVPSETTITEGDKFYPMKDVSATDTEDGDITSEVKYEGNVDTNIPGTYTITYTVKDSAGHLATQTQTITVKEKPAEDKEPELTVPEETVLTVGDQFDPMSGVKAIDKEDGDLTSKVTYSGDQGTDKEGTYKIKYVVEDSKGHRVIKLRTVIVKAAEKPSEDQAPVLKVLFTTTLHVGDTFDPMSGVSATDKEDGNLTSKVKYKGNVDTTKPGKYIVEYSVVDSKGVNAIATQTVIVEESGETPDMEPKLTVPVGATMNVGEQFDRMAGVSATDKEDGDLTSKVTVEGKVDTTKPGTYVLTYTVKDSAGHLATQTQTVTVKEKEKPVEDQEPGLTVPAEVNMNVGDKFDPMSGFKAIDKEDGDITDKVIQFGEVDTSKTGTYEVKFLVRDSGGNEVTTIQKVVVKDKDNGNNNTNNGNGADNGSTGTNNSNGSDTGNSNISINSTSDKKEDTYKELPKTGASTNNSAALGILMVLAGMVLTFGRKFKKVLK

SEQ ID NO: 27378 - protein, 176 aa, Bacillus cereus BtB2-4
MYKKMGTIALTGALAFSLAACGETEVKEVSKTDAPKQEEKKDKKASTENKVYKTGETVEVNGLQITFNSAQFVEPNEYSKAEKGKVLEIAFSAKNNGKKDAYIGTEELKIADASGNQFKEYFGADNAFMNENVGPGNQITGKMYFDVSESDKYTGTYKPNFTLDDKSVKFEFTPGK

SEQ ID NO: 27379 - protein, 164 aa, Bacillus cereus BtB2-4
MKKKLLPICAMALLTVGYSSVASASTGTLTKEESAQMQQDKAKKEEAIKEQQKSEVEKKEAAQVQEKSDMAKKEEAIKAGQKNDTAKQEVTPQVQEKEALAKKEAAIKAGQKNDAAKQEVAKQAVQGEKLPNTASNNVAMMALSACLVAIGTLFGLNRRNKIKA

SEQ ID NO: 27380 - protein, 431 aa, Bacillus cereus BtB2-4; identical to SEQ ID NO: 26767

SEQ ID NO: 27381 - protein, 376 aa, Bacillus cereus BtB2-4
MKTKQTIAASTLALAMIAGSTPTHAEVNEATPQQSTGDRLAEIKQHRQELDAKLQQHKENVDQTLNELNQVKENVDTKVNELHERKQVADEKINEIKQHKQELDAKLQQDKQIAEDKIAEIKEHKKQVDEKVAEIKEHKQTVDEKVNEIKEHKQTVDEKVNEIKQHKENIDAKVNELKEVKKQVDDKLAELKKAKQTAEDKLAEIKENKPNTGNTLEELKKIKGNLDSLSSNLELAKQDVKNKLAELQEARQDLLNKINEMKQAKQTVSDDLTKKKQDLDIKINDFKHTEKKIDDKLAELHTTKQNVDNKINEVSQPKHTTVNNNTTTTTVPANNNARELPNAGSEESNNMTLGMLSVLGGGLLITRNKIKTFFSK

SEQ ID NO: 27382 - protein, 458 aa, Bacillus cereus BtB2-4
MNLKLTSKLERLRKSKKGIGACVLAAGVTAITMIPQSAYAHGFVEKPSSRAALCSQNYGALNLNCGNVMYEPQSLEAPKGFPDGGPIDGKIASAGGLFGGILDQQTSNRWFKNTIKGGGNTFTWKYTAAHSTSKWHYYITKKGWDPNKPLTRAELEPIGTVKHDGSAASNNLTHTINVPTDRNGYHVILAVWDVADTSNAFYNVIDVNLVNNEAPDTVAPSQPTGLNASKVSANSVELTWKASTDNIGVKEYQVLRNGEVIDTVPGTTFIDKKLKANTEYTYTIKALDSAGNISKESEKLKVKTTNAIPDIEAPTQPKGLHSMGTTATTVDLMWSPSEDNVGVDHYVVYRENAGVMNKIGTTDNTSFVDKNLKANTSYKYVVTAVDLARNESSRSDVLTVATKLDGSTYEKWDARKAYNKGDKVVHEGKVYEAVQSYQGNGDPNWIFALSIWKPVLNK

SEQ ID NO: 27383 - protein, 455 aa, Bacillus cereus BtB2-4
MNNRFLKQLQNLKMNKKSIGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINNVKPDTEAPSIPNGIQAQKVTANSIELTWNVSTDNVGVKGYQIFRNGEMIDTVPGTYFIDKKLQPSTEYSYTVKAIDAAGNVSKESTALTVKTTVEAPDTEAPTQPKGLHSMGTTASSVDLMWSPFDDNVGVDYYDIYREIEGTMKKIATSNTTSYMDKNLLANTTYKYAVKAVDVVGNESVQSDTFTITTKTESASYEAWDAKKAYKKEDRVLHEGKVYEAVQNYEGHGDPNWIFALSLWKTV

SEQ ID NO: 27384 - protein, 503 aa, Bacillus cereus BtB2-4
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGEGKGLLAVSDYQPVTGVKEVTKKISEKDAEQKSMAYVGGESEQNLWAPTEKEFGYIVEEGVAIPVYKVVVHSNNPFGAWETFIDAENGKLIKKVDINRKAEGTGKVFLPNPVVSSGSLAGLKDNNDADSTALTNQLKTVTLKGLDGTGFLIGEYVTISSKAKTKSTNLQFNYTRANDSFEDVMSYYHIDTLQRYIQGLGFQNINKRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDAAAYSSSDPTCLRRLDTNKVYPKDITNEVHNDGEIWAQGQYEMAQSFGRDVATKIILQSHWSLTPNAKFRDGAKAIKQADALLYGGQHATEIDRIWAARGISTN

SEQ ID NO: 27385 - protein, 971 aa, Bacillus cereus BtB2-4
MKGYSKKVLVGVSFASLMLGSFQGSILAEDTKGEQVSYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTQDDSKGIETLVEVLRSGFYLGFYNTELSKLNERSYHDKCLPALKTIANNPNFKLGTLEQNKVVSSYGKLIGNASSDVETITSAAKIFKQYNDNFSTLVDNLSAGNAIYDIMQGVDYDIQSYLYDTRKAPKDTVWYQKIDSYINELSRFALMGTITEKNGWLINNGIYYTGRLGTFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSDIAAEITAEAKLSNVSVKKNKSQFFNTFTLQGTYTGTTAKGEYEDWKTITQNVNDTLKRLSAKEWTGYKTVTAYFVNYRVNASGQFEYDVVFHGINTEEGAVNKAPVAVINGPYSGNVNEAISFKSDGSKDEDGKIASYKWEFGDGTESSEQNPTHVYTKEGTYTAKLTVTDDKGLTNTATASVTVQKKEDNSVEKEPNNSFQTANKLQLNQLLRASLGNGDTSDYFEINVETARNLQINVTKENNIGVNWVLYSAADLNNYVTYAQTQGNKLVGSYNAHPGKYYLHVYQYGGGTGNYTVEVK

SEQ ID NO: 27386 - protein, 738 aa, Bacillus cereus BtB2-4
MKQLKPAISVLGSVSMALTLASPALADVKQPNPGGTVEIFKENANVKKEDKNFTLGSDGEIGSLITQNIEMANNDWDKDGISNDLEINGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRVYTPKDKSLADKPVLSYNEVFQQVNIDTKKVNHIVNKAKSTNNVSVVSANNGTDALNDLKAGQGDRGYLHKDSVHGAFAKLQQPTLVEGSYDSVTQKIRATILPGLFGVSKDIPTTYSKKWNAPSQTVTLVKRENGFTYESRENIHPIKSEIAAHRKVTFEINDAHNLTPTQKIDTEIKANKEFEDYVVDNSGEFVTEGVPYTVASYGNTAYLGSHHAGNKWEYLWAEKSSDEKVNVIIERVGQPKPGKPIKKDEEVLIKFQNPIYSDYAYLKLQDSYIHLDQKQNASTFKFNHAYPKNFTGHHKQWNILSNGNKLKVGYLIDYMKYGNGENGTDTIAWNLSRVQ

SEQ ID NO: 27387 - protein, 209 aa, Bacillus cereus BtB2-4; identical to SEQ ID NO: 26769

SEQ ID NO: 27388 - protein, 80 aa, Bacillus cereus BtB2-4
GSQGGNRVKGDSSSQGGNGSQGGNRVKGDSGSQSGNAKDNATKQGNKLPNTATHYPASILIGLSTFLIGVLLFIRRKNAK

SEQ ID NO: 27389 - protein, 183 aa, Bacillus cereus BtB2-4
MRKSFILLTLILVLVSVTAACTQDKKDSAVENGPIEEPTAKNENEELINFEEKEDMSRLEQGILLVGESVKGGYYLATVQSAYLNANNDSVVVNVSVKNVRGQTIGLSELKYNLKDEKDGKTYEGKVLDQNPSDIQVKPNETVELKIAFEVPSTTDEYMFYIESSLDPLETNWKIDKLQSQKN

SEQ ID NO: 27390 - protein, 113 aa, Bacillus cereus CER057; identical to SEQ ID NO: 27376

SEQ ID NO: 27391 - protein, 176 aa, Bacillus cereus CER057; identical to SEQ ID NO: 27378

SEQ ID NO: 27392 - protein, 431 aa, Bacillus cereus CER057; identical to SEQ ID NO: 26767

SEQ ID NO: 27393 - protein, 455 aa, Bacillus cereus CER057; identical to SEQ ID NO: 27383

SEQ ID NO: 27394 - protein, 209 aa, Bacillus cereus CER057; identical to SEQ ID NO: 26769

SEQ ID NO: 27395 - protein, 164 aa, Bacillus cereus CER057; identical to SEQ ID NO: 27379

SEQ ID NO: 27396 - protein, 376 aa, Bacillus cereus CER057; identical to SEQ ID NO: 27381

SEQ ID NO: 27397 - protein, 748 aa, Bacillus cereus CER057; identical to SEQ ID NO: 27372

SEQ ID NO: 27398 - protein, 1053 aa, Bacillus cereus CER057; identical to SEQ ID NO: 27377

SEQ ID NO: 27399 - protein, 738 aa, Bacillus cereus CER057; identical to SEQ ID NO: 27386

SEQ ID NO: 27400 - protein, 183 aa, Bacillus cereus CER057; identical to SEQ ID NO: 27389

SEQ ID NO: 27401 - protein, 80 aa, Bacillus cereus CER057; identical to SEQ ID NO: 27388

SEQ ID NO: 27402 - protein, 971 aa, Bacillus cereus CER057; identical to SEQ ID NO: 27385

SEQ ID NO: 27403 - protein, 458 aa, Bacillus cereus CER057; identical to SEQ ID NO: 27382

SEQ ID NO: 27404 - protein, 503 aa, Bacillus cereus CER057; identical to SEQ ID NO: 27384

SEQ ID NO: 27405 - protein, 965 aa, Bacillus cereus CER057; identical to SEQ ID NO: 27373

SEQ ID NO: 27406 - protein, 333 aa, Bacillus cereus CER057; identical to SEQ ID NO: 27374

SEQ ID NO: 27407 - protein, 209 aa, Bacillus cereus CER074; identical to SEQ ID NO: 26769

SEQ ID NO: 27408 - protein, 455 aa, Bacillus cereus CER074; identical to SEQ ID NO: 27383

SEQ ID NO: 27409 - protein, 376 aa, Bacillus cereus CER074; identical to SEQ ID NO: 27381

SEQ ID NO: 27410 - protein, 1053 aa, Bacillus cereus CER074; identical to SEQ ID NO: 27377

SEQ ID NO: 27411 - protein, 971 aa, Bacillus cereus CER074; identical to SEQ ID NO: 27385

SEQ ID NO: 27412 - protein, 113 aa, Bacillus cereus CER074; identical to SEQ ID NO: 27376

SEQ ID NO: 27413 - protein, 503 aa, Bacillus cereus CER074; identical to SEQ ID NO: 27384

SEQ ID NO: 27414 - protein, 333 aa, Bacillus cereus CER074; identical to SEQ ID NO: 27374

SEQ ID NO: 27415 - protein, 965 aa, Bacillus cereus CER074; identical to SEQ ID NO: 27373

SEQ ID NO: 27416 - protein, 164 aa, Bacillus cereus CER074; identical to SEQ ID NO: 27379

SEQ ID NO: 27417 - protein, 458 aa, Bacillus cereus CER074; identical to SEQ ID NO: 27382

SEQ ID NO: 27418 - protein, 183 aa, Bacillus cereus CER074; identical to SEQ ID NO: 27389

SEQ ID NO: 27419 - protein, 738 aa, Bacillus cereus CER074; identical to SEQ ID NO: 27386

SEQ ID NO: 27420 - protein, 748 aa, Bacillus cereus CER074; identical to SEQ ID NO: 27372

SEQ ID NO: 27421 - protein, 431 aa, Bacillus cereus CER074; identical to SEQ ID NO: 26767

SEQ ID NO: 27422 - protein, 176 aa, Bacillus cereus CER074; identical to SEQ ID NO: 27378

SEQ ID NO: 27423 - protein, 163 aa, Bacillus cereus F65185
MLKKVSQIVLIFGIAFSLSACTETKDSNESKQEDVQDKVYKIGETVDVDGLQVTIDSVKLGYPDYDEDKKKEEILGIIFKVENNSKKEITFAFYEFEITDKKGTRFKEYNNPDSFISKKLAPEEKIQDIMLFDVAKENTYIATYRPEFTRENRIIKFELKPNK

SEQ ID NO: 27424 - protein, 949 aa, Bacillus cereus F65185
MALSLGALQTHAAAEEKVPYNVLKTKPVGIEKSVDEVGHISKVDETLSFQERLKVGDFSQRPASITKKTAVKQVKESYSMADLNKMNDRELVETLGSIKWHQITDLFQFNEDAKAFYKDKGKMQVIIDELAHRGSTFTKDDSKGIQTFTEVLRSAFYLAFYNSELSDLNERSFQDKCLPALKAIANNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHAPKSLTEVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSAEVNPVHVYEREGSYKVSLRVKDDKGKESRSETTVTIKDGSLTESEPNNRLEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYSLSVK

SEQ ID NO: 27425 - protein, 333 aa, Bacillus cereus F65185
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTDQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 27426 - protein, 190 aa, Bacillus cereus F65185
MLLFWKEETMNKKLLAPLLCSTFLFGISACGSHDAPAINEQATSKKTENEKLSSKDSQKELPTNVDSSDVYMSMGSAESLDVIGTGEVKAQGVFKVLDIAVYNRKEEPITLDINNFKLIDGFGREYHISNEYQSVLKAANTSTFKFGIVNPDEHSDGNIVFDVPKNTRGLTLKFNNDKLDKELQLKVELE

SEQ ID NO: 27427 - protein, 336 aa, Bacillus cereus F65185
MKRSKTYLKYLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKLFTLDWKNKKLVEKK

SEQ ID NO: 27428 - protein, 503 aa, Bacillus cereus F65185; identical to SEQ ID NO: 26634

SEQ ID NO: 27429 - protein, 344 aa, Bacillus cereus F65185
MFINFSLLDINRIILPHSPTGATGPTGATGSTGPTGATGSTGTTGTTGATGSTGATGATGATGSTGPTGATGATGSTGTTGTTGATGATGATGATGSTGLTGSTGATGSTGATGATGATGATGATGATGATGATGATGATGATGLTGSTGATGATGATGSTGPTGPTGSTGTTGATGSIGTTGFTGSTGPTGSTGSTGPTGAASVGLTNYLYVFDTTNQSIAVGSSVTFNTNGPITGTALSHITGTGNIIINTLGTYVAEFQLQASRENQFSLQLNGTPISGGRFGTGSPHTINQGTAAFTVTVVPSTLTLINNTSSAGTITLSNSDGGSLTNVSASISIFQVG

SEQ ID NO: 27430 - protein, 457 aa, Bacillus cereus F65185
MNMNNRFLKQLQNMKMNKKSLGVVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVPGTHFIDKKLQPSTEYSYTVKAIDAAGNVSTESTALTVKTTVETPDTEAPTQPKGLHSMGTTASSVDLMWSPSDDNIGVDHYDIYRETEGSMKKIATSNTTSYLDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 27431 - protein, 897 aa, Bacillus cereus F65185
MGFRFLNSEFSFKLLGGNGMVKYSIISKWILGVGLVTITCNGLQIQAETKEKNVKNVLQMEPVGIQKSVNELAHPSKVQENASFTKRFKLADLSQRPLAPTDNIKPLAEEKKYSMAELNQLNNKQLTDLLVTIKWYQIPELFQFNSDSLKFYQDDSRMQAIINKLEEQGQTYTKDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWYRNIDNFINEINRFALLGTVTNKNGWLINNGIYYAGRLGKLHSTPTKGQQVVTDTMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGAKRLDSVVPRKSIIGGLSNDPAKRYTASQTLNAKYGTWDFYNYSFALQSYMYNKRPEMFDKVHDLIRANDVSSYDEYRATLSKDNKLNEEYQSYMQMLIDNRDKYTIPQVSDEYLTQHDPKSLSDVTSDITNEAKLKDVKVTKNKSQFFNTFTLQGTYTGSAAKGEVEDWKVMNETTNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 27432 - protein, 380 aa, Bacillus cereus F65185
MHMKEKRYKNMKTKQTIAASTLALAMIAGANSAHAEVNDATPQQSTGDRLAEIKQHKQELDAKLQQHKENVDQTLNELNKVKENVDTKVNELHERKQVADEKINEVKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAVLQEARQDLINKINEIKQSKQTVSDDLSKKKQDLDIKINDFKHTEKKIDDKLAELHTTKQNVDNKINEVSQSKQMQADNGTKNNNAKELPNAGSEQSNNMALGMLSVLGGVLLLTRNKIKTLFSK

SEQ ID NO: 27433 - protein, 711 aa, Bacillus cereus F65185
MLVKNQDKCSKFQAPIPFPPPGITGPTGPTGPTGALGGPTGPQGIQGVQGPIGPTGPQGIQGVQGVQGENGPTGPTGLTGPQGSQGNQGPMGERGPQGIQGVQGIQGERGPTGPTGIQGIQGIPGPIGPTGPTGIQGIQGMQGEIGPTGPTGVQGIQGVQGEIGPTGPTGNTGIQGVQGNLGGSGLQGVTGIQGIQGPIGPTGPTGSQGIQGEQGPMGPQGETGVQGLQGPQGEMGQVGPTGIQGIQGVQGVIGPTGPQGLQGIQGPVGATGPTGPQGVQGAQGPIGPTGPQGIQGIQGEQGVRGATGPTGLQGLQGIQGPSGPTGPQGVQGVQGPSGITGPTGPQGIQGIQGPQGDIGPTGATGIQGVQGPEGPTGPTGATGPQGIQGIQGIQGPTGPQGIQGLQGIQGPIGPTGPTGPQGIQGITGSTGPTGATGATGPTGVTGPQGPQGIQGPQGVTGPTGATGSTGVTGPQGIQGIQGSQGITGPTGATGVTGITGPQGIQGIQGPQGVTGATGATGATGLTGATGPTGIQGIQGITGATGGTGVTGPTGATGPTGLTGATGSSAISTGGGYFFSTSTSTIAASANIPINSGSTVYGTGVSLTSATTVTVTTPGIYLVSYYFQGDANGGNETVSVRLLLNGTQLTGSFIQNVTTSTVVIEPAISNTLLVNVTSANSTLILQNGPLGVGHVTTIAGAITASLNVVRIL

SEQ ID NO: 27434 - protein, 824 aa, Bacillus cereus F65185
MALPLPLIGATGPTGNSGPIGPTGGHEGPVGPTGVTGPTGATGPQGPQGIRGIQGPQGTTGAQGIQGAIGDTGEQGITGPTGLQGAQGLIGNQGLIGDIGVQGLEGIQGATGPAGSQGIQGIQGIQGEIGERGQTGAQGMQGERGITGVSGITGPQGPQGVQGIQGEQGAIGIQGEDGFQGIQGITGEEGPQGAQGIQGEVGPTGSTGMQGAQGISGIKGITGVIGLQGPQGVQGIQGITGATGFQGIKGIRGITGATGSIGTQGSEGPPGGPTGVTGPIGPSSGVTGPAGPPGPPGGPTGPTGATGSTGVSGGIGPIGAQGVQGITGPTGSQGVRGAQGSQGVVGAVGVQGAQGPQGNQGIAGPTGAEGSQGIQGPLGVTGPTGAEGPKGIQGIQGVIGPTGAQGMVGIQGIAGPVGVTGAEGAQGTQGIRGATGPAGAQGIQGVQGIQGETGAAGTQGPQGVQGIQGTTGLTGTQGAQGPQGVQGIIGPTGAIGLQGPQGLQGITGPTGAQGVQGIQGVQGIIGPTGAQGIRGPQGNTGEVGITGSQGVQGAQGSQGPQGPQGNVGITGATGETGATGATGATGLQGVQGVQGITGIQGITGTTGNTGATGPQGIQGIQGIQGLQGPIGASGVTGASGSIGPVGAQGSQGPSGVVGPTGATGSAGSIGFLGIAGATGATGLPSGGGYFFSTSTSTIAANALIPINSGSTVFGSDVSLTNATTVTLSTPGIYLVSYYFQGDPTAGNETISVRLTLNGIQVAGSFIFYVTGGTFILEPAVSNTMVIEVTSSNATLSLQNGPLAIGHVTTLSGVITASLNVLKIV

SEQ ID NO: 27435 - protein, 55 aa, Bacillus cereus F65185
MENEKYLQVVEDEELEQLVGGIGPGWVETITKDCPWKMPVACVTIMGQTICKKCR

SEQ ID NO: 27436 - protein, 1062 aa, Bacillus cereus F65185
MTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPPGYVSDDKPQTIEVKTGETGAVQIVNNKVKGNIEIKKLSDSGKILPNVEFTVFTEDGKEVKKVVTKENGIANVEDLTYGKYYFLETKTPNGYIGNKTKYPFEIKEHNKTLNFTVENTEVKGSVKLLKVDNEDISKKLEGAAFELKDASGKVVGEYKTDKNGEINVKDLAYGKYSFVEKASPNGYVLVKEPILFEIKEHGKVIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTASDKKDGTKEMHTSKSVTIQDKVEFKDLQVGKEYTLKGKLMDKKTNKPFVVNGKEVTAETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKTVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKPEQPKPEQPNSGKNTPTPEQPNEQVKEQPQLKKEIQSKIGWLPQTGTNLTSWISMAAGALLLIVGGVIFLKRKNA

SEQ ID NO: 27437 - protein, 971 aa, Bacillus cereus F65185
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITEKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNTSGQFEYDVVFHGINTEEGAENKAPVAVINGPYSGNVNEAISFTSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 27438 - protein, 462 aa, Bacillus cereus F65185
MSSWLNNTNGYCSCNNQNGVHVDSCCFSCDGTVPKLGPTGPTGPMGSTGPTGATGSTGSTGSTGPTGATGSTGPTGATGPTGSTGSTGSTGATGATGSTGPTGATGATGSTGPTGATGATGSTGSTGATGPTGATGATGPTGATGATGATGSTGSTGATGPTGATGITGVTGPTGATGITGVTGITGATGATGATGPTGSTGPTGSTGSTGPTGATGSTGATGSTGPTGATGSTGATGSTGPTGATGSTGVTGSTGATGSTGPTGATGSTGVTGSTGATGPTGSTGPTGSTGPTGSTGPTGATGATGPTGSTGSTGSTGPTGATGTSITATYAFANNTSGTAISVVLGGTNVPLPNNQNIGPGITVSGGNTVFTVANAGNYYISYTINITASLLVSSRITINGGALVGTINAPAVATTSFSATIITTLAAGDAISLQLFGLLAVATLSTTTPGAVLTIIRLS

SEQ ID NO: 27439 - protein, 1309 aa, Bacillus cereus F65185
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGPQGVQGLQGPIGPTGATGAQGIQGIQGLQGPIGATGPEGPQGIQGVQGLPGVTGPQGIQGAQGIQGTQGPSGNTGATGATGQGITGPTGITGPTGITGPSGGPPGPTGPTGATGPGGGPSGSTGATGATGNTGATGSTGVTGATGSTGPTGSTGAQGLQGIQGIQGPIGPTGPEGPQGIQGIPGPTGVTGEQGIQGVQGIQGATGATGDQGPQGIQGAIGPQGATGATGDQGPQGIQGVPGPSGATGPQGVQGIQGPMGDIGPTGPEGPEGLQGPQGIQGVPGPVGATGPEGPQGIQGIQGPVGATGPQGPQGIQGIQGVQGITGTTGVQGATGIQGIQGEIGATGPEGPQGVQGAQGEIGPTGPMGPQGVQGVQGIQGATGAQGVQGPQGIQGIQGPTGATGDTGATGATGEGTTGPTGVTGPTGVTGPSGGPAGPTGPTGPSGPAGVTGPSGGPPGPTGVTGATGVTGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGPQGPTGIQGIQGEIGPTGPEGPEGLQGPQGIQGVQGPVGATGPEGPQGIQGIQGPVGATGPQGPQGIQGIQGVQGITGATGAQGATGIQGIQGEIGAPGPEGPQGVQGIQGVIGPTGPMGTQGVQGIQGIQGATGAQGVQGPQGIQGIQGPTGATGDTGATGATGEGTTGPTGVTGPTGVTGPSGGPAGPTGPTGPSGPTGVTGPSGGPPGPTGATGATGVTGDNGATGSTGVTGATGATGATGVTGLQGPQGIQGVQGEIGPTGPQGIQGPQGIQGVTGATGAQGPQGIQGPQGDIGPTGPQGIQGPQGPQGIQGATGATGAQGPQGIQGPQGDIGPTGPQGPQGIQGPQGIQGPTGATGATGATGPQGIQGPQGIQGPQGIQGPQGIQGPTGATGATGATGPQGIQGPQGIQGPTGATGATGATGLQGIQGPQGIQGPQGIQGPTGATGATGSQGLTGDTGPTGAGATGATGATGVSTTATYAFANNTSGTAISVLLGGTNVPLPNNQNIGPGITVSGGNTVFTVANAGNYYIAYTINLTAGLLVSSRITVNGSPLAGTINAPTVATGSFSATIIANLPAGAAVSLQLFGVVAIATLSTATPGATLTIIRLS

SEQ ID NO: 27440 - protein, 56 aa, Bacillus cereus F65185
MVFSIKPTDSGVGSATVTWTSITTGNPVARGDAISLYITPGITASAVYSIFLITDI

SEQ ID NO: 27441 - protein, 59 aa, Bacillus cereus F65185
MKPEKPEVRLEKLIKEPQVKVEKELPKTGAAHSWMMSVGAGISFLVGGVLFVLGRRRKQ

SEQ ID NO: 27442 - protein, 431 aa, Bacillus cereus F65185; identical to SEQ ID NO: 27092

SEQ ID NO: 27443 - protein, 338 aa, Bacillus cereus F65185
MTGCSSSQSSTTVKNGKASSSSKNVEVEVENAEYVLPLSGAMGGINKDTVLKFKVSLKNKGDEMLEISPYLFTLYQGDEKMKKYDKADSNKLRLIELEPGKKTSGILYYEVNKASSYELVYSNEETKKRDDETEKVSFKIDTQEIEKNTKDLNKPAEALKSYINAIYYDKDINKINKLSGEDGKQFTQNIQQEFKKDALSSTHNGISDQEFENYYKKLKSVLQEKVTFKVKSVGSSPEEDKVEVELKVKPLLLSELQPKLHKENERLLKENPGIEQPKLFSQSFGYFISILPEAKVSDKEKVIKVEMERYGKEQWRFSKDKVNDSEDVMEIMGEFLKQ

SEQ ID NO: 27444 - protein, 450 aa, Bacillus cereus F65185
MERLRKSKKGIGACVLAAGVTAITMIPQSAYAHGFVEKPSSRAALCSQNYGALNLNCGNIMYEPQSLEAPKGFPDGGPIDGKIASAGGLFGGILDQQTSNRWFKNTIKGGANTFTWKYTAAHPTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDIEAPTQPKGLHSMGTTATTVDLMWSPSEDNVGVDHYIVYRESAGVMNKIGTAANTSFMDKDLKANTSYKYVVTAVDLAGNESSRSDVLTVTTKSEDSTYEKWDARKAYTKGDRVVHEGKVYEAVQDHQGNGDSNWIFALSLWKPVLNK

SEQ ID NO: 27445 - protein, 772 aa, Bacillus cereus F65185
MNSLDCKNMEKKTKNLRVLRKNEGDYMGNNSKHKTRKILAATATVTMLATGMISSSDVFAEQKEQQKNLSTSLQNEKSVKSENRTFTVPGKGDVEVLKQQERKNMAFSPYEPTGLYAKPNEQITINVEGNQDIQVYIGTYSYDASWREDSKIKSFTLKPGINTIQSPNGGMIYFYNKQQGGTIRTTITAGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYATSYRTAYVGDAIQYVLDINKFITDGWGPWHEAGHLRQQSPWKFYNMTEVQNNIYSLSVEKAFNQPSNLEKSGIYPKAFQYLEQVNKNYDEISDVFVKLVMLWQLQLAYGEDFYPKLHQLYRDMPSSELPQTDENKKQLFMISASKVAKQNLIPFFEKWGLRPNNDTIQKVAALGYPILTAEIWKGTDSNPIKPDMPNVNNILEGNQFAWSLKGISDFEFAKINFNKSTEEMQVDLKSGVPHHYFNETYASIKVQNASGKVVYNKDIYGNKQQNAESQKVSVKVGDYIELTHLEGVHRATLTNVDNSKQESFGKKAMYEVTKEGLKKVNQIVNPKPDTEAPTQPQGLYASNLTSNSVELKWNPSTDNVGVKEYQVLRDGQLIQTVQGTTFTDQNLTVNKEYKYAVKAVDAAGNTSIQSEILLVKTKDQNVSYEKWDPKKAYTKGDKVEHQGTVYEAVQNHQGNGDPNWIFALSLWKAITIN

SEQ ID NO: 27446 - protein, 172 aa, Bacillus cereus F65185
MGKIFKFGCLGIIALFVIGIIAMVAGGGDSTEKTSTDTRAVSKEGVSSDVKIAVGSMETVDSVGNEYTKEQAQGVFKILEVTLTNNQKDAITVDANSFKLVDSKGREFTYSTQGQTSFDLANGGKTDFFLKQLNPGLTQTGKIVFDIPKDAEGLFLKASGGMTGKEINLKVE

SEQ ID NO: 27447 - protein, 245 aa, Bacillus cereus F65185
MVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDSANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 27448 - protein, 782 aa, Bacillus cereus F65185
MYGHQLTAHVDKKGIIKSISGASAQNLTQEDLKKPINLSKEEAKQYIYKKYGNDIKFISEPEVKAVIFVDENHGQASNAYQVTFAATTPNYVSGTYLVNAHNGDILKDMVQESSLKISEEYVESVKENKTSNFTSLTGTGKDDLGVTRTFGISKQTSGNYALADYTRGQGIETYDVNYRDITNEESYYPGILATSASTTFNDPKAVSAHFLATKVYDFYKEKYNRNSFDNKGKKVLSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANTDELNMTSNFSELKLACLKVATNKYGTSSIEVQAVQNAFDAAKITGTVKENEKTAENQAPELTVPFTITLRVGDTFDPMRNVKAVDKEDGDLTNKVKHKGDVDTSKPGTYIVEYLVVDSQGRTTTATQTVIVEGNGEILDLEPKLTVPVGATIHVGDSFDPMIKVKAIDKEDGDLTSKVKIAGGVDTSKVGTYVLTYTVTDSKGHEVTAKQTVTVKVREEVTNEKPILKVPATTSITEGDQFDPLVGVSATDKEDGDLTSKIAYEGTIDTTKAGTYEIIYSVKDSMGNDVNTIQKVLVKDKETSKANGLANKANKSNISNNSNSDKKEYTYKELPKTGVSTTNSAAIGILMIITGTVLTFVRKFRKIQK

SEQ ID NO: 27449 - protein, 357 aa, Bacillus cereus F837/76
MKQNIKNSIKVSFIEDPYADKKIAIVTTDGSNIHAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNYPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKALEEQISSIKNVNNQLNKGKGKLSFSMNGNQLKATSSNAGYGISYEDKNWGIFVNGEKIYTFNEKTTVGNISNDINKLNIKGPYIEIKKI

SEQ ID NO: 27450 - protein, 148 aa, Bacillus cereus F837/76; identical to SEQ ID NO: 26670

SEQ ID NO: 27451 - protein, 564 aa, Bacillus cereus F837/76
MKKLFSMVLAFILMFSTLPSAFAANEAPTKGSLTIHKYAHEKDGQEGEAGTGEPGQKIPEGATPIEGVEYEVIQIASFELITKDGEIVKEGEKEVKNATPIKDKTGKDGTVKFDNLPIGRYLVKEISGPTNVNLNTDPYTIEIPMTDKEGKKLNYDVHIYPKNEIKRGAVELTKTDDAGKPLENVEFTLYHKGTDKVVVDKAGKELKDLKTDKDGKIRVDGLLHGEYYFKESKALPGYVLDPKHREFKIEKSGAFPKDGQAGYGEVVKLDTIINYKKPTIDKKINGNLNGLPINVDEEFTYDIKTTLPGDIHKYKKYVITDNVDPKLTIIGTPVVTIDGEKVSSDVVKVTLGEKTAAGQLVTVTVENFKALEGKKELHLQIKAKVNGDINGGTEIKNIAKIDYETGDEVTPPDDETTTPPVTVIVTDGKISLKKIDGATKDALEGAKFELRKDGKVVKVKGVDVVGVSDKDGMIKWENIPYGEYEIVEIEAPKYTDKGEVKSYQKLREPIKVKIDKDNQTVKLTVENNKSGWILPATGGIGTILFTVVGLVLMGAAFMFLRRKA

SEQ ID NO: 27452 - protein, 965 aa, Bacillus cereus F837/76; identical to SEQ ID NO: 26610

SEQ ID NO: 27453 - protein, 251 aa, Bacillus cereus F837/76
MNEKYIILYGTALEPNLIGPTLPPIPPFTFPTGPTGITGPTGATGFTGIGFTGPTGVTGPTGIGITGPTGVTGPTGIGITGPTGITGPTGIGITGPTGVTGPTGIGITGPTGATGLGILPVFGTITTDVGIGFSVVVNTNINFTLPGPVSGTTLNPVDNSIIINTTGVYSVSFSIVFVIQAISSSILNLTINDSIQFAIESRIGGGPGVRATSARTDLLSLNQGDVLRVRIREATGDIIYSNASLVVSKVD

SEQ ID NO: 27454 - protein, 971 aa, Bacillus cereus F837/76
MKGYSKKVLVGVSFASLMLGSFQGGALAEGTKGEQVSYRNVLKMEPVGVQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTWVDNLSAGNVIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGMNTEEGAVNKAPVAVINGPYSGNVNEAISFKSDGSKDEDGKIVAYKWEFGDGTVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 27455 - protein, 455 aa, Bacillus cereus F837/76
MNNRLLKQLQNMKMNKKSLGAIALTAGIIGTTLIPQNTYAHGFVEKPGSRSALCSPTYGALNVNCGSVMYEPQSLEAPKGFPQGGPVDGQIASAGGKFGGILDQQTADRWFKNTITGGENTFTWKYTAPHLTSKWHYYITKKGWDPNKALTRADFEPIGTVQHDGSAASNHLTHKINVPTDRSGYHVILAVWDVADTANAFYNVIDVNLINDVKPDTEAPSIPNRIQAQKVTANSIELAWNASTDNVGVKGYQIFRNGEVIDTVPGTHFIDKKLQPSTEYSYTVKAIDAAGNVSKESATLTVKTTVEAPDTEAPTQPIGLHSMGTTASSVDLMWSPSDDNIGVDHYDIYRETKGSMEKIATSNTTSYMDKYLLSNTTYKYVVKAVDVAGNESVQSDIFIITTKTESVSYEEWDAKKAYEKGDRVLHEGKVYEAVQSYKGNGDPNWIYALSLWKTV

SEQ ID NO: 27456 - protein, 780 aa, Bacillus cereus F837/76; identical to SEQ ID NO: 26613

SEQ ID NO: 27457 - protein, 3314 aa, Bacillus cereus F837/76
MKKLFNICLIVFVLFSQFISFPYNQAKAETLQETSLFDTVEMKDGTDHIIDEAKNPNNLIKIGSTIQVEYAWSIKDQQVVHANDTAVIQIPLALKVSKDLQGDLVTDQKNIGQYFITAKDNKLKLIFNDQVENSKDAKGKIKIDTVFNPTLKAEEKSVQIAFPLGTLVQPITVPIQLEDSKEDGTKQDTNKQVPDQVAKPATDNPEQNPATKPATDNPEQNPATRPVTDNPEQNSATKPATDNPEQNPATKPATDNPEQNPATKPAADNPEQNLASDPAESTNSGPKQITTNILTGVKLTDKDGKPFTEDNRPSTDSPANIEFTWELLKSMNVKSGDYYIFDLPKHFKIYNTINSPLYDSENNPIGNFTVTKDGKVTMTFNDYVEEHPDVVGNLQLKTEFNKAEIKGTTTQEIPFPIKDKDVSITVDFKPNIQTTTNKKGLPDRPINTNEINWTVEMNKTKDTLKNAVFKDNIPQGTSLNKDSIKVYYLEVDVNGNATRGKEADPADYKIISSDGSKLEIAFKDSIKEAYQIEYVTKITDENVKNFQNNVTITSDNQGQQKASSTVTVSRGTHLNKTSKYDPKTQTIEWTITYNGDQRNIKKTDALLKDIFDDTHELDVNSIVVKNASYDDKGRLVTGDAVNNYTVSNKKNGFDLQFNEDINSAYVITYKTKPTNNVIKDGKIKNIVTADNGSSKENEAGFQQQNIIKSNNKAETNYKDKTTTWTITVNNNNYPLNNAIITDTFDHGGLQLKDKKLEIKDGDYTLQAGTDYVLDVTDKGFKITLIGTYQSNMTKTLVVKYTTDFDYTKLESGKTSFKNTGNLSWIDTDSNPQSNKVEANFDPDNFTKANGYKYGSYNAQTKEITWVIGFNYNNVEIKDPYVIDVIQDKQKLVPGSIEVRDMILNGSPDNAQPGNAVPTEKYELEEPTEKNKNTLKVHFKQSINSPYYIIFKTSLDGELIQGTYKNEAELKDGSKIVNTLKGDAQVKKGGSFVTKKAVQDDNYINWSIAINESQSTIADAVVTDDPTDNQVLVEDSFHLYPTTVDYYGNVTKDTANELKQGTDYKLKITTDNNTGKQHFEIAFLKKIDRAYILEYRSLINADDKEKVSNKAKIAGNQLTVKNTETTETIEVRMSSGSGGGSATKGRGNLEIIKVDNDNKNTLLTGAEFTLYDRTGKTVIRKITTDKDGIAKFNNLKRDKYLLKETKAPEGYVISWDLKQGKIVELGTQETTTYKLANKKFVGKVVLTKSDDLNKNVTLQGAVFTLLDKDKKIISEHEKLTTNNKGQITVDHLKPGTYYLKETKAPEHYKLDDRLIEVKIAEDQTTVINRTATNSLIPGSAILTKVDKDGKTLAGAEFSVRDRHNNVIRGYEKLTTNDQGQIEATNLRPGDYQFVEEKAPKDYDIDKTPIEFTIVKSQKKAVTVTATNHLIKGGVTLTKTDDIDGTALAGAIFKIVDANDEKKVIRENVKTGADGKVTVKDLEPGTYKFIETEAPKDYVLNTNPIEFTIDKSQQSFATVTATNSLKTGEVELLKVDEFGDKKPLAGAVFKIVDVNNNDVRTDLTTDADGKTKADKLRPGTYKFIETAAPEHYVLRAEPIEFTIDRSQKETLLVKAENALKPGDVELTKVDDIDGTALAGAVFKIVDANDEKKVIRENVKTGADGKAIATGLRPGDYKFIEVTAPKYYDKNTNPIEFTIKESQGTSPITVTAKNSLTKGGIELTKVNAADEKETLEGAVFKIVNRDTNEDARTNLVTNSEGKLIVDDLRPGNYKLIETKAPTYYDVNVEPIEFTIEKGQQTLLPLTFKNSLTKGKVKLIKEDDVKSSIALAGAVFTLQDANGTEIAKDLKTDEHGVLVIPDLAPGDYQFIETAAPEHYKLDQTPIKFTIKKGSKEDLPVPVTVKNSLLTGGVTLTKVDDVDGTTLEGAEFIIVDAHDTEKVVRKGLTTDEHGKVSASDLRPGDYQFIEVKAPKDYTLGNDPIPFTIGKSQKENITVTATNSLKKGAVTLTKIDDIDRTMLKGAIFKIVDMDGNEVRTNLVTNKNGKIYVPDLRPGDYQFIETKAPEHYVLDETPIPFTIERNQTKEINVTGKNTLKKGSVELTKIDDIDTDTKLANAVFNLLDADGEIVEEGLKTNAEGKIVVENLRPGTYQFVETIAPEHYDLNKTPIEFTIKKSQTETLHVTAKNALTKGAVELSKVDDIDGTKLEGAVFNIVDMKGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKRPIVVTVEKSQKNIATVTMKNSLTKGGVELSKVDDVDGTTLEGAVFNIVDMKGTVIRENLTTNSQGKISVSNLRPGDYQFVETKAPKHYDLNKEPIPFTIEKGQAEPISVTAKNSLTKGAVELSKVDDIDGTALEGAVFKIVDMNGNDVRTGITTDAKGKISISDLHPGDYQFIETTAPKHYKLDATPIKFTIEKSQAEKLQVTAKNSLIEGAVELIKVDDINPDTKLSDAVFNIIDAKGQVVRTNLTTDKDGKVSASNLRPGDYQFVETKAPKDYDLNKTPIPFTIEKSQPTHVSVTAKNGLTKGGVELTKVDSLNAKETLEGAVFKITDMNGNDIRTNLVTNKDGKIIAKDLQPGDYQFIETKAPKHYDLNEDPIKFTIERSQTKHVFVTATNSLTKGSVELIKVDDVEENTTLEGAVFKIVNKDGHDVRTDLTTDKNGRLVVDELPPGDYEFIETKAPTHYDLNETPIKFTVKKGQEKIASVTATNSLTKGAVELSKVDDVDGSALKDAVFKIVDMNGNNVRSNLTTNKDGKISVSDLRPGDYQFIETKAPTHYDLNQTPINFTVEKSQTTTASVTAKNSLTKGAVELTKVDDIDGAILEGAVFKIVDQNGLDVRTDLTTDKDGKISVSDLRPGDYQFVETKAPTHYDLNQNPINFTVEKSQTTTASVTAKNSLTKGAVELTKVDDIDGATLEGAIFKIVDMNGNDVRSDLTTNKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPETHGKETSEELENGNPKTQTNKQQDDQNKGKELPNTGHKKDSTQTVGILLLLAGLLSILATKRKKYY

SEQ ID NO: 27458 - protein, 431 aa, Bacillus cereus F837/76; identical to SEQ ID NO: 26106

SEQ ID NO: 27459 - protein, 333 aa, Bacillus cereus F837/76
MKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSSTPEDGGVAIVSKWPIVEKIQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYDDYSDHYPVEATISMK

SEQ ID NO: 27460 - protein, 201 aa, Bacillus cereus F837/76
MKQNDKLWLNKGIIGPENIGPTFPVLPPIHIPTGTTGVTGATGITGTTGVTGATGITGVTGATGITGVTGATGITGVTGATGITGVTGATGITGVTGATGPTGTTGVTGPTGVIGPITTTNLLFYTFADGEKLIYTDSDGLAQYGTTHILSPDEVSYINLFINGILQPQPLYQVSTGQLTLLDNQPPSQGSSIILQFIIIN

SEQ ID NO: 27461 - protein, 372 aa, Bacillus cereus F837/76; identical to SEQ ID NO: 26596

SEQ ID NO: 27462 - protein, 503 aa, Bacillus cereus F837/76
MFNKKMVAMAMTVPLVMGTLSTVSAVETKKQVKVEAYSPQKQAIEYLKGNANQYGLQPDLSDLQYISTTETPVASYVRFQQVVNGAPVFSNQITVTLNGEGKGVLAVSDYQPIKAVKQVTEKISEKDAIQKSMAYVGEASEQNLWAPTEKEFGYIIEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAAAYSSSDPTCLRRLDTNKVYPKDMKNQVHADGEIWSQGQYEMAQAFGRDVATKIILQSHWSLTPNSKFSDGAKAIKQADALLYGGQHAADIDRIWAARGISTN

SEQ ID NO: 27463 - protein, 234 aa, Bacillus cereus F837/76; identical to SEQ ID NO: 26616

SEQ ID NO: 27464 - protein, 187 aa, Bacillus cereus F837/76; identical to SEQ ID NO: 26615

SEQ ID NO: 27465 - protein, 1124 aa, Bacillus cereus G9241
MIATQEVSEATGWKYEFKDLAAYDENGVAYKYEVKEQAVPGYESKVNGYDITNTKVGETKVEGTKTWKDDNAKDRPEMIKVDLLQNGKVVDTKEVTAATEWKYTFEKLQAYDTNGVAYKYEVKEQPIAGYESKVSGTDITNTKVGKTKVEGTKTWKDGNATDRPTMIKVDLLQNGNVIQTHDVLAVMGWKYIFADLEAYDAEGKAYEYEVKEQPVPGYESKVSGTDITNTKVGQTKVEGTKTWKDDNATDRPEMIKVDLLQNGTVIATQEVSKATGWKYEFKDLVAYDENGVAYKYEVKEQVVPGYESKVNGYDITNTKVGETKVEGTKTWKDDNAKDRPEMIKVDLLQNGKVVDTKEVTAETNWKYTFEKLQAYDANGVAYKYEVKEQAIPGYESKVNGTDITNTKVGKTKVEGTKTWKDDNATDRPEMIKVDLLQNGTVIATQEVSKATGWKYEFKDLAAYDANGVAYKYEVKEQQVDGYKSEVKGYDITNTKVGETKVEGMKTWKDDNAKDRPEMIKVDLLQNGKVVDTKEVTAATNWKYTFEKLQAYDTNGVAYKYEVKEQAVPGYESKVNGTDITNTKVGKTKVEGTKTWKDDNATDRPEMIKVDLLQNGTVIATQEVSKATGWKYEFKDLAAYDENGVAYKYEVKEQAVPGYESKVNGTDITNIKVGETKVEGTKTWKDDNATNRPSTIKVDLLQNGKVVDTKEVTAETNWKYTFEKLQAYDANGVAYKYEVKEQPVAGYKSEVKGYDITNTKVAELTVEGTKTWNDNNATDRPSSIKVDLLQNGKVVDTKEVTAATNWKYTFEKLQAYDANGVAYKYEVKEQPVAGYQSDVHGYDITNTKVGETKVEGTKTWNDNNATDRPSSIKVDLLQNGKVVDTKEVTAETNWKYTFEKLQAYDAEGKAYKYEVKEQPVAGYESKVSGTDITNTKVGKTKVEGTKTWKDDNATDRPEMIKVDLLQNGKVVDTKEVTAETNWKYTFEKLQAYDANGVAYKYEVKEQPVAGYKSEVKGYDITNTKIKDKPNVDPKDPSTDPKDPSTDPKDPSTDPKDPSTDPKNPNTNTGSNSDSKVPSTTENDKPTLLPNTGGTSAGTSAGMSSILGGMVLFLLGGILFARQRIK

SEQ ID NO: 27466 - protein, 680 aa, Bacillus cereus G9241
MYLKRITSIFSIIMIFMFTIGQSLLPIVANAQELNTAGIVDSFKIDKTDLYVGQRTKVTVNFSEKDGLKLKPGDTLTLTLPPELKGLNTEFLLDDYGTCKVTAGTVVCTFNDKVSTHQNIKGYLNFFIEAANVGTDEKKEIETNFGTNVDKQSVTITGPSSGGGTDPGKPPFFYKTGDMNSGKSDEVRWFLNINLAKEELSRDIVVTDNLQEGQTLNKDSFYIIVDDHIGRRSLTLQELEKQGYGTITFTGDKSFKVVLNKDKARLASFSIGYTSTITEAGKKQDFFKNDYTIDYQVLNGEPVTESGTQPVENMTAGGGAEGNVTPRGTLKIVKHIEGDEEKVIPNVSFKLYKEPNEQVGDVYTTDEKGIIEIPNLQPGKYYVKEVSAPDYIDFDPQAKVNFEVKSDAVNGVKLLIPNKVKTTSIAGTKTWKDDNEKDRPSSIKVDLLQNGKVLDTKEVTAADGWKYKFDNLTVYDANGVAYKYEVKEQPIDGYTTEVNDYDITNTKVVQTTKVEGTKTWKDGNAEGRPTMIKVDLLQNGKVIATQEVSEATGWKYEFKDLAINDADGKAYKYEVKEQAVDGYESKVNGYDITNTKVGKTSVAGTKTWKGGTEEEHKAIKVDLLQNGTVIATQEVSKETGWKYEFKDLVAFDENGKAYKYEVKEQPVDGYESKVNGYDIT

SEQ ID NO: 27467 - protein, 212 aa, Bacillus cereus G9241
MNSDEKLSLNKGMVRPENIGPTFPVLPPIYIPTGATGTTGATGATGATGGGAIIPFASGTTPSALVNALIANTGTLLGFGFSQPGVALTGGTSITLALGVGDYAFVAPRAGVITSLAGFFSATAALAPLSPVQVQIQILTAPAASNTFTVQGAPLLLTPAFAAIAIGSTASGIIPEAIPVAAGDKVLLYVSLTAASPIAAVAGFVSAGINIV

SEQ ID NO: 27468 - protein, 503 aa, Bacillus cereus G9241
MFNKKMVAMAMTVPLVMGTISTVSALENQQQVKLEAYSPQKKATEYLKENAAQYGLKADLSDLQYISTTETSVASYVRFQQVVNGAPVFSKQITVTLNGEGKGVLAVSDYQSVKGVKEVTTKISEKDAIQKSMAYVGEESEQNLWAPTEKEFGYIVEEGIARPVYKVVVHSNNPFGAWETFVDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDNNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 27469 - protein, 143 aa, Bacillus cereus G9241
MKKANGIAKSVAVASVIMSGSLGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGY

SEQ ID NO: 27470 - protein, 718 aa, Bacillus cereus G9241
MVDNLSAGNAIYDIMQGVDYDIQSYLYDTRKAPKDTVWYQKIDSYINELSRFALIGTVTVKNGWLINNGIYYTGRLGTFHSTGTKGLQVVTDAMKMYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKIHDLIRKNDVTAYDAYRSALSKDANLNKEYQDYMQMLVDNREKYNVPLVSNDYLATHAPKPVSDIAAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKAPVAVINGPYSGNINEAISFKSDGSKDEDGKIVAYKWEFGDGTVSNEQNPIHVYTKEGTYTAKLTVTDDKGLTNTVTTNVTVQKKEDNSVEKEPNNSFQTANKLQFNQVLRASLGNGDTSDFFEINVETAKNLQINVTKENNIGVNWVLYSEADLNNYVTYAQQEGNKLVGSYYTYPGKYYLHVYQYGGGTGNYTVEVK

SEQ ID NO: 27471 - protein, 202 aa, Bacillus cereus G9241
MKKPFYKKWWFWVIVVIVVLGAYGNSTKDKEETKTASTEPKQEAKQETKKDEPKKEEAKSEPKKEEPKKELSKEGESSKVKIAVGSVESTDSVGGQYLSEKAQGVFKVVEISITNNQKDAITVDANSFKLVDNQDREFKYSTQAQTAFDVGNGGKSDFFLKQLNPGLTQTGKIIFDVPADAQGLVLKARGGMMGKEIKLKVE

SEQ ID NO: 27472 - protein, 455 aa, Bacillus cereus G9241
MNNRFLKQLQNMKMNKKSLGAVALTAGIIGTTLIPQNAYAHGFVEKPSSRSALCSPTYGALNVNCGSVMYEPQSLEAPKGFPQGGPVDGQIASAGGKFGGVLDQQTADRWFKNTITGGENTFTWKYTAPHLTSKWHYYITKKGWNPNKALTRADFEPIGTVQHDGSAASNHLTHKINVPIDRSGYHVILAVWDVADTANAFYNVIDVNLINDVKPDTEAPSIPNGIQAQKVTAHSIELAWTASTDNVGVKGYQIFRNGEMIDTVPGTHFIDKKLQPSTEYSYTVKAIDAAGNASKESAKLTVKTTVEAPDTEAPTQPKGLHSMGTTTSSVDLMWSPSDDNIGVDHYDIYRETEGSMKKIATSNTTSYMDKNLLPNTTYKYVVKAVDVAGNESVQSDIFAITTKTESASYEEWDATKAYEKGDRVLYKGKIYEAVQSYKGNGDPNWIYALSLWKTV

SEQ ID NO: 27473 - protein, 800 aa, Bacillus cereus G9241
MTRNKFIPNKFSIISFSVLLFAISSSQAIEVNAMNEHYTESDIKRNHKTEKNKTEKEKFKDSINNLVKTEFTNETLDKIQQTQDLLKKIPKDVLEIYSELGGEIYFTDIDLVEHKELQDLSEEEKNSMNSRGEKVPFASRFVFEKKRETPKLIINIKDYAINSEQSKEVYYEIGKGISLDIISKDKSLDPEFLNLIKSLSDDSDSSDLLFSQKFKEKLELNNKSIDINFIKENLTEFQHAFSLAFSYYFAPDHRTVLELYAPDMFEYMNKLEKGGFEEISESLKKEGVEKDRIDVLKGEKALKASGLVPEHADAFKKTARELNTYILFRPVNKLATNLIKSGVATKGLNVHGKSSDWGPVAGYIPFDQDLSKKHGQQLAVEKGNLENKKSITEHEGEIGKIPLKLDHLRIEELKENGIILKGKKEIDNGKKYYLLESNNQVYEFRISDENNEVQYKTKEGKITVLGEKFNWRNIEVMAKNVEGVLKPLTADYDLFALAPSLTEIKKQIPQKEWDKVVNTPNSLEKQKGVTNLLIKYGIERKPDSTKGTLSNWQKQMLDRLNEAVKYTGYTGGDVVNHGTEQDNEEFPEKDNEIFIINPEGEFILTKNWEMTGRFIEKNITGKDYLYYFNRSYNKIAPGNKAYIEWTDPITKAKINTIPTSAEFIKNLSSIRRSSNVGVYKDSGDKDEFAKKESAKKIAGYLSDYYNSANHIFSQEKKRKISIFRGIQAYNEIENVLKSKQIAPEYKNYFQYLKERITNQVQLLLTHQKSNIEFKLLYKQLNFTENETDKFEVFQKIIDEK

SEQ ID NO: 27474 - protein, 378 aa, Bacillus cereus G9241
MHNVLLLDTFSFGLIRTEIVKDLKKVKSHNRVFDLFITIHMEVWNVKGKLLKGVLSFGIGLGVLYGGSSAQADTSTDQNNTLKVMTHNVYMLSTNLYPNWGQSERADLIGAADYIKNQDVVILNEVFDNSASDRLLGNLKQEYPNQTAVLGRSNGNEWDKTLGSYSSSTPEDGGVAIVSKWPIVEKIQYVFAKGCGPDNLSNKGFVYTKIKKNDHFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIVASKDHANPSFIENKVLQPKSPQWTVTSWLKKYTYNDYSDHYPVEATISMK

SEQ ID NO: 27475 - protein, 788 aa, Bacillus cereus G9241
MLAGATLAIGVIAPQVLPTTAHADEKAGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPDVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWTFKPIVADKLNTTFDSSPNAQKYIKKDGKISYVGPSENEFAKYAIDITKKNDDDKETGGENPTPPPTGEGNNGGNPTPPPTGGGNNGGNPTPPSTGEGNNGGNPTPPPTGEGNNGGNPTPPSTDEGNNAGSGQTTTDNQNAKETTTVSENKEERDLPKTGTSVASTIGAGLAFIGAGFLLLFRRKKANK

SEQ ID NO: 27476 - protein, 337 aa, Bacillus cereus G9241
MKRSKTYLKCLALSAVVASSALALSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGLSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKSFTLDWKNKKLVEKNR

SEQ ID NO: 27477 - protein, 305 aa, Bacillus cereus G9241
MNIKQSFKLLAMFLSVLFVLFPLQKAFAEVMDHTKYQMDWSYSKSKKKPIRTELIKTADGKIAFCLNVDLKSPSGQDLPEMGKVDINVYRVLLNGYPQKSPQELGVSDWREAHYATQLAVWNALKQIDINDLDFRNKNVEKVTRDIVAKANASEELQEITMSVTPTEEQEAVLKNDFFETGLYTVETNAKSGTYKVQATGAPAGAKFVNETGESKTEFNVGEKFRILIPKQTPAGGFSFKVIGKLTKLQGIAHKGTPTIQNAVVLLERSEEKTSPELSVSWKKGNGHDNNKPHIPNEPHKPNQKR

SEQ ID NO: 27478 - protein, 431 aa, Bacillus cereus G9241
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGVKSFYNIKR

SEQ ID NO: 27479 - protein, 965 aa, Bacillus cereus G9241
MNKKSKINKVMLSISTMALSLGALQTHVAAEEKVPYNVLHSKPVGIEKPVDEIGHVSKAEETLSFQERLKVGDFSQRPASIPNKAAAKQVKESYTMADLNKMNNQELVETLGSIKWHQITDLFQFNEDAKVFYKDKGKMQVIIDELAHRGSTFTKDDSKGIQTFTEVLRSAFYLAFYNNELSELNERSFQDKCLPALKAIAKNPNFKLGTDEQDTVVSAYGKLISNASSDVETVQYTANILKQYNDNLHTYVDDRMKGQAVYDIMQGIDYDIQSYLIEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPAVADDYLAEHAPKSLTAVGKEISDTLPMKDEKMTKHSSQFFNTFTLEGTYTGSVAKGESEDWKAMSKKVNEALEQLAQKDWSGYKTVTAYFVNYRVNSSNQFEYDVVFHGIAKDEGENKAPTININGPYNGLVKEGIQFKSDGSKDEDGKIVSYLWDFGDGSTSAEANPVHVYEREGSYKVALIVKDDKGRESRSETTVTVKDGSLTELEPNNRPEEANRIGLNNTIKGSLIGEDHTDVYTFNVASAKDIDISVLNEYGIGMTWVLHHESDMQNYAAYGQANGNHIEANFNAKPGKYYLYVYKYDNGDGTYELSVK

SEQ ID NO: 27480 - protein, 553 aa, Bacillus cereus G9241
MKRIFSLLLIFVLAFSALMNMTVSAESKSTGTLTIHKFEQSKDFKTTTEGNGKEGQTVPEGAKPLEGVTFEIKRIESFEKISNDGTVIKEETKPVKDDAITKVTNAKGEAVFTNLPLGRYEVKAIKGPEHIELDMTTFIVDIPMTSTNGKELNYDVHIYPKNETKRGSVEFIKKGEGGKVLKDAEFHLFKKNKDGTSTQVKTPSSLVTGEDGKIRVDSLEYGDYYYFIEHKAPTDYLTSKEERPFSIKESGKVVKLDDIKNYKEPTITKSINNGSKVAGINKETDYTYDIKTLLPEDIKSYKKYVVTDILDDRLEIKGLPIVMVDGKKVEDGSVKVVVEGQKVTATIEDFSKINGKELHLQITAKIKSDVESGVKIPNKAVLNFVNKEDVSSEKDGKPSNEVVVTPTAGNIKIEKVDGKDKALKLEGAKFQLQDKKGNVIKVNGKEMNDITDANGIITWNEIPYGEYQIVETEAPKYKDKDGAVEHYQKLRDPINITIDEKHQKIELQVENNKSGWIIPATGGMGTIFFTVVGLMLMAVATFIFFRKKPVKNS

SEQ ID NO: 27481 - protein, 72 aa, Bacillus cereus G9241
MEINYLCMLVFLMLQQLDNFIPKDQLPSLAAYGFQLSTVIVVAEKNQDTTDLIISNTRVSDYYGLKWLSIGK

SEQ ID NO: 27482 - protein, 277 aa, Bacillus cereus G9241
MNKAINEPLLIDGKEVTAETKFIAKEKNGFVTLDFTFVGAEQQGREVVVFEDLLHEVQVIATHADINDVGQTVRFVEPSIKTTATNKADGSKELDAFKSVTIQDKVEYKDLIVGKEYVVKGKLMDKATKRTLLVDGKEVTVESKFTAKERNGSITLDFTFNASALQGKEVVVFEELYQDNVLVAIHVDIEDKGQTVKFKEVKPEQPKPEQPYQDNNTPTSEQPKEQVKEQSQPKKDMQSKIGWLPQTCADLTSWISTATGVLLLIVGGAIFLKRKNA

SEQ ID NO: 27483 - protein, 72 aa, Bacillus cereus G9241
MGIGFNGVPVPSLDGANYGTAVGQEVVGFGFSGQVPAGTTVSLYNLNGQTVTIGGNTGSTSAAARLSFFRIS

SEQ ID NO: 27484 - protein, 760 aa, Bacillus cereus G9241
MKKRKVFIPLLAVSTILAASPVNLNIIQANTTQEDSILQGKETNSQGLLGYYFNDLDFKNPTVITTLETGDLSIDNSEIESTLSNEKQYFQSAIWTGFVNVEKDGEYTFSTSDNNHVTISVNDQEVMNRTSDLHKIWLEKGQLYEITVKYQRESPSEKGIGFQLYWTTPDNTTETIPKSKLLLPKLKAKSSKSRTERSANMNREIVDEDNDGIPDSLEIEGYTVDVKNKRSILTPWVPTVHEKKGLRKYQSSPQKWSTASDPYSDFEKVTGRIDKKVSLEARDPRIAAFPNVTVDMEKIIISKIEDKSKQQGGSQGNTISTGTSTSKTHTLEEHADVSFHASLFDFGGSVSAGISNSNSSTVTIDTSESTNIEKSWSETLGVNTADAAKLNANIRFKNTGTAPIYNALSTTSLVLGNNQTIATIKAKENQMAQLIAPNEYYPSKKLAAISLNAQDDFSSTPITMNYNQLMELEKTKKLRLDTDQVYGNIGEFNHSKGRVEVNTNLNWSNFLPQIEETTARIILQEDNNDSTERRVAAVDPNDFLEMTKPDVTLKEALKLAYGFKEENRQLKYKEKDISRFEFVFDKETNQNIQQQLKGRKFKNIYEALDNIQLNAKMNILVRDANFRYVDGKRVGANDWFIKTTHQQVIKWSEESATLKIDKNTTEMMAGYLIEIVEPSGKKELVNSRYDSIDIFSILKDGTVFLDFKKHNDNTPLRINNGETVNIYAITKERKNLAIEEGRFPNINDSEKGVLVLSLKK

SEQ ID NO: 27485 - protein, 317 aa, Bacillus cereus G9241
MYQRNCFSCDGRRNGGSIGSTGATGITGPTGSTGPTGITGPTGITGPTGITGPTGITGPTGITGPTGITGPTGSVGATGAGFQSTTTFSLAAAPNYKKGQVVTYTGSGYVVKKDAPQGFPNISPDYIVLVESGPTGSTGPTGITGPSGNTGPTGTAGSASAKSIVFQGTNAGFQRIAGSPGIDSNVIPYVTAGSGSIVGFTASINVNNLPAAVYTINICRNVPTNLTVPTSSYILSTITLATTDKITGTIVFSIKSTDTGPGQIQVFNPTPAAGPATVTWTSITTGNPISIGDAISLYITPGITASAVYSVFLITNI

SEQ ID NO: 27486 - protein, 554 aa, Bacillus cereus G9241
MKKFLSMFLIFLLAFASLPSMLIKAESKSEKKGTLTIHKFQQEPLNNPALKESSSKGVEIPKDAKPLAGVVYQIKQVESFGTISNDGKIVKEDIKPVNGVPIEVETNADGIAFFGDLPLGRYEVKEISGPPHVNIDTKTYKVDIPMTSEDGKVLTYDVKIYPKNETKRGAVELTKIGVENKALKGVQFSLYKEDGTELEKGLETDGNGKIRVGNLSYGKYYFLETKALDGYVLDPKKYEFFIKESGVINKDGTVTSGEVVKVDVKNYEEPTIDKKINGDLNNLPINTKTDYNYDIKTLIPEDIKDYKHYVVTDVLDSRLEIQDQPVVKIDGKVVDASVVEVVVDGQKVTATVKDFSKLDNKKEFHLQIKAQIRDGVETGVEIPNTATITFKNKDDVTGEKATKPVIVTPTTGGITLTKVDGKDGKKLEGAEFALQDTKGNPVEIDGKKVVGTSDKNGVITWNKLPYGEYQVVETKAPTYEKEDGTTGSYQQLREPIHVKIDADHKTVTLTVENNKSGWILPSTGGIGTILFTVVGLVLMIIAAFVFFRKKATNN

SEQ ID NO: 27487 - protein, 942 aa, Bacillus cereus G9241
MSTYLKRISVICFIFTVLIGQIFMPIIGHAQELNTTGFVDSFAFEKTKLNYGEKTTIHVNFSEKPGKKMKSGDTLTLALPPELKGYSGTIPLKDDSGRIFGTCQINANNVVCTFNDTVEKLENIRGNFNFTVQGTNVEAGKTKDVQTNLGTDLEKQMVSITHPKGEGTEPGIFFYKSGDIQPDKSNEVRWFLNINLKKQYLHDNIVLKDTLQEGQTLNKDSFTITINNKEYLSLKQFQDRGYGYIKLTSDNSFEVVIYRHMANATSFTIFYTSTITDSGKKLKHLQNDYKLDYQILYEKPISESNSVKVENISFGGGAEGVLPAKGTLQIVKHIEGDENKFIPGVSFKLFTESGQQIGDSYTTNQDGIVEAPNLTPGNYYVQEISAPNYVEFDSQAKIPFTIKTDATNGIKLMVPNKLKTISVAGTKTWEGDKVNDRPKTIKVDLLQNGKVIATKEVTAENDWKYEFGKLPAVDSEGKAHTYEVKEQPVSGYQSKVNGYDLTNIKIHEVTEVEEQVEEETTEEIKEEKPEEPKVTEEPKELEKPEVTEKPEIHVKPEEEQVEEETTEEIKEEKPEEPKVTEEPKELEKPEVTEKPEIHVKPEEEQVEEETTEEIKEEKPEEPKVTEEPKELEKPEVTEKPEIHVKPEEEQVEEETIEEIKEEKPEEPKVTEELKELEKPEVTEKPEIHVKPEEEQVEEETIEEIKEEKPEEPKVTEEPKELEKPEVTEKPEIHVKPEEEQVEEETIEEIKEEKPEEPKVTEEPKELEKPEVTEKPEIHVKPEEEQVEEETIEEIKEEKPEEPKVTEELKELEKPEVTEKPEIHVKPEEEQVEEETIEEIKEEKPEEPKVTEEPNMLEKPVVKEQTEVLSKQSVQEKVEVQNKQEVHSKVEIQNKSEVSPSVENNKQSKVLPQTGGASTESTSVIAGMLALIFGARLFRRSKN

SEQ ID NO: 27488 - protein, 238 aa, Bacillus cereus G9241
MKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEMKQAKQTVSDDLSKKKQDLDIKINDFKHTEKKIDDKLAEIHTTKQNVDNKINEVSQSKQTETKTGTTNANNNARELPNAGSEQSNNMALGMLSVLGGVLLVARNKIKTLFSK

SEQ ID NO: 27489 - protein, 580 aa, Bacillus cereus G9241
MLVRDQDKCSKFQAPIPFPASGITGPTGPTGPTGSLGGPTGPQGIQGVQGPIGPTGPTGIQGVQGVQGENGPTGPTGLTGPQGSQGNQGPMGERGPQGIQGVQGIQGEIGPTGPTGIQGIQGIPGSIGPTGPTGIQGVQGVQGEIGPTGPTGIQGIQGVQGEIGPTGPTGNTGIQGVQGDLGNSGLQGVTGIQGIQGPIGPTGPTGSQGIQGEQGPMGPTGATGVQGLQGPQGEMGLTGPTGSQGIQGVQGVIGPTGPTGLQGDPGPTGSTGPTGVTGPTGSATGPTGATGPTGPQGVQGAQGPIGPTGPQGIQGIQGEQGVRGATGPTGLQGLQGIQGIQGPTGPQGIQGPQGITGPTGATGPTGATGPIGPQGIQGPQGVTGATGATGATGVTGATGPTGIQGIQGITGATGGTGVTGPTGATGPTGLTGATGSSAISTGGGYFFSTSTSTIAANANIPINSGSTVYGTGVSLTSATTVTVSTPGIYLVSYYFQGDANGGNETVSVRLLLNGAQLAGSFIQSVTTSTVVIEPAISNTLLVNVTSANSTLVLQNGPLGVGHVTTIAGAITASLNVVRIL

SEQ ID NO: 27490 - protein, 188 aa, Bacillus cereus G9241
MKSRSYNEGTNNFVSKDIVPALTGYGFSPNVVAVITADKTESTSDLKITNRRISDQYNIEWVSSKWWGTNNKDTYNEFFTNNYKLDWKNHQVTLDNQKALVEQMSSINNVNNQLNKGRGKLSFTMNGNQLKATSSNAGYGISYEDKNWGIFVNGEKVYTFNEKTTVGNISNDINKLNIKGPYIEIKQI

SEQ ID NO: 27491 - protein, 321 aa, Bacillus cereus H3081.97
MSHNNCFGHNNCNNPIVFTPECCNNPQTVPITSEQLGRLITLLNSLISAIAAFFANPSDANRLALLNLFTQLLNLLNELAPSPEGNFLKQLIQSIINLLQSPNPNLGQLLSLLQQFYSALAPFFFSLIIDPASLQLLLNLLTQLIGATPGGGPTGATGGGAIIPFASGTTPAALVNALIANTGTLLGFGFSQPGVGLAGGTSITLALGVGDYAFVAPRAGVITSLAGFFSATAALSPLSPVQVQIQILTAPAASNTFTVQGAPLLLTPAFAAIAIGSTASGIIPEAIPVAAGDKILLYVSLTAASPIAAVAGFVSAGINIV

SEQ ID NO: 27492 - protein, 455 aa, Bacillus cereus H3081.97
MKNRFLKQLQNMKMNKKSLGAVALTAGIIGTTLIPQNAYAHGFVEKPGSRSALCSPTYGALNVNCGSVMYEPQSLEAPKGFPQGGPVDGQIASAGGKFGGVLDQQTADRWFKNTITGGENTFTWKYTAPHLTSEWHYYITKKGWNPNKALTRADFEPIGTVQHDGSAASNHLTHKINVPTDRSGYHVILAVWDVADTANAFYNVIDVNLINDVKPDTEAPSIPNGIQAKKVTAHSIELAWTASTDNVGVKGYQIFRNGEMIDTVPGTHFIDKKLQPSTEYSYTVKAIDAAGNASKESAKLTVKTTVEAPDTEAPTQPKGLHSMGTTTSSVDLMWSPSDDNIGVDHYDIYRETEGSMKKIATSNTTSYMDKNLLPNTTYKYVVKAVDVVGNESVQSDVFTITTKTESATYEEWDATKAYEKGDRVLYEGKVYEAVQSYKGNGDPNWIYALSLWKTV

SEQ ID NO: 27493 - protein, 965 aa, Bacillus cereus H3081.97
MNKKSKINKVMLSISTMALSLGAIQTHASAEEKVPYNVLHSKPVGIEKPVDEIGHVSKAEETLSFQERLKVGDFSQRPASIPNKAAVKQVKESYSMADLNKMNDQELVETLGSIKWHQITDLFQFNEDAKSFYKDKGKMQVVIDELAHRGSTFTKDDSKGIQTFTEVLRSAFYLAFYNNELSELNERSFQDKCLPALKSIAKNPNFKLGTAEQDTVVSAYGKLISNASSDVETVQYASNILKQYNDNFNTYVNDRMKGQAIYDIMQGIDYDIQSYLIEARKEANETMWYGKVDGFINEINRIALLNEVTPENKWLVNNGIYFASRFGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPAVADDYLAEHAPKSLTAVEKEMTETLPMKDAKMTKHSSQFFNTFTLEGTYTGSVTKGESEDWNAMSKKVNEVLEQLAQKEWSGYKTVTAYFVNYRVNSSNEFEYDVVFHGIAKDDGENKAPTVNINGPYNGLVKEGIQFKSDGSKDEDGKIVSYLWDFGDGRTSTEVNPVHVYEREGSYKVALIVKDDKGKESKSETTVTVKDGSLTESEPNNRPEEANRIGLNTTIKGSLIGGDHTDVYTFNVASAKDIDISVLNEYGIGMTWVLHHESDMQNYAAYGQANGNHIEANFNAKPGEYYLYVYKYDNGDGTYKLSVK

SEQ ID NO: 27494 - protein, 372 aa, Bacillus cereus H3081.97; identical to SEQ ID NO: 26834

SEQ ID NO: 27495 - protein, 427 aa, Bacillus cereus H3081.97
MSNKDKKFKNPLNFDDIISAISYDPSVIGPTFPNTTIVSPTGITGPTGSTGSTGSTGDTGPTGNTGPTGNTGAIGNTGPTGNTGPTGATGNTGSTGNTGNTGSTGNTGNTGSTGVTGTTGPSGNTGPTGSTGPTGNTGPTGVTGTTGPSGNTGPSGNTGPTGSTGPSGNTGSTGVTGTTGPTGITGPTGITGPTGDTGSTGVTGTTGPSGNTGPTGATGPTGNTGPTGVTGTTGPSGNTGPTGATGITGPTGATGPSGSTGPTGRTGTTGNTGPTGSTGPTGSTGPTGTLAQAYASLTLGVNQTVAANGKVNFSGGGTNLNGITFNGSDTLTIQQNGDYMITLNVSPALGSVTPAAFGVGLNNNPTPSTNMVSNVSGGMISSTTIISLTAGTTLSLFNNSGVAVSLNNGAGGAAGGGVARVTVIRVD

SEQ ID NO: 27496 - protein, 553 aa, Bacillus cereus H3081.97; identical to SEQ ID NO: 26419

SEQ ID NO: 27497 - protein, 503 aa, Bacillus cereus H3081.97
MFNKKMVAMAMTVPLVMGTISTVSALEKQQQVKLEAYSPQKKATEYLKENAAQYGLKADLSDLQYISTTETSVASYVRFQQVMNGAPVFSKQITVTLNGEGKGVLAVSDYQSVKGVKEATTKISEKDAIQKSMAYVGEVSEQNLWAPTEKEFGYIVEEGIARPVYKVVVHSNNPFGAWETFVDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDNNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 27498 - protein, 971 aa, Bacillus cereus H3081.97
MKGYSKKVLVGVSFASFMLGSFQGGALAEGTKGEQVSYRNVLKMEPVGVQLPVQELAHSSKVLENKSFEKRLQFADLSQRPPEVKKESKQLAVAKTYTIAELNQLSNQQLVDLLVTIDWEQINGLFQFNKDSLAFYQNDSRIQAIIDKLQQQGQAYTKDDSKGIETLVEILRSGFYLGFYHTELSKLNERSYHDKCLPALKTIANNSNFKLGTVEQNRVVSSYGKLIGNASSDVETITSAAKIFKQYNDNFSTLVDNLSAGNAIYDIMQGVDYDIQSYLYDTRKAPKDTVWYQKIDSYINELSRFALIGTVTAKNGWLINNGIYYTGRLGTFHSTGTKGLQVVTDAMKIYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTTEESIYSLEELFRHEFTHYLQGRYEVPGLWGQGKMYENERLSWFEEGNAEFFAGATRTDNVVPRKSIIGGISSNPADRYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLNNVSVKKNKSQFFHTFTLQGTYTGTTAKGEYEDWKTITQNVNDTLKRLSAKEWTGYKTVTAYFVNYRVNAAGQFEYDVIFHGINTEEGAVNKAPVAVINGPYSGNVNEAISFKSDGSKDEDGKITSYKWEFGDGAVSNEQNPTHVYTKEGTYTAKLTVTDDKGLTNTVTTNVTVQKKEDNSIEKEPNNSFQTANKLQFNQVLRASLGNGDMSDFFEINVETAKNLQINVTKENNIGVNWVLYSEADLNNYVTYAQQEGNKLVGSYYTYPGKYYLHVYQYGGGTGNYTVEVK

SEQ ID NO: 27499 - protein, 1078 aa, Bacillus cereus H3081.97
MSTYLKRISVICFIFTVIIGQVFTPIIGHAQELRTSGIVDSFTIEKTKLTYGEKTSIHVNFSEKPGKEMKAGDTLTLALPPELIGFSGTITLKDESGRVFGTCQINANSVVCTFNETVEERENIRGSFNFTVQAMNVEAGKTKDIQTNLGTDLEKQSVSITHPKSEGNEPGIFFYKVGDIQPNNSDEVRWFLNFNLKKQYLHNNIVLKDTLQEGQLLKKDSFTVTINNKEYLSLEQFQQRGYGYINFTGDNSFEVVIYKHMGNATSFTVAYKSTITESGKKLKFLQNDYKLDYQILNEKPTSESNSAKVENISFGGEAEGDLPAKGTLQIVKHIEGNEGKVIPGVSFELYTESGQKIGGSYTTNEEGIVEAPNLTPGNYYVQEISAPNYVEFDPKAKIPFTIKKDDVNGIKLMIPNKLKTTSVIGTKKWEGDKVNDRPEIIKVDLLQDGKVIATKEVTATNGWKYEFENLPAVDNNRKTHKYEVKEQPVSGYQSKVIGYDIVNTKIQEATEVEEENKEETTEDLKELEKPEEPKVTEEPNVLEKPDVTEKPEIWVKPIEEENKEETTEELEDLEKPEEPKVTEEPNVLEKPEVTERPEIWVKPEEEEVEEETTEELEDLEKPEEPKVTEEPNVLEKPEVTERPEIWVKPEEEEVEEETTEELEDLEKPEEPKVTEEPNVLEKPEVKEKPEIWVKPVEEENKEETTEDLKELEKPEEPKVTEEPNVLEKPEVKEKPEIWVKPVEEENKEETTEDLKELEKPEEPKVTEEPNVLEKPEVTEKPEIWVKPVEEEVEEETTEDLKELEKPEEPKVTEEPNVLEKPEVTEKPEIWVKPVEEEVEEETTEDLKELEKPEEPKVTEEPNVLEKPEVTEKPEIWVKPIEEENKEETTEELEDLEKPEEPKVTEEPNVLEKPEVKEKPEIWVNLEEVENKEGTTEEITEEITEELEGLLKPEEPKVKEEPNVLEKPEVKEQPEIWVKPIEEENKEETTEELEDLLKPEEPKAKEEPNVLEQPEVSSKPEVQNKQDVQDKSEVTSSKEANKQLKVLPQTGGASTEATSVIAGMLTLILGARLFRRSKK

SEQ ID NO: 27500 - protein, 833 aa, Bacillus cereus H3081.97
MRKSFNQKIKKLSSSLIVVLLVCMNFLIHLPNKAEAATIELKGLGDVSYYNAVIFGNHSATSADIEGAMAIQKNMNASSYTVLAAATGAHNLAGATWVEEGYPSLLLGGQFTKAGTGQVIIQDGTVAMTKDGDPEGAMKSSYDRISYKEQAEIDAKFKEFRKDVNSVIEDAGQLHTDKPKMGMTFGIGEDVNNPNIYVSSGQNGKKEFEVKDVFLPNVDNKDFIVIYSDAEEVSFGGGAILYDTTDKGEFTLVNTSQVYDPNSFFTELASKVIWVFPNATKLTTEGYGVVGSVFAPNAVVDTKGGSINGQVFLGGLHQRDGFEVHNFKFNWPKWNKPSVEKVTGQFEIVKVDASDETKLLSGAEFEVYKDGKQIDTLRTDKTGKVISKKLEPGKYTLKETKAPEGYKLIKEEIEVNVEENKVVSVIVKNVKELGSLQVIKKDAESKNVLEDAEFRLKNENGQIVGGIKTTNKDGVVIFENLVPGKYTLEETKAPEGYKVKEVKVEVNVIANEVVKREVLNEKEPSKGPEKPGEETEKPGEETEKPGEETEKPGEETEKPGEETEKPGEETEKPGEETEKPGEETEKPGEETEKPGEETEKPGEETGKPGEETGKPGEEIEKPGEETGTAGEETEKPGEETGKPGEETEKPGGETEKPGEETEKPGEETEKPGEETGKPGEETEKPGEETGKPGEETGKPGEEIEKPGEETGTSGEETEKPGEETGKPGEETGKPGEEIEKPGEETGTSGEETEKPGEETGKPGEETEKPGGETGTPSEGMENVDKEKPTLPEKGQGASHAQLPATGHDMNYLPFIGFALVLLGIRLRFMIKNS

SEQ ID NO: 27501 - protein, 3386 aa, Bacillus cereus H3081.97
MKKLFNICLIVFVLFSQLASFPYNQVKAETLAGNSLFDTVEMKDATNHIIDEALNPKNLIKVGSTIHLEYAWSIKDQQTDSAVLQIPNALKVKSDQQGNLMAEQQIIGQYFVKANDNKMKLVFNDQVKDSKGANGKISIDAVFNPDLKSGAKSVQLSFPLGATAKPISVPVQVDNPASPTTDKDTAPKPAEEQKSNDVQKPVEEQKNNDAQKPAEEQKNNDAQKPAEEQKNNDAQKPAEEQNNNDAQKPAEEQKNNDAQKPVEEQKNGETQQSTEQPGDSPDPSPKQITENILTGVTLTDKDGKPFNNTDNRPNPNSITKIDFTWEVLKSLNVKKDDYYTFQLPEYFIVHNTITEDLIDGQGNTIGSFVVTPDGKVTMTFNEYVEDNPNIAGHLNIRTEFNEVKITGATEKQIPFPIKEKDVIVELDFKPKVKKSIDKKGVPDRPINTNQINWKVEMNKTKDKLTNAVFQDDIPNGASLNEDSIKVYYLEVDINGKTTRGAEVPKEEYELTSSSNKLNIAFKKETNKAYEIEYATKITDESVTSFKNNAKVSSKNQKDVSANATVTVSRGTHLAKNSRYNPKTQTIEWTITFNGDQRDIKKADALLKDVLDKSHKVDKNSIVVKNASYDDAGKLVTGDNATNFTVKETDEGFDLQFNEDINSAYVITYTSKATNDVIKDGEIENKIIADGKWSQTNKVTLKQQNIIKKHNKKDTDYNKKTTTWTIIVNDNNYVLNDAVIKDTFDYGGLTLQKDSFKITDGSRTLDVTDTGFEVKLTGDYKSNMDKTLTITYTTDFNYETLSKVKENKGKNTSFKNTAKLTWVDINGDDKNSSSNDTFDPDGYTKGNGFKYGSYNAQTKEITWKIGFNYNNITIKDPSIVDVLRDNQKLIPESIEVRHMKLTGGAHGFEVSDPVPPSEYTIENPTKDNNNTLTVHFKNEINSAYYISFKTSLAGEQINKRYDNYADLKDGSETVTTIHGAFEITNGGSGITKTAKQNDKYIDWSVSINASQSTIENAVVTDEPTDNQMLDEKSFHLYPTTVAVDGTLTKDTANELKEGTDYKLKVITDNDTGKQQFKVEFLHTIERAYILEYRSLINADHNEKVSNKATITGHRLTLTKVEDVKFVEVKVSSGSGGGSANKGRGSLQIIKVDDKDQKVRLAGAEFTLYDQTGTTAIRPITTGDDGVAKFNNLRRDKYLIKETKAPTGYVISKELREGILVELGSEEITKYTFTNKKFVGKVVLTKTDATSRERLEHAVFSLLDQNKQVIPEHKELITNDKGQITVDHLKPGTYYLQETKAPEHYKLDDRLIEVKIAEDQTTVINRTATNSLIPGAAILTKVDKDGKTLAGAEFSVRDRNNIKVPGYEKLTTNDQGQIEAKDLRPGDYQFVEEKAPKDYDIDKKPIEFTIVKSQKKAVTVTATNHLIKGGVTLTKTDDIDGTALAGAVFKIVDANDEKKVIRKNVTTGADGKVTVKDLEPGTYRFIETEAPKDYVLNTNPIEFTIDKSQQSFATVTATNSLKTGEVELLKVDEFGDKKPLKGAVFKIVDVNNNDVRTDLTTNADGKTKADKLRPGTYKFIETAAPEHYVLRAEPIEFTIDRSQKETLLVKAENALKPGDVELTKVDDIDGTALAGAVFKIVDANDEKKVIRENIKTGADGKAIATGLRPGDYKFIEVTAPKYYDKNTSPIKFTITESQTTSATVTAKNSLTKGGIELTKVNAADEKETLEGAVFKIVNRDTNEDTRTNLVTNSEGKLVVDDLRPGNYKLIETKAPTYYDVNVEPIEFTIEKGQQKLLPLTFKNSLTKGKVKLIKEDDVESSIALAGAVFTLQDANGTEIAKDLKTDDHGVIVIPDLAPGDYQFIETSAPEHYKLDQTPIKFTIKKGSKDDLPVPVTVTNSLLTGGVTLTKVDDVDGATLEGAEFIIVDAHDTKKVVRKELTTDKQGKVSASDLRPGDYQFIEVKAPKDYTLANDPIPFTIGKSQKENITVTATNSLKKGAVTLTKIDDIDRTMLKGAIFKIVDMKGNEVRTNLGTDKNGKISVSDLRPGDYQFIETKAPEHYVLDETPIPFTIERSQTKEINVTGKNTLKKGSVELTKIDDIDTNTNLANAVFNLLDENGQVVEEGLKTNAEGKIVVENLRPGTYQFVETIAPEHYDLNNTPIEFTIKKSQTETLHITAKNALTKGGVELSKVDDIDGTKLEGAVFNIVDMKGTVIHKDLVTNSKGKIEIDDLRPGNYQFIETKAPKHYVLDETPIPFTIEKGQKKAISLTAKNSLQQGSIELLKVDDLNDQMKLSDAVFNLLDQNGKVLKTDLKTNNEGKIVVENLRPGTYKFVETTAPKHYDLDKKPIVVTVEKSQKGIATVTMKNSLTKGGVELSKVDDVDGATLEGAVFNIVDMKGTVIRENLTTNSQGKISVPDLRPGDYQFIETKAPKHYDLNKEPIPFTIEKGQTEPISVTAKNSLTKGAVELSKMGDIDGTALEGAVFKIVDMNGNDVRTGITTDAKGKVSIPDLHPGDYQFIETTAPKHYKLDATPIKFTIEKSQAEKLQVTAKNSLIEGAVELIKVDDINPDTKLSDAVFNIIDAKGKIVRTNLTTDKDGKVSASNLRPGDYQFVETKAPKDYDLNNTPIPFTIEKSQTTHVSVTAKNGLTKGGVELTKVDSLDAKETLEGAVFKITDMNGNDIRTNLVTNKDGKIIAKDLQPGDYQFIETKAPKHYDLNEDPIKFTIERSQTKHVFVTATNSLTKGSVELIKVDDVEKNTTLEGAVFKIVNKDGHDVRTDLTTDKNGRLVVDELPPGDYEFIETKAPNHYDLNETPIKFTVKKGQEKIASVTAKNSLTKGAVELTKVDDIDGSTLEGAIFKIVDMNGNDVRSDLTTDKDGKISVSDLRPGDYQFIETKAPTHYDLNQTPINFTVEKSQTATASVIAKNSLTKGAVELTKVDDIDGVTLEGAVFKIVDMNGNDVRSDLTTNKDGKISVSDLRPGDYQFVETKAPDHYDLNQTPINFTVEKSQTATASVTATNSLTKGAVELSKVDDVDGTALKGAVFKIVDMNGNDVRADLTTDKDGKISVSDLRPGDYQFIETKAPTHYDLNQTPINFTVEKSQTTTASVTAKNSLTKGAVELTKVDDIDGSTLEGAIFKIVDMNGNDVRADLTTDKDGKISVSDLRPGDYQFIETKAPTGYDLNAKPIPFTITKGQSQVTSVTALNSLTTGSIELTKVDMDHNGTLEGAIFNILDQDGKVVREGLKTDGHGKLIINDLKPGNYQLVETKAPEAYQLDASPISFTIEKAQAAPLQITVSNKKIESSSGGDNESITPPNKEEKPGKETSEELEKGNPETQINKQQDDRNTGKELPNTGHKKDSTQTVGILLLLAGLLSILATKRKKYY

SEQ ID NO: 27502 - protein, 794 aa, Bacillus cereus H3081.97; identical to SEQ ID NO: 26420

SEQ ID NO: 27503 - protein, 431 aa, Bacillus cereus H3081.97; identical to SEQ ID NO: 26428

SEQ ID NO: 27504 - protein, 138 aa, Bacillus cereus H3081.97; identical to SEQ ID NO: 26427

SEQ ID NO: 27505 - protein, 306 aa, Bacillus cereus H3081.97
MNIKQSFKLLAMFLSVLFVLFPLQKAFAEVMDHTKYQMDWSYSKSKKKPIRTELIKTADGKIAFCLNVDLKSPSGQDLPEMGKVDINVYRVLLNGYPQKSPQELGVSDWREAHYATQLAVWNALKQIDINDLDFRNKNVEKVTKDIVAKASASDELQEITMSVTPTEEQEAVLKNDFFETGLYTVDTNAKSGTYKVQATGAPTGAKFVNEKGEAKTEFNVGEKFRILVPKQTPAGGFSFKVIGKLTKLQGIAHKGTPTIQNAVVLLERSEEETSPELSVSWKKGNGHDNNKPHTPNEPHKPNQYKR

SEQ ID NO: 27506 - protein, 564 aa, Bacillus cereus H3081.97; identical to SEQ ID NO: 26430

SEQ ID NO: 27507 - protein, 134 aa, Bacillus cereus H3081.97
MKKKLLSICTMALLTVGHSSVASADTGTVTKEEEAQLQQDKAKKEEAIKIQQKSEVEKKRIAQEQLKSDMAKKEAAIKEQQKNDVAKKEVAKPVVQGEKLPNTASNNVAMMALSACFVGVGTLFGLKRRNKVKA

SEQ ID NO: 27508 - protein, 524 aa, Bacillus cereus H3081.97
MYRRNCFSCDGRRPSGSNGNTGPTGITGPTGITGPSGITGSTGITGPTGITGSTGPTGATGATGGTGAGLQSTTAFSLAAAPNYKAGQVVTYTSSGYVVKKDAPQGFPNVSPDYIVLVESGATGSTGPTGNTGSTGNTGSTGSTGPTGITGPSGNTGSTGSTGPSGNTGSTGSTGPTGNTGSTGSTGSTGSTGPTGITGSTGITGSTGSTGPTGITGPTGITGSTGITGPTGVTGSTGSTGPTGITGSTGITGSTGVTGSTGSTGPTGITGSTGSTGPTGITGPSGNTGSTGSTGPTGITGPSGNTGSTGSTGPTGITGPTGITGPTGNTGPTGNTGSTGSTGPTGITGPTGITGSTGPTGSAGSASAKSIVFQGTNAGFQRIAGSPGIDSNVIPYVTAGFGSIVGFTASINVNNLPAAAYTIDICRNVPTNLTAPTSSYILTTITLTTTNKITGTIVFSIKPTDTGSGQIQVFNPTPVVGPATVTWTSITTGNLVSRGDAISLYINPGITASAVYSVFLITDI

SEQ ID NO: 27509 - protein, 432 aa, Bacillus cereus H3081.97
MSSWRNNINGYCECNNQNGVHVDSCCFSCDGTVPKLGPTGPTGATGPTGATGPMGATGPTGATGPTGATGPTGATGPTGVTGSTGATGITGATGATGATGITGATGATGATGITGATGPTGVTGVTGATGSTGATGPTGVTGSTGATGITGATGATGPTGVTGITGATGPTGVTGVTGATGATGPTGVTGITGATGATGSTGATGPTGATGITGATGATGITGATGPTGATGITGATGPTGATGPTGATGPTGATGSTGPTGATGITGAMGVTGATGPTGATGSTGSTGPTGITGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGDAISLQLFGLLAVATLSTTTPGAVLTIIRLS

SEQ ID NO: 27510 - protein, 333 aa, Bacillus cereus H3081.97; identical to SEQ ID NO: 26832

SEQ ID NO: 27511 - protein, 175 aa, Bacillus cereus H3081.97; identical to SEQ ID NO: 26353

SEQ ID NO: 27512 - protein, 456 aa, Bacillus cereus H3081.97; identical to SEQ ID NO: 26352

SEQ ID NO: 27513 - protein, 878 aa, Bacillus cereus HD73; identical to SEQ ID NO: 27040

SEQ ID NO: 27514 - protein, 370 aa, Bacillus cereus HD73; identical to SEQ ID NO: 27047

SEQ ID NO: 27515 - protein, 960 aa, Bacillus cereus HD73; identical to SEQ ID NO: 27038

SEQ ID NO: 27516 - protein, 458 aa, Bacillus cereus HD73; identical to SEQ ID NO: 27037

SEQ ID NO: 27517 - protein, 431 aa, Bacillus cereus HD73; identical to SEQ ID NO: 26534

SEQ ID NO: 27518 - protein, 348 aa, Bacillus cereus HD73
MKGKLLKGVLSLGVGLGALYSGTSAQAEASTNQTDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTDQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPQSPQWTVTSWFQKYTYNDYSDHCELHDINSLKGVGHELVTKMINLVP

SEQ ID NO: 27519 - protein, 159 aa, Bacillus cereus HD73
MSQIVLIFGIAFSLSACTETKDSNESKQEDVQDKVYKIGETVDVDGLQVTIDSVKLGYTDYDEDKKKEEILGIIFKVENNSKKEIPFAFYEFEITDKKGTRFKEYNNPDSFISKKLAPEEKIQDIMLFDVAKENTYIATYRPEFTRENRTIKFELKPNK

SEQ ID NO: 27520 - protein, 96 aa, Bacillus cereus HD73
PEEPKEPKEPEVKPEDPKEPKEPEVKPEEPKDLKKPEVKPEKPEVRLEKLIKEPQVKVEKELPKTGGAHSWMMSVGAGISFLVGGVLFVLGRRRKQ

SEQ ID NO: 27521 - protein, 965 aa, Bacillus cereus HD73
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDRELVETLGSIKWHQITDLFQFNEDAKAFYKDKGKMQVIIDELAHRGSTFTKDDSKGIQTFTEVLRSAFYLAFYNSELSDLNERSFQDKCLPALKAIANNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYHENLSKDPKLNKEYQEYMQQLIDNQDKYNVPEVADDYLAEHAPKSLTEVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSAEVNPVHVYEREGSYKVSLRVKDDKGKESRSETTVTIKDGSLTESEPNNRLEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYKLSVK

SEQ ID NO: 27522 - protein, 503 aa, Bacillus cereus HD73; identical to SEQ ID NO: 26634

SEQ ID NO: 27523 - protein, 455 aa, Bacillus cereus HD73; identical to SEQ ID NO: 27050

SEQ ID NO: 27524 - protein, 98 aa, Bacillus cereus HD73
MFKVLDIAVYNRKEEPITLDINNFKLIDGFGREYHISNEYQSVLKAANTSTFKFGIVNPDEHSDGNIVFDVPKNTRGLTLKFNNDKLDKELQLKVELE

SEQ ID NO: 27525 - protein, 553 aa, Bacillus cereus HD73; identical to SEQ ID NO: 26913

SEQ ID NO: 27526 - protein, 971 aa, Bacillus cereus HD73; identical to SEQ ID NO: 27048

SEQ ID NO: 27527 - protein, 336 aa, Bacillus cereus HD73; identical to SEQ ID NO: 27051

SEQ ID NO: 27528 - protein, 96 aa, Bacillus cereus HD73
EKPGTPNPEKPGTPNPEKPGTPNPEKPGTPNPEKPGTPNPEKPGTPDPEKPGTPNPEKPEKELPKTGQKMPVEPYMGALLVMMSFGLLILGRKQQR

SEQ ID NO: 27529 - protein, 554 aa, Bacillus cereus HD73; identical to SEQ ID NO: 27043

SEQ ID NO: 27530 - protein, 893 aa, Bacillus cereus HD73; identical to SEQ ID NO: 27049

SEQ ID NO: 27531 - protein, 1093 aa, Bacillus cereus HD73; identical to SEQ ID NO: 27045

SEQ ID NO: 27532 - protein, 746 aa, Bacillus cereus HD73; identical to SEQ ID NO: 27044

SEQ ID NO: 27533 - protein, 787 aa, Bacillus cereus HuA2-1
MKFIKGIFVSTIALTAFTGLELIKFHENPNVVYADSKGPVKNISQSEADIKEEDQIIVKFKSEVNFPYKDGLENQIKDEGSDSELVKIFSEFPQLTLKRLFTSVNPKEIENIDKHTRETENNSSSNLLDYYIVEVPNKVTAETLMDKFKKSYLVEEVYMQEKPTLLPEVQLPTVSLNPYDDPRFLNQGYLKEAPYGINASYAWSIKGGDGKGTTFVDMEYGWLLDHEDLVNQKVELISGRNIDQHVGHGTSVLGIVSAEDNKVGNIGIAPKAKVKVVSQIRGDGSYNTADAIINAVHNLQAGDILLLEAQASYDGYGDKYLPVEVQPDIFDAIRAGTDKGIIVIEAGANGSNDLDQFRDRNGKQVLNRNSPDFKDSGAIMIGAASSTVPHKRLWFSNYGSRIDVYGWGENVDTTRAEPNRITKNLYTTGFSGTSSTSPIIAGAATSIQGVAKEHLGRPYKPAELRNILSNQNTGTKSQNPLTDKIGVLPDLKSILSNLGYSPDISNNVLEGNQFVWSMKGIGDFEFAKLDFNKTKEEMQIQLKAGVPHHYFDSTYASVKVQNSSGKVVYNKDIYGNRQQNAETQKISMKVGDYIEFTHLEGGNRATLINVDKNIQESFGKKIVYQVTVNGLKKVDQIINPSPDTEAPTRPEGLQAANITTNSVELKWNSSTDNVGVKEYQVLRDGRFIQTVQGTTFTDSKLTANMEYKYTVKAIDAAGNQSIQSSVLSIKTKEQNTSYEKWDPRKAYTKGDRVEYQGKIYEAVQSYQGNGDSNWIFSLSLWKTISIS

SEQ ID NO: 27534 - protein, 431 aa, Bacillus cereus HuA2-1; identical to SEQ ID NO: 26715

SEQ ID NO: 27535 - protein, 789 aa, Bacillus cereus HuA2-1
MKFIKGIFVSTIALTAFTGLELIKFHENPDEVYADSKDFVKNISQSEADIKEKDQIIVKFKSEVNFPYKDGLEKQIKKEDSDPELVKIFSEFPQLTLKRLFTSVDPIEIENIDKDTRETEKKSSSNLLDYYMVEVPNKVTAEALMDKFKKSHLVEEVYMQEKPTLLPEIQLPNLSLNPYDDPRFLNQGYLKEAPYGINASYAWSIKGGDGKGTTFVDMEYGWLLDHEDLVNQKIELISGRNIDQHVGHGTSVLGIVSAEDNKVGNIGIAPKAKVKVVSQIRGDGSYNTADAIINAVHNLQAGDILLLEAQASYDGYGDKYLPVEVQPAIFDAIRAGTDKGIIVIEAGANGTNDLDQFRDKNGKQVLNRNSPDFKDSGAIMIGAASSTVPHKRLWFSNYGSRIDVYGWGENVDTTRAEPNGITKNLYTTGFSGTSSASPIIAGAATSIQGVAKEHLGRPYKPAELRNILSNPNTGTKSQDPSIDKIGVLPDLKSILSNLGYSPDISNTVNVLEGNQFVWSMKGIGDFEFAKLDFNKTKEEMQIQLKAGVPHHYFDSTYASVKVQNSSEKVVYNKDIYGNRQQNAETQKISVKVGDYIEFTHLEGGNRAALINVDKNLQESFGKKIVYQVTVNGLKKVDQIINPNPDTEAPTQPQGLQATNITANSVDLKWNPSTDNVSVKEYQVLRDGKFIQTVQGTTFTDSKLTANIEYKYTVKAIDAAGNQSIQSSALSIKTKEQNTSYEKWDPKKAYTKGDRVEYQGKIYEAVQSYQGNGDSNWIFSLSLWRPITAS

SEQ ID NO: 27536 - protein, 503 aa, Bacillus cereus HuA2-1
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGEGKGLLAISDYQPVTGVKEVTKKISEKDAEQKSMAYVGGESEQNLWAPTEKEFGYIVEEGVAIPVYKVVVHSNNPFGAWETFIDAENGKLIKKVDINRKAEGTGKVFLPNPVVSSGNLAGLKDNNDADSTALTNQLKTVTLKGLDGTGFLIGEYVTISSKAKTKSTNLQFNYTRANDSFEDVMSYYHIDTLQRYIQGLGFQNINKRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDATAYSSSDPTCLRRLDTNKVYPKDITNEVHNDGEIWAQGQYEMAQSFGRDVATKIILQSHWSLTPNAKFRDGAKAIKQADALLYGGQHATEIDRIWAARGISTN

SEQ ID NO: 27537 - protein, 182 aa, Bacillus cereus HuA2-1
MNKKLLTSLLCSTFLFGLSACSSHDTSSSNTKNEQETSKETKNDELSNKDSQKELPTHGDSSDVYISIGSADSLDVIGNGEVKAQGVFKVLDVAVYNRQEEPITLNSNNFKLIDGAGREYHISNESQLVLKAANTATFKFGVLNPNENSEGNIVFDVPKNTQGLTLKVSGDMLDKGIELKVE

SEQ ID NO: 27538 - protein, 183 aa, Bacillus cereus HuA2-1
MRKLFILLTLILVLSSVTAACTQDKKDSAVENGPIEEPTAKNENEELINFEEKEDMSRLEQGILLVGESVKGGYYLTAVQNAYLNASNDSVVVNVSVKNVRGQTIGLSELKYNLKDEKDGKAYEGKVLDQNPSDIQVKPNETVELKIAFEVPSTADEYMFYIESSLDPLGAHWKIDKLQSQKN

SEQ ID NO: 27539 - protein, 748 aa, Bacillus cereus HuA2-1
MKRISSLLLTMPIILGSIATIPHTKVSAETMSFNQETFTLETLDQQTDQAIANGNFEAHLNNLTAYLNGNIGGITEENLKKKLVDPVFAAALAQWQFISQTGAATMDAFAKKDADHQKFLSWAMKNTDVMNTYLEGGSPTGKNPVNALEIWHTIWNADADSHKGLYLKLAISTSLAHAEPIKYWTNNKPINPLTRYQHYKSADQNNELLPCFRTYDVWHLRLVVNTWSPEEDLTWARNMINTEHPELKSQDKVGESAYLIKYTTHNKDGVSIHAGNDAFYGLGWNLSSIYRFGGVCGNISKFGTQVSQAFGVAAMPVGQPGHCALIWNNKPSSWNLGNDISGWGESSRHDATVIPWSDNSPTNQVPYMLLFENAERDPVKLDQSERLRWLAKAITSADNKIAIYKISTNILPINFLVWKDYVSLMLQNPNVTDAEWKELNNSIISVFANEPRPMMDLLTQIKSHVPNTDDILEGKQFSWSLKGIGDFEFAKVNLNKSTEEMQIDLKAGVPHHYFDGTYASIKVQNTSGKLVYNKEVYGNKQQNAESKTVPVKVGDFIELTHLEGEERATLINLDNNKHESFDKKVMYEVTKDGLKKVNQIVNPKPDTEAPTQPQGLYASNVTSNSVELKWNPSSDNVGVKEYQVLRDGQLIQTVQGTTFTDQNLKVSKEYKYAVKAVDAAGNTSNQSNILLIKTKDQNVSYEKWDPRKAYTKGDKVEHQGKVYEAVQNHQGNGDPNWIFALALWKPLT

SEQ ID NO: 27540 - protein, 662 aa, Bacillus cereus HuA2-1
MFNQRTRRGVKKILAVTAASTIFSMFGSSISNIEAASHTNAPGVYVTPKNSVSSDIISIDWSPVQTAPYTYWAVHNWNQGGEAGGYAGFQQQSGFDENGKRTLHFAVWDPISSKEAIKAEYVSPTSVASNFGGEGTGLKIQTTYDWKNYNWYRMTMRSWQENGHTKFGQWLKDVSKNQWKLIGIMDFPVPNVTFNYGQTLFQEDWAGNGQDVREARVKNGYGRNISDKKWVSWNTQSIDGQEPLNNNWDGGATSEYLWFKAGGNSQSTIGTGKTFTLNQPSQPEIGKLDYDIKSMYYENEKLNISWQLKESSTPQFKGKIEIYNNENMTGQPINVIDDIKSYQNGISQSISLPTNAYAKIVLTDIFDQTVEKKVQIKNESPNILEGDKFAWSMKGIGDFEFAKVNLNKSTEELQVNLIAGTPHNYFDSTYASIKVQDTSGKVVYNKEVYGNKGQNAESKTVPVKVGNFIELTHLEGGERATLTNLDNNKRESFDKKVIYEVTKDGLKKLSQIVNPKPDTEAPTQPLGLYASNVASNSVELRWNPSTDNVGVKEYQVFRDGQLIQTVQGTTFNDQNLTANKEYKYTVKAVDAAGNISVQSNILTVTTKSQNVTYEKWDPKKTYTKGDKVEYQGKFYEAVQSYQGNGDPTWIFALSLWQPVKMI

SEQ ID NO: 27541 - protein, 64 aa, Bacillus cereus HuA2-1
MSSVLKWASSYNIGMELTNENSQFYKVSPINTIDTKTITSSIGYNIGGEIKVSDKADGGGVALK

SEQ ID NO: 27542 - protein, 748 aa, Bacillus cereus HuA2-1
MKRISSLLLTMPIILGSIATIPHTKVSAETISFNQETFTLETLNQQTDQAIANGNFEAHLNNLTAYLNGNVGGMTEENLKKKLADPVFAAALAQWQFISQTGAATMATFAKKDANHQKFLGWAMKNTGVMNTYLEGGSPTGKNPVNALEIWNTIWNADANSHEGLYLKLAIATSLAHAEPIKYWTNNQPINPLTRYQHYKSADQNNELLPCFRTYDVWHLRLVVNTWSPEEDLTWARNMINTEHPELKSQDKVGESAYLINYVTHNKDGVSIHAGNDAFYGLGWNLSSIYRFGGVCGNISKFGTQVSQAFGVAAMPVGQPGHCALIWNNKPSSWNLGNDISGWSESSRHDATVIPWSDNSPTNQVPYMLLFENAERDPVKLDQSERLRWLAKAMTSTDNKIAIYKISTNILPINFLVWKDYVSLMLQNPNVTDAEWKELNNSIISVFANEPRPMMDLLTQIKNHVPNTDDILEGDQFAWSLKGIGDFEFAKVNLNKSTEEMQIDLKAGVPHNYFDSTYASIKVQNTSGKVVYNKEVYGNKQQNAETQKVPVKIGDFIELTHLEGRERATLINLDNNKRESFDKKAMYEVTKDGLKKVNQIVNPKPDTEAPTQPQGLYASNLTSNSVELKWNSSTDNVGVKEYQVLRDGQLIQTVQGTTFTDQNLTANKEYKYAVKAVDAAGNTSIQSNILPIKTKDQNVTYEKWDPKKAYTKGDKVEHQGKVYEAVQNHQGNGDPNWIFALALWNPLT

SEQ ID NO: 27543 - protein, 746 aa, Bacillus cereus HuA2-1
MGNKSKHKTKRILVATATLTILASGMASSSDIVAEETQQQKKLSTSLQGEKSVKSENRTYTVPGKGDVEVLKQQERKSMAFSPYEPTGLYAKPNEQITINVEGNQDIQAYIGTYSYDASWREDSKIKSFTLKPGINTIQSPNGGMIYFYNKQQGGTIRTTVTTGGTTTPFFELGKHTKQDLINMLDQYPNAHAVELKGERVLITASPARVKKYLLGSNTDPVQLLKKMDEATRIQDKVAGLSEEQVDKHYIHYVEENHSPDYYMYAYPYRTAYVGDAIQYVLDINKFIKDGWGPWHEAGHLRQQSPWKFYNMTEVQNNIYSLSVEKAFNQPSNLEKSGIYPKAFQYLEQTNKNYDEISDVFVKLVMLWQLQLAYGEDFYPKLHQLYRDMPSSELPQTDENKKQLFMISASKVAKQNLIPFFEKWGLRPNNDTIQKVDALGYPILTAEIWKGTDSNPIKPDMPNGNNILEGKQFAWSLKGISDFEFAKINFNKSTEEMQIDLKAGIPHHYFNETYASIKVQSASGKVVYNKDIYGNEQQNAESQKVPVKVGDFIELTHLEGVHRATFMNVDNSKQESFGKKAIYEVTKDGLKKVNQIVNPKPDTEAPTQPQELYASNLTSNSVELKWNPSTDNVGVKEYQVLRDGQLIQTVQGTTFTDQNLTANKEYKYAVKAVDAAGNTSIQSNILPVKTKDQNVSYEKWDPKKAYTKGDKVEHQGKVYEAVQNHQGNGDQNWIFALSLWKPITIK

SEQ ID NO: 27544 - protein, 667 aa, Bacillus cereus HuA2-1
MIIKKHPFRTLAKTAVALTMIIPTSQAISHPFAYAQENIAESQQQVAPFWNKNKNYPGESYVTYEGKVYHSLYWVNAGILPTQQFSGWELYTGSEYIPDNSDPNDLFGEGITWPSHVFAPYVDNGMNPQNLLKYAQETNISFFTLSFIVADKNGNPVWGGSHTPIGDGNLDDQIKQIRKIGGDVKVSFGGANAGNIPGLGADLAAAITDVYKLKDAYKSVINTLHLTHMDFDIEGALVAHPESIERRSKAIALLQKELKAEGKDVKIGYTLPVMPYGLTNDGINVIQSAIKHDVDLNSINIMTMDYGQQNQQMGQAAIDAINSLHGQLTNLYKGTIKDSDIWKMIAVTPMIGKNDTQNETFTLNNANELFQFAKEKGIGEISMWSVYRDKKPTESWQIGQATGDASGLPDVDDGAFSKLFSAFNSSTEIDVIAPTAPSNLRSVSQTTTTVELQWEASTDNVGVKEYEVYRDGKKVGTTKTTRYEDTGLQAYTKYNFTIKAADAAGNKSKSSNEVSVTTKEENPEQVAPTAPTGLQASETTTNSVHLIWEKSISNVGIKEYEIYRNGTKIATSPSTHYTDENLLASTEYRYMVKAIDTQGKVSVASNEIKITTKDTPSSEYKAWDLYAAYKKGDRVEHQGKIYEAVQSYQGYGDPNWIFSLALWKVIK

SEQ ID NO: 27545 - protein, 743 aa, Bacillus cereus HuA2-1
MKRGQKRKTQNLVMVTATLSMFTIGITPSLEIFAEEQAQQQKVSVLKNEESVKVENRVFTVQGKGDVKVLSHLDRRAASFSPFEPTGLYAKPNEEITIDVEGNNEITAYIGAFSYNRNSQGEELVKSFTLKPGTNTIRYEGGGMIYFYNKQENGTIRTTIQKGGTPVPYFELGKHTKQDLIDMLNQNPDSFAVELKGERVLITATPERVKKYLLGSNTDPAQLLKKMDEATRIQDRMSGLTEEQVDKHYIHYVEDKDNKSGFMYATEYRTAYVGDAIQYVLDINKFTTDGWGPWHEAGHLRQQVPWRFYNMGEVQNNIYSLAVEKAFGQPSRLEEEGVYPKVSRYLVQENKNYDEISDVFVKLAMLWQLHLAYGEEFYPKLHQLYRDMPSNEIPQTDETKKQLFMITASKAAKQNLIPFFEKWGLRPNNDTIQKIASLGYPNLTAEIWESTDSNPIKPDTPNSSNVLEGSQFAWSMKGIGDFEFVKVNLNKSTEEMQINLKAGVPHNYFDSTYASIKVQNTSGKVVYNKEIYGNKQQNAEQAKVPVKVGSFIEFTHLEGANRATITNMEKNIQESFGVKVVYEITKEGLKKVDKIVNPKPDTEAPTQPQGLYASNVASNSVDLKWNPSTDNVGVKEYQVLRDGQLIQTVQGTTFTDQNLTANKEYKYAVKAVDAAGNTSIQSNILPIKTKDQNVSYEKWDPKKAYTKGDKVEHQGKVYEAVQNHQGNGDPNWIFALALWNPLT

SEQ ID NO: 27546 - protein, 254 aa, Bacillus cereus HuA2-1
MLKRSLGLLSTAVVTASMLFGVSGHSAYADSLSEEKDMYQVAAKESAECKKQGQYKVCETPEQAKKWGEKQYNKWKPNKNEQTVLNSYTKYAGKFNTPLRDNKGDITKIKNPNDKNNILALDSVLNRGEIPEDVILFRGDDPIAFMDDPNKLIKNGKIDKEEFNKLKEKYKGKSKTEYGYISTSLLSNTPIVSTKVFQIEFKTLAGTHGGYIEKHSSYPGQYEFLLPRNTTYIISKMELSNDEKHIKIEALVKR

SEQ ID NO: 27547 - protein, 749 aa, Bacillus cereus HuA2-1
MKRGQKQKTKNLVMITATLSMFATGITPSLEVFAEEQAQQKKVSTTLQNENSVNVENRVFAVPGKGDVSQLQNIERRERNFSAYEPTGLYAKPNEQITIQVQGNQSIQAYIGTFSFDASWREDSKIKSFTLNPGTNTIQSPNGGMIYFYNKQQGGTIQTTVITGGTATPLFELGKHTKQDLINMLNQYPNAHAVELKGERVLITASPVRVKKYLIDSNTDPVQLLKKMDEATRIQDKISGLSEEQVDKHYLHYVEDNHSLDYYMYAYPHRTAYVGDAIQHVLDINKFTNDGWGPWHEAGHMRQQTPWNFKNMTEVQVNLYSLAVEKAFTSNQPFRLQQEGAYTKAFQYLEQPNKNYDDISDLFVKVVMLWQLQLAYGEDFYPKLHQLYRDMPSNEIPQTDETKKQLFMISASKAAKQNLIPFFEKWGLRPNNDTIQKVAALGYPNLTAEIWKSTDSNPVKPDTPNFSNILEGNQFAWSMKGIGDFEFVKVNLNKSTEEMQINLKAGVPHNYFDSTYASIKVQNTSGKVVYNKEIYGNKQQNAEQAKVPVKVGDFIEFTHLEGANRANITNMEKNMQESFGYKAVYEITKEGLKKVDSIVNPKPDTEAPTQPQGLYASNVTSNSVELKWNPSTDNVGVKEYQVLRDGQLIQTIQGTTFIDQNLTANKEYKYAVKAVDAAGNTSNQSNILLIKIKDQNVSYEKWDPRKAYTKGDKVEHQGKVYEAVQNHQGNGDPNWIFALSLWKPLTLNF

SEQ ID NO: 27548 - protein, 164 aa, Bacillus cereus HuA2-1
MKKKLLPICAMALLTVGYSSVASADTGTLTKEEAAQVQQDAAKKEEAIKVQQKNDVEKKQAAQVQEKSDMAKKEEAIKAGQKNDTAKKEVTPQVQEKEALAKKEEAIKAGQKNDAAKKEVAKPAVQGEKLPNTASNNVAMMALSACLVGIGTLFGLKRRNKVKA

SEQ ID NO: 27549 - protein, 458 aa, Bacillus cereus HuA2-1
MNLKLTSKLERLRKSKKGIGACVLAAGVTAITMIPQSAYAHGFVEKPSSRAALCSQNYGALNLNCGNVMYEPQSLEAPKGFPDDGPIDGKIASAGGLFGGILDQQTSNRWFKNTIKGGANTFTWKYTAAHSTSKWHYYITKKGWDPNKPLTRAELEPIGTVNHDGSAASNNLTHTINVPTDRNGYHVILAVWDVADTSNAFYNVIDVNLVNNETPDTVAPSQPTGLNASKVSANSVELTWKASTDNIGVKEYQVLRNGEVIGTVPGTTFTDKKLKANTEYTYTIKALDAAGNISKESEKLKAKTTNEIPDKEAPTQPKGLHSMGTTATTVDLMWSPSEDNVGVDHYVVYRESAGVMNKIGAADNTSFMDKNLKANTSYKYVVTAVDLAGNESSRSDVLNVTTKSGDSTYEKWDARKAYTKGDRVIHEGKVYEAVQDYQGNGDSNWIFALSLWKPVLNK

SEQ ID NO: 27550 - protein, 971 aa, Bacillus cereus HuA2-1
MKGYSKKVLVGVSFASLMLGSFQGSILAEDTKGEQVSYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTKDDSKGVETLVEVLRSGFYLGFYNAELSKLNERSYHDKCLPALKTIANNPNFKLGTLEQNRVVSSYGKLIGNASSDVETVTSAAKIFKQYNDNFSTLVDNLSAGNAIYDIMQGVDYDIQSYLYDTRKVPKDTVWYQKIDSYINELSRFALIGTITEKNGWLINNGIYYTGRLGIFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSDIAAEITAEAKLSNVSVKKNKSQFFNTFTLQGTYTGTSAKGEYEDWKTITQNVNDTLKRLSAKEWTGYKTVTAYFVNYRVNASGQFEYDVVFHGINTEEGAVNKAPVAVINGPYSGHTNEAISFKSDGSKDEDGKIASYNWEFGDGAVSNEQNPTHVYTKEGTYTAKLTVTDDKGLTNTATTSVTVQKKEDNSVEKEPNNSFQTANKLQLNQVLRASLGNGDTSDFFEINVETAKNLQINVTKENNIGVNWVLYSEADLNNYVTYAQQQGNKLVGSYYTYPGKYYLHVYQYGGGTGNYTVEVK

SEQ ID NO: 27551 - protein, 456 aa, Bacillus cereus HuA2-1
MNKKILNQFRKMATNKKGLSAAVVAVGIMSTTLIPQNAYAHGFVEKPGSRAALCSQNYGALNLNCGNIMYEPQSLEAPKGFPQGGPVDGEIASAGGLFGGILDQQTADRWFKNTIKGGENTFTWKYTAPHSTSQWHYYITKKGWNPNKPLTRADFEPIGTVKHDGSAASNNLSHKINVPTDRSGYHVILAVWDVADTVNAFYNVIDVNLVNNEKPDTEAPTQPSGLQVVKATSNSVELNWKPATDNVGVKEYQVLRNGEVINTVAGTSVVDKKLSPNTEYTYTVKAVDAVGNISKESEALVIKTTVEKPDTEAPTQPKGLHSMGITANTVDLMWSPSEDNIDVDHYIVYRENAGDMKEIGTANTTSFMDRNLQVNTTYKYVVTAVDTAGNESMKSDVLTVTTKEQENTYEQWDSYKAYKKGDRVVHEGKEYEAAQSYQGNGDPNWIFALSLWNEIK

SEQ ID NO: 27552 - protein, 374 aa, Bacillus cereus HuA2-1
MKTKQTIAASTLALAMIAGANSAQAEVTDATPQQSTGDRLAEIKQHKQELDAKLQQHKENVDQTLNELNQVKENVDTKVNELHERKQVADEKIGEIKQHKQELDAKLQQDKQIAEDKIAEIKEHKKQVDEKVAEIKEHKQTVDEKVNEIKEHKQTVDEKVNEIKQHKENIDAKVNELKEVKKQVDDKLAELKKAKQTAEDKLAEIKENKPNTGNTLEELKKIKGNLDSLSSNLELAKQDVKNKLAELQEARQDLLNKINEMKQAKQTVSDDLTKKKQDLDIKINDFKHTEKKIDDKLAELHTTKQNVDNKINEVSQSKQTETDNNNTTVPAKNNARELPNAGSEQSNNMALGMLSVLGGVLLITRNKIKTLFSK

SEQ ID NO: 27553 - protein, 455 aa, Bacillus cereus HuA2-1
MNNRFLKQLQNLKMNKKSIGAVALTAGIIGTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTVNAFYNVIDVNLINNVKPDTEAPSIPNGLQAQKVTANSIELTWNVSTDNVGVKGYQIFRNGEMIDTVPGTYFIDKKLQPSTEYTYTVKAIDAAGNVSKESTALTVKTTVEAPDTEAPTQPKGLHSMGTTASSVDLMWSPSDDNVGVDYYDIYREIEGTMKKIARSYTTSYMDKNLLANTTYKYAVKAVDVVGNESVQSDTFTITTKTESASYEAWDAKKAYKKEDRVLHEGKVYEAVQNYEGHGDPNWIFALSLWKTV

SEQ ID NO: 27554 - protein, 965 aa, Bacillus cereus HuA2-1
MNKKSKINKVMLSISTMALSLGALQTHALAEEKVPYNVLKTKPVGIEKPVDEVGHISKVDETLSFQERLKVGDFSQRPASIMKSSEVKQVKESYSMADLNKMNNKELIETLGSIKWNQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISDMLSMKDTKMTKHTSQFFNTFTLEGTFTGSVTKGESEDWKAMSKRVNEALEQLAQKEWSGYKTVTAYFVNYRVNSSNQFEYDVVFHGIAKDDGENKAPTVNVNGPYNGLVKEGIQFKSDGSNDEDGKIVSYLWDFGDGSTSTEVNPVHAYEREGTYKVALRVKDDKGKESRNETTVTITDGSLTESEPNNRPEEANRIGLNTTIKGSLIGGDHTDVYTFNVASAKDIDISVLNEHGIGMTWVLHHESDMQNYAAYGQANGNHIEAKFNAKPGKYYLYVYKYDNGDGAYALSVK

SEQ ID NO: 27555 - protein, 333 aa, Bacillus cereus HuA2-1
MKSKLLKGVLSFGIGLAALYSGSSVQAEMSTNQNDTLKVMTHNVYMLSTNLYPNWGQSQRADLIGAADYIKNQDVVILNELFDNSASNRLLGNLKKEYPNQTAVLGRSSGSEWDKTLGNYSSSTPEDGGVAIVSKWPIVEKIQYVFEKGCGPDNLSNKGFVYTKVKKNDRFVHVIGTHLQAEDSMCGKTSPASVRTKQLQEIQEFIKNKNIPNNEYVLIGGDMNVNKINAENNSNSEYASMFKTLHASAPSYTGHTATWDATTNSIAKYNFPDSPAEYLDYIIASKDHANPSYIENNVLQPKSPEWSVTSWFQKYTYNDYSDHYPVEATISMK

SEQ ID NO: 27556 - protein, 431 aa, Bacillus cereus HuA2-4; identical to SEQ ID NO: 26715

SEQ ID NO: 27557 - protein, 455 aa, Bacillus cereus HuA2-4
MNNRFLKQLQNLKMNKKSIGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINNVKPDTEAPSIPNGIQAQKVTANSIELTWNVSTDNVGIKGYQIFRNGEMIDTVPGTYFIDKKLQPSTEYTYTVKAIDAAGNVSKESTALTVKTTVEAPDTEAPTQPKGLHSMGTTASSVDLMWSPSDDNVGVDYYDIYREIEGTMKKIATSNTTSYMDKNLLANTTYKYAVKAVDVVGNESVQSDTFTITTKTESASYEAWDAKKAYKKEDRVLHEGKVYEAVQNYEGHGDPNWIFALSLWKTV

SEQ ID NO: 27558 - protein, 183 aa, Bacillus cereus HuA2-4
MRKSFILLTLILVLVSVTAACTQDKKDSAVENGPIEEPTAKNENEELINFEEKEDMSRLEQGILLVGESVKGGYYLATVQSAYLNANNDSVVVNVSVKNVRGQTIGLSELKYNLKDEKDGKAYEGKVLDQNPSDIQVKPNETVELKIAFEVPGTTDEYMFYIESSLDPLETNWKIDKLQSPKN

SEQ ID NO: 27559 - protein, 333 aa, Bacillus cereus HuA2-4
MKSKLLKGVLSFGIGLGALYSGSSAQAEMSINQNNTLKVMTHNVYMLSTNLYPNWGQSQRADLIGAADYIKNQDVVILNEVFDNSASNRLLGNLKKEYPNQTAVLGRSSGSEWDKTLGNYSSSTPEDGGVAIVSKWPIVEKIQYVFEKGCGPDNLSNKGFVYTKVKKNDRFVHVIGTHLQAEDSMCGNTSPASVRTKQLQEIQEFIKNKNIPNNEYVLIGGDMNVNKINAENNSNSEYASMFKTLHASVPSYTGHAATWDATTNSIAKYNYPDAPAEHLDYIIASKDHANPSFVENNVLQVKSPKWSVTSWFKKYTYDDYSDHYPVEATISMK

SEQ ID NO: 27560 - protein, 108 aa, Bacillus cereus HuA2-4
EYQVLRDGQLIQTVQGTTFTDQNLTVNKEYKYAVKAVDAAGNTSIQSDILPVKTKNQNESYEKWDPKKAYTKGDKVEHQGKIYEAVQNHQGNGDPNWIFALALWNPLT

SEQ ID NO: 27561 - protein, 971 aa, Bacillus cereus HuA2-4
MKGYSKKVLVGVSFASLMLGSFQGSILAEDTKGEQVSYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTKDDSKGVETLVEVLRSGFYLGFYNAELSKLNERSYHDKCLPALKTIANNPNFKLGTLEQNRVVSSYGKLIGNASSDVETVTSAAKIFKQYNDNFSTLVDNLSAGNAIYDIMQGVDYDIQSYLYDTRKVPKDTVWYQKIDSYINELSRFALMGTITEKNGWLINNGIYYTGRLGIFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSDIAAEITAEAKLSNVSVKKNKSQFFNTFTLQGTYTGTSAKGEYEDWKTITQNVNDTLKRLSAKEWTGYKTVTAYFVNYRVNASGQFEYDVVFHGINTEEGAVNKAPVAVINGPYSGHTNEAISFKSDGSKDEDGKIASYNWEFGDGAVSNEQNPTHVYTKEGTYTAKLTVTDDKGLTNTATTSVTVQKKEDNSVEKEPNNSFQTANKLQLNQVLRASLGNGDTSDYFEINIETAKNLQINVTKENNIGVNWVLYSEADLNNYVTYAQQQGNKLVGSYYTYPGKYYLHVYQYGGGTGNYTVEVK

SEQ ID NO: 27562 - protein, 749 aa, Bacillus cereus HuA2-4
MKRVQKQKTKNLVMITATLSMFATGVTPSLEVFAEEQAQQKKVSTTLLQNENSVNVENRVFVVPGKGDVSQLQNIERRERNFSAYEPTGLYAKPNEQIIIQVQGNQSIQAYIGTFSFDASWREDSKIKSFTLNPGTNTIQSPNGGMIYFYNKQQGGTIQTTVTTGGAATPLFELGKHTKQDLINMLNQYPNAHAVELKGERVLITASPARVKKYLIGSNTDPVQLLKKMDEATRIQDKISGLSEEQVDKHYLHYVEDNHSLDYYMYAYPHRTAYVGDAIQHVLDINKFTNDGWGPWHEAGHMRQQAPWNFKNMTEVQVNLYSLAVEKAFTSNQPFRLQQEGAYTKAFQYLEQSNKNYDEISDAFVKLVMLWQLQLAYGEDFYPKLHQLYRDMPLNEIPQTDETKKQLFMISSSKVAKQNLIPFFEKWGLRPNNDTIQKVAALGYPNLTAEIWKSTDSNPVKPDTPNFSNVLEGNQFAWSLKGIGDFEFAKVNLNKSTEEMQIALKAGVPHNYFDSTYASIKVQNTSGKVVYNKEIYGNKQQNAEQVKVPVKVGDFIEFTHLEGANRATITNMEKNIQETFGNKAVYEITKEGLKKVDKIVNPKPDTEAPTQPQGLYASNVTSNSVELKWNPSTDNVGVKEYQVLRDGQLIQTVKGTTFTDQNLTVNKEYKYTVKAVDAAGNTSIQSNILPVKTKDQNVSYEKWDPKKAYTKGDKVEHQGKVYEAVQNHQGNGDQNWIFALSLWKPITIK

SEQ ID NO: 27563 - protein, 721 aa, Bacillus cereus HuA2-4
MKKLKPALSVLGSVSMALTLAYPALADIKQPNAGSTIEMFKEDANAKEGKDLIYGTDGKKGKMSTEKIEIQNNDWDQDGISNDLEIRGYKIEFNRQTGKNEAQAWDPERDKDKLKFITNPMSSNSDGDPFTDAYEVQYYGSNSDTEFNPMVANIPNLQVGIKRIGVTPLAAITDSNGGSIDKGWEKSVSTQHSFGVGAGVEGGVEGSAAGPVPSGKASLNVSYGYSKTSTDTERYSSNIDWSTAKTVDSAKAAKVSLQLEYKNTGTASAQNVSPHFNIRLGDKIISTVKATQDRYKANQLSTEKGGRNTTEVLIDSVDNQADVNIYLSLDELKAVEQGAILSVEVLPTSTMELYIEKDGEFMNLGDSGKFESRVNASTTILETDIGNKPKFRMYAPEGVGSDTNLTFNEVLKHVKVDSTKINEFIDNSRGDQVIVAKENLENAKKSYVSKGAKVGVFTKIQQPELSYSAYDPFTKKFYAAVVPGLFGASNEVSVSFENKKSKQTQQVTLLRKGNVYESKEAVSLNDFNPSQKVTFEINDAQKKLPTQKISTVVTYNKEYENYLTHRFSDELIVEGTPYTMKASGNPVLSYKGNDKWQYLAYAGNYTQPVNVIIERKGQPKPGQPIKKGEDIHIKVQNSAYSGYEYLKLQNGYIHFDQKQNASTFKFNHIHSPGSLDYQREWNLQSDGNNIGLDKGGSGYVTYGNDVHTGSSLNRWSFDKAK

SEQ ID NO: 27564 - protein, 164 aa, Bacillus cereus HuA2-4
MKKKLLPICAMALLTVGYSSVASASTGTLTKEESAQMQQDKAKKEEAIKEQQKSEVEKKEAAQVQEKSDMAKKEEAIKAGQKNDTAKKEVTPQVQEKEALAKKEAAIKAGQKNDAAKQEVAKQAVQGEKLPNTASNNVAMMALSACLVAIGTLFGLNRRNKIKA

SEQ ID NO: 27565 - protein, 378 aa, Bacillus cereus HuA2-4
MKTKQTIAASTLALAMIAGANSTHAEVTDATPQQSTGDRLAEIKQHRQELDAKLQQHKENVDQTLNELNQVKENVDTKVNELHERKQVADEKIGEMKQHKQELDAKLQQDKQIAEDKIAEIKEHKKQVDEKVAEIKEHKQTVDEKVNEIKEHKQTVDEKVNEIKQHKENIDAKVNELKEVKKQVDDKLAELKKAKQTAEDKLAEIKENKPNTGNTLEELKKIKGNLDSLSSNLELAKQDVKNKLAELQEARQDLLNKINEMKQAKQTVSDDLTKKKQDLDIKINDFKHTEKKIDDKLAELHTTKQNVDNKINEVSQPKQTTVNNNTTTTPSTVPAKNNARELPNAGSEESNNMALGMLSVLGGVLLITRNKIKTLFSK

SEQ ID NO: 27566 - protein, 878 aa, Bacillus cereus HuA2-4
MVKYSKISKLILGVGLVTISCNGLQIQAETKEKNVKSVLQMEPVGIQKSVDELAHSSTVQENASFTKRLKLSDLSQRPLAPNEDVKPLAEEKKYSMAELNQLSNKQLTDLLVTIKWYQIPELFQFNSDSLKFYQDDSRMQAIINKLAEQGQTYTKDDSKGIETLVEALRAAFYLGFYHDELSKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTMWYRNIDNFINEVNRFALIGTVTNKNGWLINNGIYYAGRLGKLYSTPTKGQQVVTEAMRIYPHLGEQYFVAAEQITTNYGGVDANGKTISLDQIREEGKKKYLPKTYTFDDGAIVFKTGEKVSEEKIKRLYWAAKEVRSQFYRTVGSDKPLESGHVDDVLTMVIYNSPDEYQFNRQLYGYETNNGGMYIEGTGTFFTYERTPEQSIYSLEELFRHEFTHYLQGRYEVQGLWGQGEMYQNERLTWFEEGNAEFFAGSTRLDSVVPRKSIIGGLSYDPAKRYTAAQTLNAKYGTWDFYNYSFALQSYMYNNRPEMFDKVHDLIRANDVSSYDAYRSTLSKDNKLNEDYQSYMQMLIDNRDKYTIPQVSDEYLAQHDPKSISDVTSDITNEAKLKDVKVTKNKSQFFNTFTLQGTYTGSAAKGEIEDWKVMNQATNDMLKRLSGKEWTGYKTLTAYFVNYRVNNAGQFEYDIVFSGVNTEEGTAVEKEPNNSFDTANPLSLNTLLRGNLSDQDQGDKFVIDVKDQKDLQISVTNEQNLGMNWVLYSESDLNNYVAYATKRDGNKLLGNYNAKPGKYYLSVYKYGGGTGNYTVQVK

SEQ ID NO: 27567 - protein, 182 aa, Bacillus cereus HuA2-4
MNKKLVTSLLCSTFLFGLSACSSHDTSSSNTKNEQETSKETKNDELSNKDSQKELPTHGDSSDVYISIGSADSLDVIGNGEVKAQGVFKVLDVAVYNRQEEPITLNSNNFKLIDGTGREYHISNESQLVLKAANTATFKFGVLNPNENSEGNIVFDVPKNTQGLTLKVSGDMLDKGIELKVE

SEQ ID NO: 27568 - protein, 458 aa, Bacillus cereus HuA2-4
MNLKLTSKLERLRKSKKGIGACVLAVGVTAITMIPQSAYAHGFVEKPSSRAALCSQNYGALNLNCGNVMYEPQSLEAPKGFPDGGPIDGKIASAGGLFGGILDQQTSNRWFKNTIKGGANTFTWKYTAAHSTSKWHYYITKKGWDPNKPLTRAELEPIGTVNHDGSAASNNLTHTINVPTDRNGYHVILAVWDVADTSNAFYNVIDVNLVNNETPDTVAPSQPTGLNASKVSANSVALTWKASTDNIGVKEYQVLRNGEVIDTVPGTTFTDKKLKANAEYTYTIKALDSAGNISKESEKLKVKTTNETPDTEAPTQPKGLHSMSTTATTVDLMWSPSEDNVGVDHYIVYRESAGVMNKIGAADNTSFMDKDLKTNTSYKYVVTAVDLAGNESSRSDVLNVTTKSEDSTYEKWDARKAYTKGDRVVHEGKVYEAVQNHQGNGDSNWIFALSLWKPVLNK

SEQ ID NO: 27569 - protein, 965 aa, Bacillus cereus HuA2-4
MNKQSKINKVLLSISTMALSLGAIQTNVSAEEKVPYNVLHSKPVGIEKPVDEIGHASKAEETLSFQERLKVGDFSQRPASITKNSAVKQAKEGYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASDILKQYNDNFNAYVDDRMKGQAVYDMMQGIDYDIQSYLNEARKEANETMWYGKVDGFINEINRIALLNQVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHTSQFFNTFTLEGTFTGSVTKGESEDWKAMSKRVNEALEQLTQKEWSGYKTVTAYFVNYRVNSSNEFEYDVVFHGIAKDDRENKAPTVNVNGPYNGFVKEGIQFKSDGSKDEDGKIVSYLWDFGDGRTSKEVNPVHAYEREGTYKVALVVKDDKGKESRSETTVTIKDGSVTESEPNNRPEEANRIGLNTTIKGSLIGGDHTDVYTFNVASAKDIDISVLNEYGIGMTWVLHHESDMQNYAAYGQANGNHIEAKFNAKPGKYYLYVYKYDNGDGTYALSVK

SEQ ID NO: 27570 - protein, 503 aa, Bacillus cereus HuA2-4
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGEGKGLLAISDYQPVTGVKEVTKKISEKDAEQKSMAYVGGESEQNLWAPTEKEFGYIVEEGVAIPVYKVVVHSNNPFGAWETFIDAENGKLIKKVDINRKAEGTGKVFLPNPVVSSGSLAGLKDNNDADSTALTNQLKTVTLKGLDGTGFLIGEYVTISSKAKTKSTNLQFNYTRANDSFEDVMSYYHIDTLQRYIQGLGFQNINKRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDAAAYSSSDPTCLRRLDTNKVYPKDITNEVHNDGEIWAQGQYEMAQSFGRDVATKIILQSHWSLTPNAKFRDGAKAIKQADALLYGGQHAAEIDRIWTARGISTN

SEQ ID NO: 27571 - protein, 990 aa, Bacillus cereus HuA4-10
MKKNKRKRINAMFIVAALSLPFAVYSTPALAAVAIEANKTGQGLEDGTYDAVIKAYKDKTNEESMAAVYIKDPKLTIENGKKIVTATLSDSDFFQYLKTEDIHTPGVFHDVKVISEDKKKNGTKVIQFEVGELGKRYNMQMHIYIPTMAYDNKYQVQFEVNALNLENNVPEKQKENKEDKVEQQDEGVNVILDKQLQMHINKYNLNRENLNTPITKEDLLKVKSLIVVEAKSKGIQDVSGLEYMTNLENLTLEEVKLENIQFISKLRQLKSLSITYGELEDIGPLAELEHIEVLTLRNNKISDLSPLSQMKKIKMLDLNSNYIKDIKTLFTVTSLRTLAVANNQISNDNLAGIEQLKNVKNLSLSNNGLTNIEHITAMKKLVELDLAKNELENIAPLSRLSTVQSLNLEENYISDITPLSQLTDLYDLKLGSNEIRDVRPVQELGKRMDIDIQRQKIFLDEASVDEEIKIPIYNLKGEPLQNINFKNEDAILNNGFIKWNSPGEKTYEFKLDTNTAESKIRFNGTVIQNIVEKQKESENLILDKTLQQHINKENFGRENLNAPITKEDLLQIKELEILKEKGKEIKDVIGLEYMTNLENLTLEGVGLKNIEFISNLKQLNAMNVSHNKIEDITPLSSLKNLQWLNLADNRIKDVSVLGSMLDLLSLKLAGNEIRDVRPLIQLGQWFTIDVGRQNIVLNDAKINEEIQVPVYDLEGEIIENIKLTSEGGMLNNGVIKWSTSGEKVYKFELDSDGISIRFSGTVIQNIVGKEEVEETKEEVKEPTKEVEEPKEEVKEPTKEVEESKEEVKEEVKEPTKEVEETKEEVKEPTKEVEEAKEEVKEPTKEVEEAKEEVKEATKEVEEAKEEVKEPTKEVEEAKEEVKEPTKEVEEVKEEVKEPTKEVEEAKEEVKEVKESATGLDQEQKGNNQVVENEGRKADTLNKQHANKPEEGKKSLPSTGGEASTSTLLSGITLVLSALSMFVFRKRLFKK

SEQ ID NO: 27572 - protein, 746 aa, Bacillus cereus HuA4-10
MGNNSKNKTRKMLAATATVTMLATGMVSSSDVFAEERQQQKKISTSLQEEKSVKSENRTYTVPGKGDVEVLKQQERKSMAFSPYEPTGLYAKPNEQITINVEGNQDIQAYIGTYSYDASWREDSKIKSFTLKPGINTIQSPNGGMIYFYNKQQGGTIRTTVTTGGTTTPFFELGKHTKQDLIDMLNQYPNAHAVELKGERVLITASPARVKKYLLGSNTDPVQLLKKMDEATRIQDKVAGLSEEQVDKHYVHYVEENHSPDYYMYAYPYRTAYVGDAIQYVLDINKFVKDGWGPWHEAGHLRQQWPWNFYNMTEVQNNIYSLSVEKAFNQPSNLEKSGIYPKAFQYLEQTNKNYDEISDVFVKLVMLWQLQLAYGEDFYPNLHQLYRDMPSNELPQTDENKKQLFMISASKVAKQNLIPFFEKWGLRPNNDTIQKVTALGYPILTAEIWKGTDSNPIKPDMPNGNNILEGKQFAWSLKGISDFEFAKINFNKSTEEMQIDLKAGIPHHYFNETYASIKVQSASGKVVYNKDIYGNEQQNAESQKVPVKVGDYIELTHLEGVHRATFMNVDNSKQESFGKKAIYEVTKDGLKKVNQIVNPKPDTEAPTQPQELYASNLTSNSVELKWNPSTDNVGVKEYQVLRDGQLIQTVQGTTFTDQNLTANKEYKYAVKAVDAAGNTSIQSNILPVKTKDQNVSYEKWDPKKAYTKGDKVEHQGKVYEAVQNHQGNGDQNWIFALSLWKPITIK

SEQ ID NO: 27573 - protein, 183 aa, Bacillus cereus HuA4-10
MRKLSILLTLILVLVSVTAACTQDKKDSTVENGPIEEPTTKNENEELINFEEKEDMSRLEQGILLVGESVKGGYYLTTVQSAHLNASNDSVVVNVSVKNVRGQMIGLSELKYNLKDEKDGKVYEGKVLDQNPSDIQVKPNETVELKIAFEVPGTADEYMFYIESSLDPLETNWKIDKLQSQKN

SEQ ID NO: 27574 - protein, 553 aa, Bacillus cereus HuA4-10
MKKILSVLLVVFLTFSAWSSVLVKAASPTKGSLTIHKYEQEKDGTTGVEGDGSANQEVPTNAKPLKGVTFEVKRVVSFEKISNDGKIVKEDVKPVTGATPSKVVTDDNGQAVLKDLPLGRYEVKEVAGPPHVNLNPNTYTVGIPLTNKEGKVLNYDVHMYPKNEIKRGAVDLIKTGANDKGLAGAAFSVFKKDGTEVKKELVTDANGHIRVQGLEYGEYYFQETKAPKGYVIDPTKREFFIKNSGTINEDGTITSGTVVKVEVKNYEEPAIDKKINGNLEALPINPLTNYNYDIKTLIPEDIKEYKKYVVTDTLDNRLVIQGKPIVKIDGAEVNASIVDVAVEGQKVIATVKDFTKLDGKKEFHLQIKSQVKEGVPSSSEILNTAKNDFTNKNDVIGEKESKPVVVVPTTGIIELTKIDGDDKKKLKGAEFVLKDKNGKIVVVAGKEVIGVSDENGVIKWSNIPYGDYQIFETKAPTYTKEDGTTASYQLLKDPINVKIGENNQSVKLAIENNKSGWILPVTGGIGTTLFTVLGLALMVTAAFVFFRKKFANK

SEQ ID NO: 27575 - protein, 458 aa, Bacillus cereus HuA4-10
MNLKLTSKLERLRKSKKGIGACVLAAGVTAITMIPQSAYAHGFVEKPSSRAALCSQNYGALNLNCGNVMYEPQSLEAPKGFPDGGPIDGKIASAGGLFGGILDQQTSNRWFKNTIKGGANTFTWKYTAAHSTSKWHYYITKKGWDPNKPLTRAELESIGTVNHDGSAASNNLTHTINVPTDRNGYHVILAVWDVADTSNAFYNVIDVNLVNNETPDTVAPSQPTGLNASKVSANSVELTWKASTDNIGVKEYQVLRNGEVIGTVPGTTFTDKKLKANTEYTYTIKALDAAGNISKESEKLKAKTTNEIPDKEAPTQPKGLHSMGTTATTVDLMWSPPEDNVGVDHYIVYRESAGVMNKIGAADNTSFMDKDLKANTSYKYVVTAVDLAGNESSRSDVLNVTTKSGDFTYEKWDARKAYTKGDRVVHEGKVYEAVQDYQGNGDSNWIFALSLWKPVLNK

SEQ ID NO: 27576 - protein, 455 aa, Bacillus cereus HuA4-10
MNNRILKHLLNMKMNKKSLGAVALTAGIIGTTLIPQNAYAHGFVEKPGSRSALCSPTYGALNVNCGSIMYEPQSLEAPKGFPQVGPVDGQIASAGGKFGGILDQQTTERWFKNTITGGENTFTWKYTAPHLTSKWHYYITKKGWNPNKALTRADFEPIETVQHDGSAALNNLNHKINVPTDRSGYHVILAVWDVADTANAFYNVIDVNLVNNEKPDTEAPSNPNGLEATKVTANSVELAWTASTDNVGVKGYQVLRNGEIIDTVPGTHFIDKQLQPSTEYSYTVKAIDAAGNVSKESTAVKVKTSVAILDTKAPTQPKGLHSMGTTASSVDLMWSPSDDNEGVDHYDIYREISGVMKKIGTSNTTSHMDKNLLANTTYKYTVKAVDVAGNESIQSDVFTVTTKTENASYEAWNSKKAYKKGDRVVHEGKVYEAVQNYQGNGDPNWIYALSLWKTV

SEQ ID NO: 27577 - protein, 878 aa, Bacillus cereus HuA4-10
MVKYSKISKLILGVGLVTISCNGLQIQAETKEKNVKNVLQMEPVGIQKSVDELAHSSTVQENASFTKRLKLADLSQRPLAPTDNVKPLAEEKKYSMAELNQLSNKQLTDLLVTIKWYQIPELFQFNSDSLKFYQDDSRMQAIINKLAEQGQTYTKDDSKGIETLVEALRAAFYLGFYHDELNKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTMWYRNIDNFINEVNRFALIGTVTNKNGWLINNGIYYAGRLGKLYSTTTKGQQVVTEAMRIYPHFGEQYFVAAEQITTNYGGVDANGKTINLDQIREDGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGSTRLDSVVPRKSIIGGLSYDPAKRYTASQTLNAKYGTWDFYNYSFALQSYMYNNRPEMFDKVHDLIRANDVSSYDAYRSTLSKDNKLNEEYQSYMQMLIDNRDKYTIPQVSDEYLTQHDPKSLSDVTSDITNEAKLKDVKVTKNKSQFFNTFTLQGTYTGSAAKGEIEDWKVMNQATNDMLKRLSGKEWTGYKTLTAYFVNYRVNNAGQFEYDVVLSGVNTEEGTAVEKEPNNSFETANPLSLNILLRGNLSDQDQGDKFVIDVKDQKDLQISVTNEQNLGLNWVLYSESDLNNYVAYATKRDGNKLLGNYNAKPGKYYLSVYKYGGGTGDYTVQVK

SEQ ID NO: 27578 - protein, 162 aa, Bacillus cereus HuA4-10
MLKKVGRIVLICGMAFSLSACTETKNSDESKQEDVQDKVYKIGETVDVDGLQVTLDSVQLGYPDYTTDKKKDDILGIVFTVKNNSKKEIPFAFYEFEITDKKGTKFKEYKYDSFTSKKVAPDGEIQDVMLFDVTKENTYIATYRPEFTHENRTIKFELKPNK

SEQ ID NO: 27579 - protein, 965 aa, Bacillus cereus HuA4-10
MNKKSKINKVMLSISTMALSLGAIQTHVSAEEKVPYNVLHSKPVGIEKRVDEIGHASKAEETLSFQERLKVGDFSQRPASIMKSSEVKQIKESYSMADLNKMNDQELVETLGSIKWHQITDLFQFNEDAKAFYKDKGKMQVIIDELAHRGNSFTKDDSKGIQTFTEVLRSAFYLAFYNNELSDLNERSFQDKCLPALKAIAKNPNFKLGTVEQDTVISAYGKLISNASSDVETVQYASNILKQYNDNFNAYVDDRMKGQAVYDMMQGIDYDIQSYLNEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDTYRETLSKDPKLNKEYQAYMQQLIDNQDKYNVPEVADDYLTEHASKSLTEVKKEISDMLSMKDTKMTKHESQFFNTFTLEGTFTGSVTKGESEDWNAMSKRVNEALEQLAQKEWSGYKTVTAYFVNYRVNSSNQFEYDVVFHGIAKDDGENKAPTVNINGPYNGLVKEGIQFKSNGSNDEDGKIVSYSWEFGDGRTSTEVNPVHAYEREGTYKVALRVKDDKGKESRSETTVTIKDGSLTESEPNNRPEEANRIGLNTTIKGSLIGGDHTDVYTFNVASAKDIDISVLNEHGIGMTWVLHHESDMQNYVAYGQANGNRIEAKFNAKPGKYYLYVYKYDNGDGTYALSVK

SEQ ID NO: 27580 - protein, 150 aa, Bacillus cereus HuA4-10
MDKATNKPLLVDGKEVTAESKFTTKEKNGSITLDFTFNASALQGKEVVVFEELYQDNVLVAIHVDIEDMGQTVKFKEVKSEQPKPEQPNPDKNTPTSEQPKEQPQPKKEIQSKIGWLPQTGTNLTSWISMAAGALLLIVGGVIFLKRKNA

SEQ ID NO: 27581 - protein, 333 aa, Bacillus cereus HuA4-10
MKGKLLKGALSFGIGLGALYSGSSAQAETSINQNNTLKVMTHNVYMLSTNLYPNWGQNERADLIGAADYIKNQDVVILNEVFDNSASNRLLGNLKKEYPNQTAVLGRSNGNEWDKTLGNYSSSTPEDGGVAIVSKWPIVEKIQYVFEKGCGPDNLSNKGFVYTKIKKNDSFVHVIGTHLQAEDSMCGKTSPASVRTKQLQEMQQFIQNKNIPNNEYVLIGGDMNVNKINAENNSDSEYASMFKTLHASIPSYTGHTATWDATTNSIAKYNFPDSPAEYLDYIIASKDHANPSYIENKVLQPKSPQWTVTSLLKKYTYNDYSDHYPVEATISMK

SEQ ID NO: 27582 - protein, 665 aa, Bacillus cereus HuA4-10
MIIQKTKISFNKVIIITAACSMFSMFGTSISHTKAETHSAAPAVYVSPQNIPASDIISIDWSPVQTAPYTYWAVHNWNAGGEAGGYAGFQQQSGFDENGKRTLHFAIWDPISSKEAIKAEYLSPNSQAGLFGGEGTGLKVQTTYGWKDYNWYRMTMRSWQEDGHTKFGQWMKDVTKNKWHLIAIMDFPVANVAFNHGLGMFQEDWADSGQNVREARLKNGYSRKLVDKQWSSWNNQNISGTHDNTYQYDGGATSEYVWVKAGGNTQSTIGSGKIFTLNQPTQPEIGKLDFDIQSIYYENEKLNVSWKLKENSTPQFKGKIEIYNNENMTGQPINVIDDIKSYQNGISQSISLPTNAYAKIVLTDLFDQTVEKKVQIKNQSPNIFEGNEFAWSLKGIGDFEFAKVNLNKSTEEMQIDLRAGVPHNYFDSTYASIKVQNTSGKVVYNKEIYGNKQQNAEQAKVPVKVGDFIEFTHLEGENRATITNREKNMQESFGNKAVYEITKEGLKKVDKIVNPKPDTEAPTQLQGLYASNVTSNSVELKWNPSTDNVGVKEYQVLRDGQLIQTIQGTTFIDQNLTANKEYKYAVKAVDAAGNTSNQSNILLIKTKDQNISYEKWDPKKAYTKGDKVEHQGKVYEAVQNHQGNGDPNWIFALSLWKPLTLNFLS

SEQ ID NO: 27583 - protein, 776 aa, Bacillus cereus HuA4-10
MPLSMEIILYKRESCSSQRSKTKKGEIILKRISSLLLTMPIILGSIATIPHTKVSAETISLNQGTFTLETLSQQTDQAIANGNFEAHLNNLTAYLNGNIGGMTEENFKKKLADPVFAAALAQWQFISQTGAATMATFAKKNADHQKFLGWAMKNTDVMNTYLEGGSPTGKNPVNALEIWNTIWNADANSHEGLYLKLAIATSLAHAEPIKYWTNNKPINPLTRYQHYKLADQNNELFPCFRTYDVWHLRLVVNTWSPEEDLTWARNMINTEHPELKKQDKVGESAYLINYVTHNKDGVSIHAGNDAFYGLGWNLSSIYRFGGVCGNISKFGTQVSQAFGVAAMPVGQPGHCALIWNNKPSSWNLGNDISGWGESSRHDATVIPWSDNSPTNQVPYMLLFENAERDPVKLDQSERLRWLAKAMTSADNKIAIYKISTNILPINFLVWKDYVSLMLQSLNVTDAEWKALNNSIISVFANEPRPMMDLLTQIKSHVPNTDDILEGKQFSWSLKGIGDFEFAKVNLNKSTDEMQIDLKAGVPHPYFDSTYASIKVQNTSGKVVYNKEIYGNKQQNAVQAKVPVKVGDFIEFTHLEGANRAIIKNMENNMQESFGNKAVYEITKEGLKRVDKIVNPKPDIEAPTQPQGLYASNVTSNSVELKWNPSTDNVGVKEYQVLRDGQLIQTLQGTTFTDQNPIANKEYKYTVKAVDAAGNTSIQSNILLIKTKDQNVSYEKWDPRKAYTKGDKVEHQGKVYEAVQNHQGNGDPNWIFALALWKPLT

SEQ ID NO: 27584 - protein, 553 aa, Bacillus cereus HuA4-10
MKKIFSLFLICMLAFSTLSNMIVSAESRSTGTLTIHKFEQSKDAKTTSEGNGKEGQIVPEDAKPLEGVTFEIKRIESFEKISNDGTVIKEEAKPVKDAAITKITDAKGEAVFKDLPLGRYEVKAIEGPKHIALDKTTFIVDIPMTSTDGKDLNYDVHIYPKNETKRGSVELMKKGEGDKVLPDAEFHLFEKNKDGTSTQVKTPKPLVTGTDGKIRVESLEYGDYYFIEEKAPKGYLTSKEEYLFSIKETGKLVKLEKDVKNYKEPTIEKTINDSSKNAGINRETEYTYDIKTLLPEDIQTYKNYVVTDVLDDRLEIVGTPIVKIDGKKIDESIVNVIVAGQKVIASVEDFSKITGKELHLQITAKMKSDVQSGVEIPNKAVLDFVNKDDISSEKDGKPSNEVLVTPTMGNITIEKIDGKNKNLKLEGARFELRDKKGNVVTVNKKKMDDVTDANGIITWNEIPYGEYQIVETVAPKYKDEDGSVEQYQKLRDPINITIDKDNKVIELQVENNKSGWIIPATGGMGTILFTVVGLLLMAVAAFIFFRKKPVKNS

SEQ ID NO: 27585 - protein, 100 aa, Bacillus cereus HuA4-10
TTDPEKPGTTDPEKPGTTDPEKPGTTDPEKPGTTNPEKPGTTNPEKPGTTNPEKPGTMNPEKPEKELPKTGQKMPVEPYMGAILVMMSFGLLVLGRKQKR

SEQ ID NO: 27586 - protein, 503 aa, Bacillus cereus HuA4-10
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGQGQGILAVSDYQAVQSVKEVAKKISEKDAEQKSMAYVGGESEQNLWAPTEKEFGYIVEEGVAIPVYKVVVHSNNPFGAWETFIDAENGKLIKKIDINRKAEGTGKVFLPNPVVSSGSLAGLKDNNDADSTALNNQLKTVTLKGLDGTGFLIGEYVTISSKAKTKSTNLQFNFTRANDSFEDVMSYYHIDTLQRYIQGLGFKNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACVGEWDATAYSSSDPTCLRRLDNNKVYPKDITNEVHDDGEIWAQGQYEMAQAFGRDVATKIILQSHWSLTPNAKFRDGAKAIKQADALLYGGQHAAEIDRIWTARGISTN

SEQ ID NO: 27587 - protein, 212 aa, Bacillus cereus HuA4-10
MKIGIIGASGKAGSRILKEALDRGHEVTAIVRDAAKITDQNVKVLEKDVFSLTSNDLQAFDVVVNAFGAPAGQEHLHVDAGNVLIEAVKGAPNTKLLVVGGAGSLFVDEEKTTRVFDTPGFPNEYLATAQNQGKNLEILQQTNDITWTFISPSALFALGKRTGSYTAGKDNLLVNSKGDSYLSYEDFAVAALDEIENPKHVNERFTVVSEAE

SEQ ID NO: 27588 - protein, 362 aa, Bacillus cereus HuA4-10
MKTKQTIAASTLALAMIAGSIPTHAEVNDATPQQSTGDRLAEIKQHKQELDAKLQQHKENVDQTLNELNQVKENVDTKVNELHERKQVADEKIGEIKQHKQELDAKLQQDKQIADEKIAEIKEHKKHVDEKVAEIKEHKQIVDEKVNEIKQHKENIDAKVNELKEVKKHVDETLAELKKAKQTAEDKLAEIKENKPNTGNTLEELKKIKQNLDSLSSNLELAKQDVKNKLAELQETRQDLINKLNEIKQAKQTVSDDLTKKKQDLDIKINDFKHTEKKIDDKLAELHTTKQNVDNKINEVSHPTQTTANNNNTNIPSKNTARELPNAGSEQSNNMALGMLSVLGGVLLLTRNKIKKVFIKQL

SEQ ID NO: 27589 - protein, 971 aa, Bacillus cereus HuA4-10
MKGYSKKVLVGVSFASLMLGSFQGSILAKDTKGDQVSYRNVLKMEPVGVQLPVEELAHSSKVLESKSFEKRLQLADLSQRPPEVKKESKQLAVAKTYTIAELNQLSNQQLVDLLVTIDWEQITGLFQFNKDSLAFYQNDSRMQAIIDKLKQQGQAYTKDDSKGIETLVEVLRSGFYLGFYNAELSKLNERSYHDKCLPALKTIANNPNFKLGTLEQNRVVSSYGKLIGNASSDVETVTPAAKIFKQYNDNFSTLVDNLSAGNAIYDIMQGVDYDIQSYLYDTRKAPKDTVWYQKIDSYINELSRFALMGTIAEKNGWLINNGIYYTGRLGTFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGMYIEGTGTFFTYERTPEESIYSLEELFRHEFTHYLQGRYEVPGLWGQGKFYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSDIAAEITAEAKLNNVSVKKNKSQFFNTFTLQGTYTGTAAKGENEDWKTITQNVNDTLKRLSAKEWTGYKTVTAYFVNYRVNASGQFEYDVVFHGINTEESAVNKAPVAVINGPYSGNVNEAISFKSDGSKDEDGKITSYKWEFGDGTVSNEQNPTHVYTKEGTYTAKLTVTDDKGATNTNTTSVTVKKKEDNSVEQEPNNSFKTANKLQLNQLLRASLGNGDTSDFFEINVETAKNLQINVTKENNIGVNWVLYSEADLNNYVTYAQQQGNKLVGNYYTYPGKYYLHVYQYGGGTGNYTVEVK

SEQ ID NO: 27590 - protein, 1094 aa, Bacillus cereus HuA4-10
MGRRVFKRVFALLSVLALFFNVFLPKANAEVMTHEKYSMNWSYSNSLGKYIRTEIIKNSSGQIAYCLTLGLKSPNGEDLPEMGKTDNVVYRVLLNGFPQKSIEQLGVANKNEAHYATQLAVWNALGQLDVNELKHENKNVEKAAKTIINAANTSEDTQDIFMNVIPAEKQKAELKGEFFETNLYTVQTNAKSGSYKVVAKNAPNGVKIISENGEMKDQLSVGEKFRIQIPKDTKTGEFNLSVAANLTKVQAIAYRGTDTVQNATVLLERNEEKLSSDLAVNWEAAGSLKIKKVGENGEVLAGAVFEVFNANNESVGKITTGVDGTAELNNLPIGTYTVKEIKAPTGYVSGDKPQTIEVKTGEIGAVQVVNNKVKGNIEIKKLSDSGKVLPNVEFTVFTEDGKEVKKVVTKENGIANVDGLTYGKYYFLETKTPNGYIGNKTKYPFEIKEHNKTLTFTVENTEVKGSVKLLKVDNEDISKKLEGAVFELKDASGKVIGEYKTDKNGEVNVKDLAYGKYSFVEKASPNGYVLITEPIMFEIKEHGKIIELLAVNHLIKGDLEITKVDVADGNNKLPNAEFAIYNEAGKEVVKGKTDDKGIAKFEKLPFGKYTYKETVAPKGYVLNEEMFSFEIKENGQIIKHIVKDEKIPSVKTTATDKTDGTKEMHTSKSVTIQDKVEYKDLQVGKEYTLKGKLMDKETNKPLVVNGKEVTAETKFTPKEANGSITLDFTFDATGLEEKEVVVFEDVLKEGKIVTTHADINDKGQTVKFVKPSVKTTATNKTDGGKEIHANDSITIQDKVEYTNLVVGKEYTVKGKLMNKVINKPLLIDGKEVTAETKFTAKEKNGFVTLDFTFVGAEQQGREVVVFEDLLHEGQVIATHADINDVGQTVRFVEPSIKTTASNKADGSKELDATKSVTIQDKVEYKDLIVGKEYVVKGKLMDKATNKPLLVDGKEVTAESKFTAKEKNGSITLDFTFNASALQGKEVVVFEELYQDNVLVAIHVDIEDKGQTVKFKEVKPEQPKPEQPKPEQPNPDKNTPTSEQPKEQPQLKKEIQSKIGWLPQTGTNLTSWISMAAGALLLIVGGVIFLKRKNA

SEQ ID NO: 27591 - protein, 101 aa, Bacillus cereus HuA4-10
GENPTTPPTGDGNNGENPTTPPTGDGNNGNESKQDGNNAGSGQTTTDNQNSKETVSENKEADKEERDLPKTGASIASTIGAGLAFVGAGLLMLFRRKKANR

SEQ ID NO: 27592 - protein, 431 aa, Bacillus cereus HuA4-10; identical to SEQ ID NO: 26767

SEQ ID NO: 27593 - protein, 183 aa, Bacillus cereus HuB1-1; identical to SEQ ID NO: 26916

SEQ ID NO: 27594 - protein, 1093 aa, Bacillus cereus HuB1-1
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLADAVFEVFNANNESVGKITTGADGMAELNNLPIGTYTLKEIKAPTGYVSDDKPQTIEVKTGETGAVQIVNNKVKGNIEIKKLSDSGKVLPNVEFTVFTEDGKEVQKVVTKENGIANVEGLTYGKYYFLETKTPNGYIGNKTKYPFEIKEHNKTLTFTVENTEVKGSVKLLKVDNEDISKKLEGAVFELKDESGKVVGEYKTDKNGEINVKDLAYGKYSFVEKASPHGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEIHTSKSVTIQDKVEYKDLQVGKEYTLKGKLMNKETNKPLVVNGKEVTAETKFTPKEANGSITLDFTFDATGLEEKEVVVFEELLKEGKIVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKSVTIQDKVEYKDLIVGKEYVVKGKLMDKATNKPLLVDGKEVTVESKFIAKEKNGSITLDFTFNASALQGKEVVVFEELYQDNILVAIHAEIEDKEQTVKFKEVKPEQPKPEQPNSDKNTPTPEQPNEQVKEQPQPKQEIQSKIGWLPQTGTNLTSWISMAAGALLLIVGGVIFLKRKNA

SEQ ID NO: 27595 - protein, 412 aa, Bacillus cereus HuB1-1
MKKAKEIAKCVAVASVIMSGSFGLQATSAFAESKGTVENLQNGGKVYNSFKTTYDMKQNIKNSIKVSFIEDPYADKKIAIVTTDGSNIDAKYTINSGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTETTSDLKITNRRISDQYNIEWVSSKWWGTNNKDTYNEFFTNHYKLDWKNHQVTLDKQKALEEQMNSINSVNDKLNKGKGKLSLSMNGNQLQATSSNAGYGISYEDKNWGIFVNGEKVYTFNEKSTVGNISNDINKLNIKGPYIEIKQI

SEQ ID NO: 27596 - protein, 458 aa, Bacillus cereus HuB1-1
MNLKLTSKLERLRKSKKGIGACVLAAGVTAITMIPQSAYAHGFVEKPSSRAALCSQNYGALNLNCGNVMYEPQSLEAPKGFPDGGPIDGKIASAGGLFGGILDQQTTNRWFKNTIKGGENTFTWKYTAAHSTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDKEAPTQPKGLHSMGTTATTVDLMWSPSEDNVGVDHYIVYRESAGVMNKIGTAANTSFIDKGLKANTSYKYVVTAVDLAGNESSRSDVLNVTTKLEDSTYEKWDARKVYTKGDRVVHEGKVYEAVQDHQGNGDSNWIFALSLWKPVLNK

SEQ ID NO: 27597 - protein, 263 aa, Bacillus cereus HuB1-1
MKKQSLAIATILSLGLTVFGGTTSTFAMTEPNDNVTFQFTSKYIGNIPSKPKDCNNVDKYKLCTNKEEADAWGKKQFSKWSKEEKSAIRDYTKNARPYNEFLRTHAGKLDSDLTMKKKIESLDKALNRKEAKMNDNIKVYRGDDAWIFGKEYDNSIIKNGKVDREKFKEIQKKFQGKTITEFGYISTSILIDAGYAKTRPVMTEFKVGSGTHGAYMNSDDLTAYPGQYELLLPRNTVYKIEKIYIAIDNNTQKEQIKVEATIK

SEQ ID NO: 27598 - protein, 172 aa, Bacillus cereus HuB1-1; identical to SEQ ID NO: 26900

SEQ ID NO: 27599 - protein, 333 aa, Bacillus cereus HuB1-1
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKISPASVRTNQLKEIQDFIKNKNIPNNEYVLIGGDMNVNKINAENNNDSEYASMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 27600 - protein, 179 aa, Bacillus cereus HuB1-1; identical to SEQ ID NO: 26915

SEQ ID NO: 27601 - protein, 81 aa, Bacillus cereus HuB1-1
PEKPGTPNPEKPGTPDPEKPGTPNPEKPGTPDPEKPGIPNPENPEKELPKTGQKMPVEPYMGVLLVMMSFGLLVLGRKQRR

SEQ ID NO: 27602 - protein, 336 aa, Bacillus cereus HuB1-1; identical to SEQ ID NO: 26897

SEQ ID NO: 27603 - protein, 503 aa, Bacillus cereus HuB1-1
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNSPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWVARGISTN

SEQ ID NO: 27604 - protein, 172 aa, Bacillus cereus HuB1-1
MGKIFKFGCLGIIALFVIGIIAMVAGGGDSSEKTSTDTKAVSKEGVSSDVKISVGSMETVDSVGNEYSKEQAQGVFKILEVTLTNNQKDAITVDTNSFKLVDNKGREFTSSVQGQSSFDLANGGKTDFFLKQLNPGLTQTGKIVFDIPKDAEGLFLKASGGMTGKEINLKVE

SEQ ID NO: 27605 - protein, 893 aa, Bacillus cereus HuB1-1
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANTDELNMTSDFSELRLACLTVATNKYGTNSIEVQAIQNAFDAAKITGTVKENEKTIENQAPELTVPITITLRVGDTFDPMRNVKAVDKEDGDLTNKVKHKGDVDTSKSGTYIMEYMVVDSQGRNATATQTVIVEKNGETSDLEPKLTVPVGATIHVGDSFVSMAEVLAIDKEDGDLTSKIKVDGEVDTSKAGTYILTYTVTDSKGHEVTAKQTVTVKVREEVKNDKPILKVPATTSITEGDQFDPLVGVSATDKEDGDLTSKVAYEGTIDTTKAGTYEIIYSVRDSVGNEVNTIQKVLVKDKETSKPNGLANKTNNNNISNNSNTDKKEYTYKDLPKTGVSTTNSAAIGILMIIAGTVLTLIRKSRKIQK

SEQ ID NO: 27606 - protein, 563 aa, Bacillus cereus HuB1-1
MIEVVKGIREMKRIFSVLLVFFLTFSTWSSVLVKADSPSKGTLTIHKYEQEKDGAQGLEGDGSANQEVPKDAKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPTIDKKINGKLEALPINPLTNYNYDIKTLIPEDIKEYKKYVVTDTLDNRLVIQGKPIVKIDGAEVNASIVEVAIEGQKITATVKDFTKLDGKKEFHLQIKSQVKEGVPSGSEILNTAKIHFTNKNDVIGEKESKPVVVVPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKSANN

SEQ ID NO: 27607 - protein, 229 aa, Bacillus cereus HuB1-1
METLAVLIFLASIVLFVLFIIALFKRKPKAKLFISSIVCLVLAMILIPTKDKEEKPKAKETTQQASIEVKKEPKKEEPKKKDEPKEEEPKKEEPKKELSKEGESSKVKITVGSVESVDSVGGEYLNEKAKGIYKVVEISITNNQKDAITVDANSFKLMDNQDREFKYSTQAQTAYDIGNSGKSDFFLKQLNPGLTQTGKIIFDVPADAQGLVLKARGGMMGKEIKLKVE

SEQ ID NO: 27608 - protein, 455 aa, Bacillus cereus HuB1-1; identical to SEQ ID NO: 26910

SEQ ID NO: 27609 - protein, 118 aa, Bacillus cereus HuB1-1; identical to SEQ ID NO: 26903

SEQ ID NO: 27610 - protein, 965 aa, Bacillus cereus HuB1-1
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTSENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDTYTVPEVADDYLAEHATKSLGAVKKEISDTLPMKDTKMAKHNSQFFNTFTLEGTYTGSVTKGESEDWKEMSKRVNESLEQLAQKEWSGYKTVTAYFVNYRVNSSNEFEYDVVFHGIAKDDGENKAPTVNINGPYNGLVKEGIQFKSDGSSDEDGKIASYLWEFGDGSTSAEVNPVHVYEREGSYKVSLRVKDDKGKESRSETTVTIKDGSLTESEPNNRPEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYELSVK

SEQ ID NO: 27611 - protein, 971 aa, Bacillus cereus HuB1-1
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNIDSLAFYQNDSRMQAIIDKLKQQGQAYTKDDSKGIETLVEVVRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPEERYTAERTLNAKYGTWDFYNYSFALQSYMYNKRYNMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNASGQFEYDVVFHGINTEEGAENKAPVAVINGPYSGNVNEAISFKSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 27612 - protein, 746 aa, Bacillus cereus HuB1-1; identical to SEQ ID NO: 26894

SEQ ID NO: 27613 - protein, 370 aa, Bacillus cereus HuB1-1; identical to SEQ ID NO: 26909

SEQ ID NO: 27614 - protein, 878 aa, Bacillus cereus HuB1-1; identical to SEQ ID NO: 26911

SEQ ID NO: 27615 - protein, 92 aa, Bacillus cereus HuB1-1
EVKPEDPKEPKEPEVKPEDPKEPKEPEVKPEDPKDLKKPEVRLEKLNKDPQVKVEKELPKTGAAHPWMMSVGAGISFLVGGVLFVLGRRRKQ

SEQ ID NO: 27616 - protein, 431 aa, Bacillus cereus HuB1-1; identical to SEQ ID NO: 26534

SEQ ID NO: 27617 - protein, 738 aa, Bacillus cereus HuB2-9; identical to SEQ ID NO: 26889

SEQ ID NO: 27618 - protein, 1064 aa, Bacillus cereus HuB2-9
MLQNPLKVIASAVILTTTLVTPVMTNSMTIHAETQEQSIENQVPAERIFHVIGKGDVNQIKDKERRQFSFSPYEPTGLYAGPNEKITIKVEGTQNIKAYIGTYSYDGAWNQDNLVKSFTLNPGENTIESPNGGMIYFYNQQNGGSVQAEVKTGGVPVPFFELGKHTKQDLINMLDTYPNAHAVELKGERSLITASPERVKKYLIGSNTDPVELLKKIDESIRLEDRVAGLSEEEADKHYVHFVEDNHSSYYMYAYTYRTAYVKDAIQVVLDINQFTKDGWGPWHEMGHQRQPNPWTWNGLGEVTNNIYSMSVQRAYGLPSRLEKDGVYQKAFTYLNKPQSEKDYNKIDDVFVKLVMFWQLDLAFREEFYPKLHQLYRAIPKEELPKTNDEKIQNFIYNTSKVAQKNLLPFFDQWGLIATPEIRQKIESLNYPILTAPIWEATDSKPVIVEENGETQDTEPKLTVPDGATMNVGDSFNPMAGVSATDKEDGDLTDKVTVEGKVDTSKAGNYELTYTVKDSKDQKVTAKQTVTVKKKEETKDEAPELKVPSETTITEGDQFDPMAGVSAIDKEDGDITPEVKYEGDVDTNTPGTYMIKYTVKDSAGHLATQTQTITVKEKPAEDQEPELTVQEETVLTVGDRFDPMSGVKAIDKEDGDITSKVTYSGDQGTDKDGTYKIKYVVEDSKGHRVIKLRTVIVKTAGKPSENQAPVLKVPFTTTLHIGDTFDPMTGVSASDKEEGNLTEKVKHKGNVDTTKPGKYIVEYWVVDSQEVNATATQTVIVEENRETPDMEPKLTVPGGETMNVGDSFDPMTGVSATDEEDGDLTDKVTVEGKVDTIKPGTYVLTYTVKDSKGHKATAEQTVTVKETEELKDEAPVLTVPAEVNMNVGDSFDPMSGVKAIDKEDGDLTKKVVHFGEVDTSKAGTYEVKFLVRDSGGNEAIMTQKVVVKDKDNGNGSDNANNGLGNNNDSDNGNNNTNNGNGSDNNNTNNGNSLDNGSNGTNNSNSTDTDNNNISNISTSDKKEDTYKELPKTGTSTNNSAAMGILMVLAGMVLTIGRKFRKVLK

SEQ ID NO: 27619 - protein, 67 aa, Bacillus cereus HuB2-9
NDSGGNGSGGNRVKGDSSSQGGNVKDNATKQGDKLPNTAAHYPASILIGLSTFLIGMLLFIRRKNAK

SEQ ID NO: 27620 - protein, 965 aa, Bacillus cereus HuB2-9; identical to SEQ ID NO: 26880

SEQ ID NO: 27621 - protein, 333 aa, Bacillus cereus HuB2-9; identical to SEQ ID NO: 26881

SEQ ID NO: 27622 - protein, 502 aa, Bacillus cereus HuB2-9; identical to SEQ ID NO: 26882

SEQ ID NO: 27623 - protein, 884 aa, Bacillus cereus HuB2-9; identical to SEQ ID NO: 27109

SEQ ID NO: 27624 - protein, 878 aa, Bacillus cereus HuB2-9; identical to SEQ ID NO: 27119

SEQ ID NO: 27625 - protein, 455 aa, Bacillus cereus HuB2-9; identical to SEQ ID NO: 26887

SEQ ID NO: 27626 - protein, 106 aa, Bacillus cereus HuB2-9
TDPKGEVTDPKGEVTEPKGEVTEPKGEVTEPKGEVTDPKSEVTDPKGEGIDRVNSQITKNNALNKQIVKKEQILPATGHDTNWLSVFGGGLMLIGAYLYRRLKRVN

SEQ ID NO: 27627 - protein, 55 aa, Bacillus cereus HuB2-9; identical to SEQ ID NO: 27116

SEQ ID NO: 27628 - protein, 213 aa, Bacillus cereus HuB2-9; identical to SEQ ID NO: 26884

SEQ ID NO: 27629 - protein, 431 aa, Bacillus cereus HuB2-9; identical to SEQ ID NO: 26893

SEQ ID NO: 27630 - protein, 162 aa, Bacillus cereus HuB2-9; identical to SEQ ID NO: 26879

SEQ ID NO: 27631 - protein, 458 aa, Bacillus cereus HuB2-9; identical to SEQ ID NO: 26890

SEQ ID NO: 27632 - protein, 553 aa, Bacillus cereus HuB2-9; identical to SEQ ID NO: 27115

SEQ ID NO: 27633 - protein, 971 aa, Bacillus cereus HuB2-9; identical to SEQ ID NO: 27110

SEQ ID NO: 27634 - protein, 370 aa, Bacillus cereus HuB2-9; identical to SEQ ID NO: 27118

SEQ ID NO: 27635 - protein, 884 aa, Bacillus cereus HuB4-10; identical to SEQ ID NO: 27109

SEQ ID NO: 27636 - protein, 162 aa, Bacillus cereus HuB4-10; identical to SEQ ID NO: 26879

SEQ ID NO: 27637 - protein, 965 aa, Bacillus cereus HuB4-10
MNKKSKINKMMLSISTMALSLGAIQTNVSAEEKVPYNVLHSKPVGIEKPVDEIGHVSKAEETLSFQERLKVGDFSQRPASITRNLAVKQAKDSYSMADLNKMNDQELVETLGSIKWHQITDLFQFNEDAKAFYKDNGKMQVIIDELAHRGSTFTKDDSKGIQTFTEVLRSAFYLAFYNNELSALNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNEVTSENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDSKLNKEYQEYMQQLINNQDKYTVPEVADDYLAEHAPKSLTEVKKEISETLSMKDAKMTKHESQFFNTFTLEGTFTGSVTKGESEDWNAMGKRVNEALEQLAQKEWSGYKTVTAYFVNYRVNSSNEFEYDVVFHGIAKDDGENKAPTVHINGPYNGLVKEGIQFKSDGSNDEDGKIVSYSWEFGDGRTSTEVNPVHAYEKEGTYKVVLRVKDDKGKESRSETTVTIKDGSLTESEPNNRKEEANRIRLNTTIKGSLIGGDHTDVYTFNVASAKDIDISVLNEYGIGMTWVLHHESDMQNYAAYGQANGNHIEAKLNAKPGKYYLYVYKYDNGDGTYSLSLK

SEQ ID NO: 27638 - protein, 431 aa, Bacillus cereus HuB4-10; identical to SEQ ID NO: 26893

SEQ ID NO: 27639 - protein, 878 aa, Bacillus cereus HuB4-10; identical to SEQ ID NO: 27134

SEQ ID NO: 27640 - protein, 370 aa, Bacillus cereus HuB4-10
MKTKQTIAASTLALAMIAGVNSAHAEVNDTTPQQNTGDRLAEIKQHRQELDAKLQQHKENVDQTLNELNQVKENVDTKVNELHERKQVADEKINEMKQHKQELDAKLQQDKQIVDEKINEIKEHKKQVADKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQKARQDLLNKINEIKQAKQTVSDDLTKKKQDLDIKINDFKHTEKKIDDKLAEVHTTKQNVDNKINEISQSKQTQADNSAKNNNARELPNAGSEQSNNMALGMLSVLGSVLLVTRNKIKTLFSK

SEQ ID NO: 27641 - protein, 458 aa, Bacillus cereus HuB4-10; identical to SEQ ID NO: 26890

SEQ ID NO: 27642 - protein, 723 aa, Bacillus cereus HuB4-10; identical to SEQ ID NO: 26883

SEQ ID NO: 27643 - protein, 502 aa, Bacillus cereus HuB4-10; identical to SEQ ID NO: 26882

SEQ ID NO: 27644 - protein, 738 aa, Bacillus cereus HuB4-10; identical to SEQ ID NO: 26889

SEQ ID NO: 27645 - protein, 333 aa, Bacillus cereus HuB4-10; identical to SEQ ID NO: 26881

SEQ ID NO: 27646 - protein, 455 aa, Bacillus cereus HuB4-10; identical to SEQ ID NO: 26887

SEQ ID NO: 27647 - protein, 971 aa, Bacillus cereus HuB4-10; identical to SEQ ID NO: 27110

SEQ ID NO: 27648 - protein, 553 aa, Bacillus cereus HuB4-10
MKKILSVLLVVFLTFSAWSNELVKAASPTKGSLTIHKYEQEKEGTTGVEGDGSANQEVPTNVKPLKGVTFEVKKVASFEKISNDGKIVKEDVKPVTGATPSQVVTDDNGQAVLKDLPLGRFEVKEVAGPPHVNLNPNTYTVDIPLTNKEGKVLNYDVHMYPKNEIKRGAVDLIKTGANDKALAGAAFSVFKKDGTEVKKDLVTDANGHIRVQGLEYGEYYFQETKAPKGYVIDPTKREFFIKNSGTINEDGTITSGTVVKVELKNYEEPTIDKKINGNLEALPINPLTNYNYDIKTLIPEDIKEYKKYVVTDTLDNRLVMQGKPIVKIDGAEVNASVVDVAVEGQKVTATVKDFTKLDGKKEFHLQIKSQVKEGVPSSSEILNIAKIDFTNKNDVIGEKESKPVVVVPTTGIIELSKIDGDNKKKLKGAEFVLKDKNGKIVVVAGKEVIGVSDENGVIKWSNIPYGDYQIFETKAPTYTKEDGKTASYQLLKDPIDVKVSENNQTVKLTIENNKSGWILPVTGGIGTTLFTVLGLTLMVTAAFVFFRKKFANK

SEQ ID NO: 27649 - protein, 1064 aa, Bacillus cereus HuB5-5
MLQNPLKVIASSVILTTTLVTPVMTNSMTIHAETQEQSIENQVPAERIFHVIGKGDVNQIKDKERRQFSFSPYEPTGLYAGPNEKITIKVEGTQNIKAYIGTYSYDGAWNQDNLVKSFTLNPGENTIESPNGGMIYFYNQQNGGSVQAEVKTGGVPVPFFELGKHTKQDLINMLDTYPNAHAVELKGERSLITASPERVKKYLIGSNTDPVELLKKIDESIRLEDRVAGLSEEEADKHYVHFVEDNHSSYYMYAYTYRTAYVKDAIQVVLDINQFTKDGWGPWHEMGHQRQPNPWTWNGLGEVTNNIYSMSVQRAYGLPSRLEKDGVYQKAFTYLNKPQSEKDYNKIDDVFVKLVMFWQLDLAFREEFYPKLHQLYRAIPKEELPKTNDEKIQNFIYNTSKVAQKNLLPFFDQWGLIATPEIRQKIESLNYPILTAPIWEATDSKPVIVEENGETQDTEPKLTVPDGATMNVGDSFNPMAGVSATDKEDGDLTDKVTVEGKVDTSKAGNYELTYTVKDSKDQKVTAKQTVTVKKKEETKDEAPELKVPSETTIIEGDQFDPMAGVSAIDKEDGDITPEVKYEGDVDTNTPGTYMIKYTVKDSAGHLATQTQTITVKEKPAEDQEPELTVQEETVLTVGDRFDPMSGVKAIDKEDGDITSKVTYSGDQGTDKDGTYKIKYVVEDSKGHRVIKLRTVIVKTAGKPSENQAPLLKVPFTTTLHIGDTFDPMTGVSASDKEEGNLTEKVKHKGNVDTTKPGKYIVEYWVVDSQEVNATATQTVIVEENRETPDMEPKLTVPGGETMNVGDSFDPVTGVSATDKEDGDLTDKVTVEGKVDTIKPGTYVLTYTVKDSKGHKATAEQTVTVKETEELKDEAPVLTVPAEVNMNVGDSFDPMSGVKAIDKEDGDLTKKVVHFGEVDTSKAGTYEVKFLVRDSGGNEAIMTQKVVVKDKDNGNGSDNANNGLGNNNDSDNGNNNTNNGNGSDNNNTNNGNSLDNGSNGTNNSNSTDTDNNNISNISTSDKKEDTYKELPKTGTSTNNSAAMGILMVLAGMVLTIGRKFRKVLK

SEQ ID NO: 27650 - protein, 431 aa, Bacillus cereus HuB5-5; identical to SEQ ID NO: 26893

SEQ ID NO: 27651 - protein, 370 aa, Bacillus cereus HuB5-5; identical to SEQ ID NO: 26891

SEQ ID NO: 27652 - protein, 502 aa, Bacillus cereus HuB5-5; identical to SEQ ID NO: 26882

SEQ ID NO: 27653 - protein, 197 aa, Bacillus cereus HuB5-5
MGKIFKFGCLGFIALIVLGAIAAALGGGDDEKEKASSEPKQETQAPAAKEEPKKQEAKKEEPKKELSKEGESSKVKIAVGSVESIDSVGGEYLKEKAQGVFKVVEITITNNQKDAITVDANSFKLVDNKDREFTYSTQAQTAFDVGNGESSDFFLKQLNPGLSQTGKIIFDVPADAQGLVLKARGGMMGKEIKLKVE

SEQ ID NO: 27654 - protein, 723 aa, Bacillus cereus HuB5-5
MKKLKPALSVLGSVSMALTLASPALADTKQPNAGSTIEMFKEDANAKEGKDLIYGIDGKKGKMSTEKIEIQNDDWDQDGISNDLEIKGYKIEFNRQTGKNEAQAWDPERDKDKLKFITNPMSANSDGDPFTDAYEVQYYGSNSDTEFNPMVANIPNLQVGIKRIGVTPLAAITDSNGGSIDKGWEKSVSTQHSFGVGAGVEGGVEGSAAGPVPSGKASLNVSYGYSKTSTDTERYSSNIDWSTAKTVDSAKAAKVSLQLEYKNTGTASAQNVSPHFNIRLGDKIISTVKATQDRYKANQLSTEKGGRNTTEVLIDSVDNQADVNIYLSLDELKAVEQGAILSVEVLPTSTMELYIEKDGEFMNLGDSGKFESRVNASTTILETDIGNKPKFRMYAPEGVGSDTNLTFNEVLKHVKVDSKKINEFIDNSRGDQVIIAKENLENAKKSYVSKGAKVGVFTKIQQPELSYSAYDPFTKKFYAAVVPGLFGASNEISVSFENKNSKQTQQVTLVRKGNVYESKEAVSLNDFNPSQKVTFEINDAQKKLPTQKISTVVTYNKEYENYLTHRFSDELIVEGTPYTLQLSGNPVLSYKGNDKWQYLASGGNYTQPVNVIIERKGQPKPGQPIKAGEELHIKVQNSAYSGYEYLKLQDKYIHFDQKQNASTFKFNHAHSPGYLDYQREWHLQSDGNKLGFSTYDAGYISYGNDRQTYGGRFEDKWSLVKAK

SEQ ID NO: 27655 - protein, 971 aa, Bacillus cereus HuB5-5
MKGYSKKVLVGVSFASLLLGSFQGSISAENTKEEQVSYRNVLKMEPVGVQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLKQQGQTYTQDDSKGIETLVEVLRSGFYLGFYNTELSKLNERSYHDKCLPALKTIASNPNFKLGTLEQNRVVSSYGKLIGNASSDVETITSAAKIFKQYNDSFSTLVDNLSAGNAIYDIMQGVDYDIQSYLYDTRKVPKDTVWYQKIDSYINELSRFALMGTITAKNGWLINNGIYYTGRLGTFHSTGTKGLQVVTDAMNIYPYLGEQYFVAAEQIATNYGGKDANGNMVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDTNLNKEYQDYMQMLVDNRDKYNVPLVSEDYLARHASKPVSDIAAEITAEANVKNVSVKKNKSQFFNTFTLQGTYTGTAAKGEYEDWKTITQKVNDTLKRLSTKEWTGYKTVTAYFVNYRVNASGQFEYDVVFHGMNTEEGAVNKAPVAVINGPYSGNVNEAISFKSDGSKDEDGKIASYKWEFGDGTVSNEQNSTHIYTKEGTYTAKLTVTDDKGATNTATTSVTVKKKEDNSVEKEPNNSFQTANKLQLNQILRASLGNGDTSDFFEINVETAKNLQINVTKENNIGVNWVLYSEADLNNYVTYAQQQGNQLVGSYYTYPGKYYLHVYQYGGGTGNYTVEVK

SEQ ID NO: 27656 - protein, 172 aa, Bacillus cereus HuB5-5
MGKIFKFGCLGIIALFVIGIIAMIAGGGDLTEKTSTDTKAVSKEGVSSDVKIAVGSMETVDSVGNEYSKEQAQGVFKILEVTLTNNQKDAITVDTNSFKLVDNKGREFTSSVQGQTSFDLANGGKTDFFLKQLNPGLTQTGKIVFDIPKDAEGLFLKASGGMTGEEIKLKVE

SEQ ID NO: 27657 - protein, 162 aa, Bacillus cereus HuB5-5; identical to SEQ ID NO: 26879

SEQ ID NO: 27658 - protein, 553 aa, Bacillus cereus HuB5-5; identical to SEQ ID NO: 26888

SEQ ID NO: 27659 - protein, 878 aa, Bacillus cereus HuB5-5; identical to SEQ ID NO: 26892

SEQ ID NO: 27660 - protein, 890 aa, Bacillus cereus HuB5-5
MKNKKEIAIVALTTGLALTAVAPYGIGHAEETDQLQVQMQEESFRSGELTQPSQKTPENVVKDALKEKTEQALSPKQVNGETGVDYKVFQKRGSYDGTTLVRMQQTYEGKEVYGHQLTAHVDNKGVIKSVSGDSAQNLKQEDLKKPIKLSKEEAKQYIYTKYGSNIKFISEPEVKEVIFVDENNGQASNAYQVTFAAATPSYVSGTYLVNADNGEMLKNMVQESGLKVSEEHVEPLKESKKNNFVSLTGTGKDDLGITRTFGISEQSNGKYALADYTRGQGIETYDVNYRDITNEEKYYPGILVTSTSPTFTDPKAVSAHFLATKVYDFYKDKYKRNSFDNKGKKVVSVVHAWDSGGTNNPKNWENAFSANINNISMLIYGDPMVKSFDIVGHEFTHAVTSSESNLEFFGESGAINEALSDIMGTAIEKYINNGKFNWTTGEQTGSVFRNMKNPSSINYSNGVPYPDDYSKYNDLNGEDNGGIHFNSSIINKVAYLIAQGGTHNGVTVNGIGEDKMFDIFYYANTDELNMTSNFSELRLACLKVATNKYGANSIEVQAVQKAFDAAKIKETVKENEKTAENQVPELTVPSTITLRVGDTFDPMRNVTAADKEDGDLTNRVQHKGDVDTSKPGKYIVNYLVVDSQGGNATDTQTVIVEKNEEILDIEPKLTAPIGVTINVGDSFVPMTEVLAIDKEDGDLTSKVKVDGKVDTSKAGTYVLTYTVTDSKGHEVTAKQTVTVTVREEVKNDNPILKVPATTTINENDQFDPMVGVSATNKKNDDLTSKVKVDGKVDTSKADTYEIIYSVRDSVGNEVKAIQKVLVKDKDTSKANGLANNSNISNNSNSDKKEYTYKELPKTGASTTNSAVMGMLMVIAGTVLTLIRKFRKTHK

SEQ ID NO: 27661 - protein, 455 aa, Bacillus cereus HuB5-5; identical to SEQ ID NO: 26887

SEQ ID NO: 27662 - protein, 738 aa, Bacillus cereus HuB5-5; identical to SEQ ID NO: 26889

SEQ ID NO: 27663 - protein, 965 aa, Bacillus cereus HuB5-5; identical to SEQ ID NO: 26880

SEQ ID NO: 27664 - protein, 333 aa, Bacillus cereus HuB5-5; identical to SEQ ID NO: 26881

SEQ ID NO: 27665 - protein, 333 aa, Bacillus cereus IS075; identical to SEQ ID NO: 26429

SEQ ID NO: 27666 - protein, 564 aa, Bacillus cereus IS075; identical to SEQ ID NO: 26430

SEQ ID NO: 27667 - protein, 431 aa, Bacillus cereus IS075; identical to SEQ ID NO: 26428

SEQ ID NO: 27668 - protein, 372 aa, Bacillus cereus IS075; identical to SEQ ID NO: 26433

SEQ ID NO: 27669 - protein, 203 aa, Bacillus cereus IS075; identical to SEQ ID NO: 27347

SEQ ID NO: 27670 - protein, 192 aa, Bacillus cereus IS075
KPEVTEKPEIHVKPEEEQVEEETTEEIKEEKPEEPKVTEEPKELEKPEVTEKPEIHVKPEEEQVEEETTEEIKEEKPEEPKVTEKPKELEKPEVTEKPEIHVKPEEEKVEEPNKSEVKEQPKVSNKPEIQGKVEAENKQDVQNKNEVSSSKESNKQSKLLPQTGGAAAESTSILAGMFALILGAIMFRRQKN

SEQ ID NO: 27671 - protein, 456 aa, Bacillus cereus IS075; identical to SEQ ID NO: 26352

SEQ ID NO: 27672 - protein, 965 aa, Bacillus cereus IS075
MNKKSKINKVMLSISTMALSLGALQAPASAEEKVPYNVLKTKPVGIEKPVDEIGHVSKAEETLSFQERLKVGDFSQRPASIPNKAAVKQVKESYSMADLNKMNDQELVETLGCIKWHQITDLFQFNEDAKAFYKDKGKMQVIIDELAHRGSTFTRDDSKGIQTFTEVLRSAFYLAFYNNELSELNERSFQDKCLPALKSIAKNPNFKLGTAEQDTVVSAYGKLISNASSDVETVQYASNILKQYNDNFNTYVNDRMKGQAIYDIMQGIDYDIQSYLIEARKEANETMWYGKVDGFINEINRIALLNEVTPENKWLVNNGIYFASRFGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPAVADDYLAEHAPKSLTAVEKEMTETLPMKDAKMTKHSSQFFNTFTLEGTYTGSVTKGESEDWNAMSKKVNEVLEQLAQKEWSGYKTVTAYFVNYRVNSSNEFEYDVVFHGIAKDDGENKAPTVNINGPYNGLVKEGIQFKSDGSKDEDGKIVSYLWDFGDGRTSTEVNPVHVYEREGSYKVALIVKDDKGKESKSETTVTVKDGSLTESEPNNRPEEANRIGLNTTIKGSLIGGDHTDVYTFNVASAKDIDISVLNEYGIGMTWVLHHESDMQNYAAYGQANGNHIEANFNAKPGEYYLYVYKYDNGDGTYKLSVK

SEQ ID NO: 27673 - protein, 794 aa, Bacillus cereus IS075; identical to SEQ ID NO: 26420

SEQ ID NO: 27674 - protein, 971 aa, Bacillus cereus IS075; identical to SEQ ID NO: 26826

SEQ ID NO: 27675 - protein, 455 aa, Bacillus cereus IS075; identical to SEQ ID NO: 26424

SEQ ID NO: 27676 - protein, 187 aa, Bacillus cereus IS075; identical to SEQ ID NO: 26434

SEQ ID NO: 27677 - protein, 553 aa, Bacillus cereus IS075; identical to SEQ ID NO: 26419

SEQ ID NO: 27678 - protein, 503 aa, Bacillus cereus IS075; identical to SEQ ID NO: 26421

SEQ ID NO: 27679 - protein, 960 aa, Bacillus cereus ISP3191
MNKNLKFTHMMIGISTIALSFGSIQTQVSAEETAPYSILQMKPMRTGTSKDEIVHATKADETLTFEERLKIGDFSQRPNLVMKHDESQLKQSYTLAELNKMSNSELIDTLSKISWNQITDLFQFNQDTKAFYQNKERMNVIINELGQRGRTFTKENSKGIETFVEVLRSAFYVGYYNNELSYLKERSFHDKCLPALKAIAKNPNFTLGTAEQDRVVAAYGKLIGNASSDTEIVQYAVNVLKQYNDNLSTYVSDYSKGQAVYEIVKGIDYDIQSYLQDTNKQPNETMWYGKVDNFINEVNRIALVGNITNENSWLINNGIYYAGRLGKFHSNPYKGLEVITQAMSLYPRLSGPYFVAVEQIKTNYGGKDYSGNAVDLQKIREEGKRQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFETFDKLQDLIRANDVKNYDSYRESLSNNTQLNAEYQAYMQQLIDNQDKYNVPQVTNDYLIQHAPKSLAEVKNEIVDVANIKDAKITKYESQFFNTFTVEGKYTGGTSKGESEDWKAISKQVNQTLEQLSQKEWSGYKTVTAYFVNYRVNAANQFEYDIVFHGVATEEKEKTNTIVNMNGPYSGIVNEEIQFHSDGTTSENGKVISYLWNFGDGTTSTEANPTHIYGEKGTYTVELTVKDSRGKESKEKTKVTVKQDPQTGGSHEEEKVLLFNTLVKGNLITPDQTDVYTFNVTDPKEVDISVENEQNIGMTWVLYHESDMQNYVACGEDEGNTIKGKFVAKPGKYYLNVYKFDDKNGEYSLFVK

SEQ ID NO: 27680 - protein, 322 aa, Bacillus cereus ISP3191
ETKAPTHYDLNQTPINFTVEKSQTATASVTAKNSLTKGAVELTKVDDIDGTTLEGAIFKIVDSNGHDVRTDLTTNKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKIDSSSGGEEKPVTPPNKEEETGKETSEELEKGNPEAHGKGTSEELEKGNPETQINKQQDDRNTGKELPNTGHKNDSTQTVGIILLLAGLLSVLATKRKKYY

SEQ ID NO: 27681 - protein, 503 aa, Bacillus cereus ISP3191
MFNKKMVAMAMTVPLVMGTLSTVSAVETKKQVKVEAYSPQKKAIEYLKGNANQYGLKPDLSDLQYISTTETPVASYVRFQQVVNGAPVFSNQITVTLNGEGKGVLAVSDYQPIKAVKQVTEKISEKDAIQKSMAYVGEASEQNLWAPTDKEFGYIIEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVHGFGSSAEGGAMGEGFGDFLGATYEDAVSTTGYGKACVGEWDAAAYSSSDPTCLRRLDTNKVYPKDIKNQVHADGEIWSQGQYEMAQAFGRDVATKIILQSHWSLTPNSKFSDGAKAIKQADALLYGGQHAADIDRIWAARGISTN

SEQ ID NO: 27682 - protein, 456 aa, Bacillus cereus ISP3191
MNKKILGQFRKMATNKKGLSAAAVAVGIMSTTLIPQNAYAHGFVEKPGSRAALCSQNYGALNSNCGNIMYEPQSLEAPKGFPQGGPVDGKIASAGGLFGGILDQQTADRWFKNTIKGGENTFTWKYTAPHSTSQWHYYITKKGWNPNKPLTRADFELIGTVKHDGSKASNNLSHKINVPTDRSGYHVILAVWDVADTVNAFYNVIDVNLINDEKPDKEAPAQPSGLQVVKTTSNSVELNWKPATDNVGVKEYQVLRNGELINTVVGTSVVDKKLSPNTEYTYIVKAVDAAGNISEESEVLVTKTTEEKPDKEAPTQPKGLHSMGSTMNSIDLMWSPSEDNVDVSHYIVYREVGGAMKEIGTANTTSFIDKNLEADTAYKYVVSAVDTSGNESLKSGAFTVTTKGQENAYEQWDAYKAYKIGDRVVHEDKVYEAVQNYQGHGDPNWIFALSLWKEVN

SEQ ID NO: 27683 - protein, 372 aa, Bacillus cereus ISP3191
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAALQEARQDLINKINEMKQSKQTVSDDLSKKKQDLDIKINDFKHTEKKIDDKLAEIHTTKQNVDNKINEVSQSKQTETKTGTTNANNNARELPNAGSEQSNNMALGMLSVLGGILLVTRNKIKTLFSK

SEQ ID NO: 27684 - protein, 145 aa, Bacillus cereus ISP3191
DPKEPEVKPEDPKEPEVKPEDPKEPEVKPEDPKEPEVKPEDPKEPEVKPEDPKEPEVKPEDPKEPEVKPEDPKEPEVKPEDPKEPEVKLEKPEVRLEKLIKEPQVKVERELPKTGAASPWMVSVGAGISFLVGGVLFVLGRRRKQ

SEQ ID NO: 27685 - protein, 431 aa, Bacillus cereus ISP3191; identical to SEQ ID NO: 26106

SEQ ID NO: 27686 - protein, 333 aa, Bacillus cereus ISP3191
MKGKLLKGVLGFGIGLGVLYGGSSAQADTSTDQNNTLKVMTHNVYMLSTNLYPNWGQSERADLIGVADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 27687 - protein, 780 aa, Bacillus cereus ISP3191
MKKSKKMLAGATLAIGVIAPQVLPTTAHADEKAGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTIFDSSPNAQKYIKKDGNISYVGPSENEFAKYAIDITKKNDDDKETGGENPTTPPTGEGDNGENPTTPPTGEGNNGENPTTPPTGEGNNGGNPTTPSTDEGNNAGSGQTTTDNQNSKETTTVSENKEERDLPKTGTSVASTIGAGLAFIGAGFLLLFRRKKANR

SEQ ID NO: 27688 - protein, 965 aa, Bacillus cereus ISP3191
MNKKSKINKVMLSISTMALSLGALQAPVSAEEKVPYNVLKTKPVGIEKPVDEIGHVSKAEETLSFQERLKVGDFSQRPASITNKATVKQVKESYSMADLNKMNDQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGESEDWNAMSKKVNEALEQLAQKEWSGYKTVTAYFVNYRINSSNQFEYDVVFHGIAKDDGENKAPTVNINGPYNGLVKEGIQFKSDGSKDEDGKIVSYLWDFGDGSTSAEVNPVHVYEREGSYKVALIVKDDKGKESKSETTVTVKDGSLTELEPNNRPEEANRIGLNNTIKGSLIGGDHTDVYTFNVATTKNIDISVLNEYGIGMTWVLQHESDMQNYAAYGQANGNHIEANFNAKPGKYYLYVYKYDNGDGTYELSVK

SEQ ID NO: 27689 - protein, 971 aa, Bacillus cereus ISP3191
MKGYSKKVLVGVSFASLMLGSFQGGALAEGTKGEQASYRDVLKMEPVGLQLPVQELAHSSKVLENKSFEKRLQFADLSQRPPELKKESKQLATAKIYTIAELNQLSNQQLVDLLVTIDWEQITGLFQFNKDSLAFYQNDSRIQAIIDKLNQQGQAYTKDDSKGIETLVEVLRSGFYLGFYHTELSKLNERSYHDKCLPALKAIANNANFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGMKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIAAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGTVNKAPVAVINGPYSGNVNEAISFKSDGSKDEDGKITSYKWEFGDGAVSNEQNPTHVYTKEGTYTAKLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 27690 - protein, 455 aa, Bacillus cereus ISP3191
MNNRLLKQLQNMKMNKKSLGAVALTAGIIGTTLIPQNTYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNRIQAQKVTANSIELAWNTSTDNVGVKGYQIFRNGEMIDTVPGTHFIDKKLQPSTEYSYTVKAIDAAGNVSKESATLTVKTTVEAPDTEAPTQPIGLHSMGTTASSVDLMWSPSDDNIGVDHYDIYRETKGSMEKIATSNTTSYMDKYLLSNTTYKYVVKAVDLAGNESVQSDIFIITTKTESVSYEEWDAKKAYEKGDRVLHEGKVYEAVQSYKGNGDPNWIYALSLWKTV

SEQ ID NO: 27691 - protein, 412 aa, Bacillus cereus ISP3191
MKKAKGVAKSVAVASVIMSGSIGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKKESTSDLKITNRRISDQYNIEWVSSKWWGTNNKDTYNEFFTNNYKLDWKNHQVTLDNQKAPEEQMIGINNVNNQLNKGKGKLSFSMNGNQLKATSSNAGYGISYEDKNWGIFVNGEKVYTFNEKTTVGNISNDINKLNIKGPYIEIKKI

SEQ ID NO: 27692 - protein, 148 aa, Bacillus cereus ISP3191
MKKKLLPICAIALLTVGYSSVASADTGTVTKEEATQLQQDKAKKEAAIKEQQKIEEEKKRIAQEQLKNDMAKKEEAIKAQQKSEEGKKEAAQVQQKNAATKKEEAKPAVQGEKLPNTASNNVVMMGLSACLVAIGTLFGLKRRNKVKA

SEQ ID NO: 27693 - protein, 569 aa, Bacillus cereus m1293
MMLSISTMALSLGAIQTHASAEEKVPYNVLHSKPVGIEKPVDEIGHVSKAEEILSFQERLKVGDFSQRPASITNKATVKQVKESYSMADLNKMNDQELVDTLGSIKWHQITDLFQFNEDAKSFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDDFNTYVNDRMKGQAIYDIMQGIDYDIQSYLIEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGS

SEQ ID NO: 27694 - protein, 338 aa, Bacillus cereus m1293
MEVWNVKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFVENKVLQPKSPQWTVTSWLKKYTYDDYSDHYPVAATISMK

SEQ ID NO: 27695 - protein, 107 aa, Bacillus cereus m1293
MTEEPNVLEKPEVTEKPETWENLEEEKNKEETAEDLNVLEKREVKEQQEVSNKSDAQGELEVPSSKESDKQSKLLPQTGGTATESTSILAGMLALILGARVFRRSKK

SEQ ID NO: 27696 - protein, 553 aa, Bacillus cereus m1293
MKKIFSLFLICMLAFSTLSNMAVSAESRSTGTLTIHKYEQSKGSKTTTEGNGKEGQTVPEDAKPLEGVTFEIKRIESFEKISNDGTVIKEEAKPVKNATITKVTNAKGEAIFTDLPLGRYEVKAIKGPEHIALDTTTFIVDIPMTSTDGKDLNYDVHIYPKNETKRGSVEFVKKGEAGKVLKDAEFHLFKKNKDGTSTQVKTPSSLVTGEDGKVRVDSLEYGDYYYFIEHKAPTGYLTSKEERPFSIKESGEVVKLDDIKNYKEPTITKSINNGSKVAGINKETDYTYDIKTLLPEDIQSYKKYVVKDILDDRLEIKGLPIVMVDGKKVEDGSVKVVVEGQKVTATIEDFSKINGKELHLQITAKIKSDVESGVKIPNKAVLDFVNKDDVSSEKDGKPSNEVVVTPTAGNIKIEKVDGKDKTLKLEGAKFQLQDKKGNVIKVNGKEMNDITDANGIITWNEIPYGEYQIVETEAPKYKDKDGAVEHYQKLRNPINITLDEKHQKIELQVENNKSGWIIPATGGMGTILFTVVGLILMAVATFIFFRKKPVKNS

SEQ ID NO: 27697 - protein, 503 aa, Bacillus cereus m1293
MFNKKMVAMAMTVPLVMGTITTVSALEKQQQVKLEAYSPQKKATEYLKENAAQYGLKADLSDLQYISTTETSVASYVRFQQVVNGAPVFSKQITVTLNGEGKGVLAVSDYQSVKGVKEVTTKISEKDAIQKSMAYVGEVSEQNLWAPTEKEFGYIVEEGIARPVYKVVVHSNNPFGAWETFVDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDNNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 27698 - protein, 455 aa, Bacillus cereus m1293
MKNQFLKQLQNMKMNKKSLGAVALTAGIIGTTLIPQNAYAHGFVEKPSSRSALCSPTYGALNVNCGSVMYEPQSLEAPKGFPQTGPVDGQIASAGGKFGGILDQQTADRWFKNTITGGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNRIQAQKVTANSIELAWTASTDNVGVKGYQIFRNGEMIDTVPGTHFIDKKLQPSTEYSYTIKAIDAAGNVSKESATLTVKTTVEAPDTEAPTQPKGLHSMGTTASSVDLMWSPSDDNIGVDHYDIYRETKGSMEKIATSNTTSYMDKYLLSNTTYKYVVKAVDVAGNESVQSDIFIITTKTESVSYEEWDAKKAYEKGDKVLHEGKVYEAVQSYKGNGDPNWIYALSLWKTV

SEQ ID NO: 27699 - protein, 382 aa, Bacillus cereus m1293
MHMKEKRYKNMKTKQTIAASTLALAMMAGANSAHAEVNDATPQQSTGDRLAEIKQHKQELDAKLQQHKENVDQTLNELNKVKENVDTKVNELHERKQVADEKINEIKQRKEEFDAKLQQDKQIAEDKIAEIKEHKKQVEDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDDLSKKKQDLDIKINDFKHTEKKIDDKLAELHTTKQNVDNKINEVSQSKQTETKTGTTNANNNARELPNAGSEQSNNMALGMLSVLGGVLLIARNKIKTLFSK

SEQ ID NO: 27700 - protein, 462 aa, Bacillus cereus m1293
MGVTGPTGLQGLQGIQGPVGATGPTGPQGVQGAQGPIGQAGPQGIQGIQGEQGVRGATGPTGLQGLQGIQGIQGPTGPQGIQGEQGLSGITGPTGPQGIQGIQGPQGNIGPTGSTGIQGVQGPEGPTGPTGATGPQGIQGIQGLQGPTGPQGIQGIQGIQGPIGPIGPTGPQGIQGITGSTGPTGATGATGQAGVTGPQGPQGIQGPQGVTGQTGATGETGATGSQGPQGIQGPQGITGSTGATGPTGATGPTGPQGIQGPQGVTGATGATGATGVTGATGPTGIQGIQGITGATGGTGVTGPTGATGPTGLTGATGSSAISTGGGYFFSTSTSTIAANANIPINSGSTVYGTGVSLTSATTVTVATPGIYLVSYYFQGDATGGNETVSVRLLLNGTQVAGSFIQNVTTSTVVIEPAISNTLLVNVTSANSTLVLQNGPLGVGHVATIAGAITASLNVVRIL

SEQ ID NO: 27701 - protein, 824 aa, Bacillus cereus m1293
MALPLPLIGATGPTGNSGPIGPTGGHEGPVGPTGVTGPTGATGSQGPQGIRGIQGPRGTTGAQGIQGAIGDTGEQGITGPTGLQGAQGLIGNQGLIGDIGVQGPEGIQGITGPTGSQGIQGPQGIQGEIGERGQTGAQGMQGVIGEAGITGVTGPQGSQGAQGIQGEEGTTGIQGEEGPQGIQGITGEQGHQGDQGIQGVVGPTGSTGPQGPQGISGIKGITGVVGPQGPSGIQGIQGINGSTGFQGAKGVRGITGATGPTGTQGAEGPPGGPTGVTGPVGPSSGVTGPSGPPGPPGGPTGPTGETGARGITGGTGAIGAQGLQGITGPTGPQGVRGTQGAQGVVGAVGFQGAQGPQGFQGITGATGVEGPQGIQGPQGEIGPTGAEGPKGVQGIQGVTGPTGAQGMQGLQGIQGPTGVAGAAGAQGAQGIQGATGPAGAQGIQGAQGIRGETGAAGVQGIQGVQGLQGITGLTGPQGAQGPKGVQGIIGPTGAIGLQGPQGIQGIVGPTGAQGSQGMQGIQGITGPTGAQGIRGPQGNLGENGITGPQGVQGAQGIEGPEGPQGNIGATGVTGETGVTGEAGATGAQGIQGVQGIMGIQGSTGMTGPTGATGVTGIQGSQGIQGPQGPTGARGATGVSGSVGPAGAQGSQGPIGAVGPTGATGSAGSIGFLGIAGATGVTGLPSGGGYFFSTSTSTIAANALIPINSGSTVFGFGVSLTNATTVTLSTPGIYLVSYYFQGDPTAGNETISVRLTLNGTQVAGSFIFYVTGGTFILEPAVSNTMVIEVTASNATLSLQNGPLAIGHVTTLSGVITASLNVLKIV

SEQ ID NO: 27702 - protein, 971 aa, Bacillus cereus m1293
MKGYSKKVLIGVSFASFMLGSFQGDALAEGTKGEQVSYRNVLKMEPIGLQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTIWYQKIDSYINELSRFALIGTVTAKNGWLINNGIYYTGRLGTFHSTETKGLQVVTDAIKIYPYLSEQYFVAAEQIATNYGGKDANGKVVDLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLSNVSVKKNKSQFFHTFTLQGTYTGTTAKGEYEDWKSITQNVNDTLKRLSAKEWTGYKTVTAYFINYRVNAAGQFEYDVVFHGINTEEGAVNKVPVAVINGPYSGNVNEAISFKSDGSKDEDGKITSYKWEFGDGTVSNEQNPTHVYTKEGTYTAKLTVTDDKGLTNTVTTNVTVQKKEDNSVEKEPNNSFQTANKLQLNQILRASLGNGDTSDYFEINVETAKNLQINVTKENNIGVNWVLYSEADLNNYVTYAQQEGNKLVGSYYTYPGKYYLHVYQYGGGTGNYTVEVK

SEQ ID NO: 27703 - protein, 788 aa, Bacillus cereus m1293
MLAGATLAIGVIAPQVLPATAHADEQTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVINANTNRIINMTYEGKPVADNQEFIVATNNYRGSSQTFPGVSKGEVVYQSQDETRQIIVKYMQETPVIDPAADKNWTFKPIVADKLHTTFDSSPNAQKYIKKDGKISYVGPSENEFAKYAIDITKKNDDDKETGGENPTTPPTGEGNNGENPTTPPTGEGNNGENPTTPPTGEGNNGENPTTPPTDEGNNGENPTTPPTDEGNNTGSGQTTTDNQNVKETTTVSEKKEERDLPKTGTSVVSTIGAGLAFVGAGFLLLFRRKKANR

SEQ ID NO: 27704 - protein, 158 aa, Bacillus cereus m1293
MTGITGATGPTGSTGATGATGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGDAISLQLFGLLAVATLSTTTPGAVLTIIRLS

SEQ ID NO: 27705 - protein, 1246 aa, Bacillus cereus m1293
MRERDKQNSLNSNFRISPNLIGPTFPPVPTGFTGIGITGPTGPRGPTGPQGPRGFQGPMGEMGPTGPQGVEGIQGPVGPIGATGPEGQQGPQGLRGPQGETGATGPQGVQGLQGPIGPTGATGAQGIQGIQGLQGPIGATGPEGPQGIQGVQGLPGATGSQGIQGVQGIQGPQGPSGNTGATGATGEGITGPTGITGPTGITGPSGGPPGPTGPTGATGPGGGPSGSTGATGATGNTGATGNTGITGATGTTGPTGSTGAQGLQGIQGIQGPIGPTGPEGPQGIQGIPGPTGVTGEQGIQGVQGIQGITGATGDQGPQGIQGVIGPQGVTGATGDQGPQGIQGVPGPSGATGPQGVQGIQGAMGDIGPTGPEGPEGLQGPQGIQGVPGPVGATGPEGPQGIQGIQGVQGATGPQGPQGIQGIQGVQGITGATGVQGATGIQGIQGEIGATGPEGPQGVQGAQGAIGPTGPMGPQGVQGVQGIQGATGAQGVQGPQGIQGIQGPTGATGDMGATGATGEGATGPTGVTGPTGVTGPSGGPAGPTGPTGPSGPAGVTGPSGGPPGPTGATGATGITGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGPQGPTGIQGIQGEIGPTGPEGPEGLQGPQGIQGVQGPVGATGPEGPQGIQGIQGVQGATGPQGPQGIQGIQGVQGITGATGAQGATGIQGIQGEIGATGPEGPQGVQGIQGAIGPTGPMGAQGVQGIQGIQGATGAQGVQGPQGVQGIQGPTGATGETGATGATGEGSTGPTGVTGPTGVTGPSGGPAGPTGPTGPSGPAGVTGPSGGPPGPTGATGATGVTGDTGATGSTGVTGATGETGATGVTGLQGPQGIQGVQGEIGPTGPQGIQGPQGIQGPTGATGAQGPQGIQGPQGDIGPTGPQGIQGPQGPQGIQGATGATGAQGPQGIQGPQGDIGPTGPQGPQGIQGPQGIQGPTGATGETGATGPQGIQGPQGIQGPQGIQGPTGATGSTGSQGPTGDTGPTGAGATGATGATGVSTTATYAFANNTSGSVISVLLGGTNIPLPNNQNIGPGITVSGGNTVFTVANAGNYYIAYTINLTAGLLVSSRITVNSSPLAGTINAPTVATGSFSATIIANLPAGAAVSLQLFGVVALATLSTATPGATLTIIRLS

SEQ ID NO: 27706 - protein, 147 aa, Bacillus cereus m1293; identical to SEQ ID NO: 26827

SEQ ID NO: 27707 - protein, 431 aa, Bacillus cereus m1293; identical to SEQ ID NO: 26428

SEQ ID NO: 27708 - protein, 103 aa, Bacillus cereus m1293; identical to SEQ ID NO: 26821

SEQ ID NO: 27709 - protein, 80 aa, Bacillus cereus m1293
MKNKKEEKASFPSKPNKPTPNGEVKPSADVKPMQQPSTHNEVRLPATGGVGNEFTVLFVLGISFIIAGAYVLRMKNRKEM

SEQ ID NO: 27710 - protein, 165 aa, Bacillus cereus m1293
MKALMKKLLASATAFTLLTVGYSSAAFAAKSPNDTKNCGHFKNQQEAQAFWNQNGYGVGNDPHRLDNDKDGIPCEDYTYQTSTSTTTDNKGTNPQEQTKQENTQQNNQVTNNKQQTEQTAVKAETKKQGEKLPNTASNGVTMMLASAALVLVGSIIVFRRKKTNA

SEQ ID NO: 27711 - protein, 49 aa, Bacillus cereus m1293
MENPDKEKGQGTSHAQQLPATGHDMNYLPFIGFALVLLGIRLRFMIKNN

SEQ ID NO: 27712 - protein, 163 aa, Bacillus cereus m1550; identical to SEQ ID NO: 26509

SEQ ID NO: 27713 - protein, 72 aa, Bacillus cereus m1550
MDQEPKGNNQVVENERRKADTLNKQHTNKPEEGKKFLPSTGGEASTSTLLSGLTLVLSALSMFVFRKRLFKK

SEQ ID NO: 27714 - protein, 949 aa, Bacillus cereus m1550
MALSLGALQTHAAAEEKVPYNVLKTKPVGIEKSVDEVGHISKVDETLSFQERLKVGDFSQRPASIKKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDMQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHAPKSLTEVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSVEVNPVHVYEREGSYKVSLRVKDDKGKESRSETTVTIKDGSLTESEPNNRPEEANRIGLNSTIKGNLIGGDHTDVYTFNVASAKDIDISVLNEYGIGMTWVLHHESDMQNYAAYGQANGNHIEAKFNAKPGKYYLYVYKYDNGDGTYSLSVK

SEQ ID NO: 27715 - protein, 176 aa, Bacillus cereus m1550
MYKKLGTIALTGALAFSLAACGETEVKEVSKNDAPKQAEKKDKKEKAESKIYKIGDTVEVNGLQLTFSSAKFVEPNEYVKAEKGKVLEIAFNAKNNGKKDIYFGTSELKIADTNGNQFKEYFGGENTFINENIASGNQITNKMLFDVPEGDKFVGTFKPTFTFDEKSVKFEFEVAK

SEQ ID NO: 27716 - protein, 333 aa, Bacillus cereus m1550
MKGKLLKGVLSLGVGLGALYSGTSAQAEVSTNQNDTLKVMTHNVYMLSTNLYPNWGQTERVDLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFIHVIGTHLQAEDSMCGKTSPASVRTNQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 27717 - protein, 179 aa, Bacillus cereus m1550
MNKKLLASLLCSTFLFGVSACSSHDAPAKNEQATSKKTENDKLSSKDPQKELPTNVDSSDVYMSMGSAESLDVLGTGEVKAQGVFKVLDIAVYNRKEEPITLDINNFKLIDGFGREYHISNEYQSVLKAANISTFKFNIVNPNESSEGNIVFDVPKNTQGLTLKINNDKLDKELQLKVE

SEQ ID NO: 27718 - protein, 183 aa, Bacillus cereus m1550; identical to SEQ ID NO: 26524

SEQ ID NO: 27719 - protein, 336 aa, Bacillus cereus m1550; identical to SEQ ID NO: 27010

SEQ ID NO: 27720 - protein, 503 aa, Bacillus cereus m1550
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIIEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 27721 - protein, 310 aa, Bacillus cereus m1550
MSKENQFNSHEILHGTALDPSSIGPTLPPTPTFTIPTGPTGITGPTGVTGPTGSTGPTGLTGPTGLTGFTGPTGDTGPTGNTGPTGVTGLTGVTGPTGNTGNTGPTGVTGPTGITGLTGDTGPTGNTGPTGVTGPTGSTGPTGITGLTGDTGPTGDTGPTGNTGPTGPTGPTGPTFNINFRAEKNVAQSFTPPADIQVSYGNIIFNNGGGYSSVTNTFTAPINGIYLFSASIGFNPTLGTTSTLRITIRKNLVSVASQTGTITTGGTPQLEITTIIDLLAGQTIDIQFSAAENGTLTVGSSNFFSGALLP

SEQ ID NO: 27722 - protein, 969 aa, Bacillus cereus m1550
MEYIIGGNIMNKNLKFTQMMIGISTVALSFGSIQTQVSAEEKVPYNILQIKPIGTETSKDEIVHVTKTDETLTFEERLKVGDFSQRPTLVMKRDEIQLKQSYSLAELNKMPDNELIDTLSKISWNQITDLFQFNQDTKAFYQNKERMNVIINELGQRGKSFTKEDSKGIETFVEVLRSAFYVGYYNNELSYLKERSFHDKCLPALKAIARNPNFALGTAEQDRVIAAYGKLISNASSDTETVQYAVNILKHYNDNLSTYVSNYAKGQAVYEIVKGIDYDIQSYLQDTNKKPNETMWYGKIDNFINEVSRIALVGNITNENSWLINNGIYYAGRLGKFHSNPNKGLEVITQAMNLYPRLSGAYFVAVEQMKTNYGGKDYSGNAVDLQKIREEGKQQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSNPASRYTAKQTLFSKYGSWDFYKYSFALQSYLYNHQFETFDKLQDLIRTNDVKNYDSYRESLSNNTQLNAEYQAYMQQLIDNQDKYNVPQVTNDYLIQHAPKPLAEVKNEIVDVANIKSAKITKYESQFFNTFTVEGKYIGGTSKGESEDWKAMSKQVNQTLEQLSQKGWSGYKTVTAYFVNYRVNAANQFEYDIVFHGVATEEKEKTTTIVNMNGPYSGIVNEEIQFHSDGTKSENGKVISYLWNFGDGTTSTEANPTHVYGEKGTYTVELTVKDSRGKESKEQTKITVKQDPQTGESLEEEKVLPFNKLVKGNLITPDQTDVYTFNVTDPKEVEISVVNEQNIGMTWVLYHESDMQNYVACGEDEGNTIKGKFVAKPGKYYLNVYKFDDKNGEYSLLVK

SEQ ID NO: 27723 - protein, 893 aa, Bacillus cereus m1550
MGNKKEIAIVALTTGFVLTSVTLYGVGHAEEPGQMQVEIQEDSFRTGNLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKAVIFVDQNHGEASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGKKVVSVVHAWDSGGANDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDRMFDIFYYANTDELNMTSNFSELKLACLKVATNKYGANSIEVQAVQNAFDAAKITGTVKENEKTAENQAPELTVPFTITLRVGDTFDPMRNVKAVDKEEGDLTNKVKHKGDVDTSKPGTYIVEYLVVDSQGRNTTARQTVIVEGNGETSDLEPKLTVPVGATIHVGDSFVPMAEVLAIDKEDGDLTSKIKVDGEVDTTKAGTYVLTYTVTDSKGHEVTAKQTVTVKVREEVKNDKPILKVPATTSITEGDQFDPLVGVSATDKEDGDLISKVAYEGTIDTTKAGTYEIIYSVRDSVGNEVNAIQKVLVKDKETSKANGLANKENKSNISNNSNSDKKEYTYKELPKTGVSTTNSAAIGILMIITGTVLTFVRKFRKIQK

SEQ ID NO: 27724 - protein, 563 aa, Bacillus cereus m1550
MIEVVKGIREMKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGAVFSLFKKDGTEVKKELATDANGHIRVQGLEYGEYYFQETKAPKGYVIDPTKREFFVKNSGTINEDGTITSGTVVKIEVKNYEEPTIDKKINGKLEALPINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDSANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 27725 - protein, 455 aa, Bacillus cereus m1550
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQAQKVTANSVELTWNASTDNVGVKGYQIFRNGEMIDTVLGTHFIDKKLQPSTEYSYTVKAIDAAGNVSKESAALTVKTTVETPDTEAPTQPKGLHSMGTTASSVDLMWSPSDDNIGVDHYDIYRETEGAMKKIATSNTTSYLDKNLLANTTYKYVVKAVDVAGNESVQSDIFTITTKTENASYEAWDAKKAYKKGDRVLHEGKVYEAVQSYQGNGDPNWIYALSLWKTV

SEQ ID NO: 27726 - protein, 878 aa, Bacillus cereus m1550
MVKYSKISKWILGVGLVTITCNGLQIQAETKEKNVKNVLQMEPVGIQKSVDELAHPSKVQENESFTKRLKLSDLSQRPLAPTDNIKPLAEEKKYSMAELNQLNNKQLTDLLVTIKWYQIPELFQFNSDSLKFYQDDSRMQAIINKLAEQGQAYTQDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDVTSDITNEAKLKDVKVTKNTSQFFNTFTLQGTYTGSAAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 27727 - protein, 835 aa, Bacillus cereus m1550
MRDQDKCSKFQAPIPFPASGITGPTGPTGPTGSLGGPTGPQGIQGVQGPIGPTGPTGIQGVQGVQGEIGPTGPTGLTGPRGAQGNQGPMGERGSQGIQGVQGIQGERGPTGPTGIQGIQGIPGPIGPTGPTGIQGIQGMQGEIGPTGPTGVQGIQGVQGEIGPTGPTGNTGIQGVQGNLGGSGLQGVTGIQGIQGPIGPTGPTGSQGIQGEQGPMGPQGETGVQGLQGPQGEMGQVGPTGIQGIQGVQGVIGPTGPTGLQGDPGPTGPTGATGITGPTGSATGPTGATGPTGPPGGPTGPTGPAGSPGGPTGPTGATGATGATGATGATGIQGVQGIQGPTGATGVTGLQGVQGSMGATGPTGDQGIQGPQGIQGVTGPTGPQGLQGIQGPAGATGPTGPQGVQGAQGPIGPTGPQGLQGIQGEQGVRGATGPTGLQGLQGIQGPSGPTGPQGVQGVQGPSGITGPTGPQGIQGIQGPQGSIGPTGPQGIQGVQGPQGSTGPTGATGPQGIQGIQGPQGVTGPQGIQGIQGIQGVIGPTGPTGPQGIQGITGSTGPTGATGATGPTGATGPQGPQGIQGPQGETGPTGATGPTGATGPQGPQGIQGPQGVTGQVGATGPTGATGPQGIQGIQGPQGVTGATGATGATGVTGATGPTGIQGIQGITGATGVTGITGPTGATGPTGLTGATGSSAISTGGGYFFSTSTSTIAANANIPINSGSTVYGTGVSLTSATTVTVTTPGIYLVSYYFQGDANGGNETVSVRLLLNGTQLTGSFIQNVTTSTVVIEPAISNTLLVNVTSANSTLILQNGPLGVGHVTTIAGAITASLNVVRIL

SEQ ID NO: 27728 - protein, 73 aa, Bacillus cereus m1550
MRLTLNGTQVAGSFIFYVTGGTFILEPAVSNTMVIEVTSSNATLSLQNGPLAIGHVTTLSGVITASLNVLKIV

SEQ ID NO: 27729 - protein, 666 aa, Bacillus cereus m1550
MALPLPFIGATGPTGNSGPIGPTGGHEGPVGPTGVTGPTGATGPQGPQGIRGIQGPQGTTGAQGIQGAIGDTGEQGITGPTGLQGAQGLIGNQGLIGDIGVQGLEGIQGATGPAGSQGIQGTQGIQGEIGERGQTGAQGMQGERGITGVSGVTGPQGPQGVQGIQGEQGAIGIQGEDGFQGIQGITGEEGPQGAQGIQGEVGPTGSTGMQGAQGISGIKGITGAIGLQGPQGVQGIQGITGATGFQGIKGIRGITGATGSIGIQGSEGPPGGPTGTTGPIGPSSGVTGPAGPPGPPGGPTGPTGATGSTGVSGGIGPIGAQGVQGITGPTGAEGSRGIQGPLGVIGPTGAEGPKGIQGIQGVIGPTGAQGMVGIQGVAGPAGVTGAEGAQGAQGIRGVTGPAGSQGIPGVQGIQGETGAAGIQGPQGVQGIQGTTGLTGTQGAQGPQGVQGIIGPTGAIGLQGSQGLQGITGPTGAQGVQGIQGVQGIIGPTGAQGIRGPQGSAGEVGITGPQGVQGAQGSQGPQGPQGNVGITGATGETGATGATGATGPQGVQGVQGITGIQGITGTTGNTGATGPQGIQGIQGIQGLQGPIGASGVTGASGSIGPVGAQGSQGPSGVVGPTGATGSAGSIGFLGIAGATGATGLPRGGVISFLLQRVQLQRMR

SEQ ID NO: 27730 - protein, 380 aa, Bacillus cereus m1550
MHMKEKRYKNMKTKQTIAASTLALAMIAGANPAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQNVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNSTKNNNAKELPNAGSEQSNNMALGMLSVLGGILLITRNKIKTLFSK

SEQ ID NO: 27731 - protein, 939 aa, Bacillus cereus m1550
MTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSESGEVKDQLSVGEKFRIQIPKNTKTGEFNLSVAANLTKVQAIAYRGTDTVQNATVLLERNEEKLSSDLAVNWEAAGSLKIKKVGENEEVLAGAVFEVFNANNESVGKITTGADGMAELNNLPIGTYTLKEIKAPTGYVSDDKPQTIEVKTGETGAVQIVNNKVKGSIEIKKLSDSGKILPNVEFTVFTEDGKEVKKVVTKENGIANVEGLTYGKYYFLETKTPNGYIGNKTKYPFEIKEHNKTLTFTVENTEVKGSVKLLKVDNEDISKKLEGAVFELKDESGKVVGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGSKELDASKSVTIQDKVEYKDLIAGKEYVVKGKLMDKATNKPLLVEGKEVTVESKFIAKEKNGSITLDFTFNASALQGKEVVVFEELYQDNILVAIHAEIEDKGQTVKFKEVKPEQPKPEQPNSDKNTPTPEQPNEQVKEQPQPKKEIQSKIGWLPQTGTNLTSWFSMAAGALLLIVGGVIFLKRKNA

SEQ ID NO: 27732 - protein, 971 aa, Bacillus cereus m1550
MKGYSKKMLVGVSFASLMLGSFQGGSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKTGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNASGQFEYDVVFHGINTEEGAENKAPVAVINGPYSGNVNEAISFTSNGSKDEDGKIISYKWEFGDGAVSNEQNPTHVYTKEGTYTAKLTVTDDKGATNTATATVAVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 27733 - protein, 43 aa, Bacillus cereus m1550
MIVALNDVVATAGELIVPASGAPLIVIRELTNNEAVILIEYEI

SEQ ID NO: 27734 - protein, 1306 aa, Bacillus cereus m1550
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGPQGVQGLQGPIGPTGATGAQGIQGIQGLQGPIGATGPEGPQGIQGVQGLPGATGPQGIQGAQGIQGTQGPSGNTGATGATGATGQGITGPTGITGPTGITGPSGGPPGPTGPTGATGPGGGPSGSTGATGATGNTGATGSTGVTGATGSTGPTGSTGAQGLQGIQGIQGPIGPTGPEGSQGIQGIPGPTGVTGEQGIQGVQGIQGATGATGDQGPQGIQGGIGPQGVTGATGDQGPQGIQGVPGPSGETGPQGVQGIQGPMGDIGPTGPEGPEGLQGPQGIQGVPGPVGATGPEGPQGIQGIQGPVGATGPQGPQGIQGIQGVQGITGATGVQGATGIQGIQGEIGATGPEGPQGVQGAQGAIGPTGPMGPQGVQGVQGIQGATGAQGVQGPQGIQGIQGIQGPTGATGDTGATGATGEGTTGPTGVTGPTGVTGPSGGPAGPTGPTGPSGPAGVTGPSGGPPGPTGATGATGVTGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGPQGPTGIQGIQGEIGPTGPEGPEGLQGPQGIQGVPGPVGATGPEGPQGIQGIQGPVGATGPQGPQGIQGIQGVQGITGATGAQGATGIQGIQGEIGATGPEGPQGVQGIQGAIGPTGPMGAQGVQGIQGIQGATGAQGVQGPQGIQGVQGPTGATGETGSTGATGEGSTGPTGVTGPTGVTGPSGGPAGPTGPTGPSGPAGVTGPSGGPPGPTGATGATGVTGDTGATGSTGVTGATGATGVTGLQGPQGIQGVQGEIGPTGPQGIQGPQGIQGVTGATGAQGPQGIQGPQGDIGPTGPQGIQGPQGPQGIQGTTGATGAQGPQGIQGPQGDIGPTGPQGPQGIQGPQGIQGPTGATGATGATGPQGIQGPQGIQGPQGIQGPTGVTGATGATGPQGIQGPQGIQGPQGIQGPTGATGATGATGPQGIQGSQGIQGPTGATGATGSQGPTGDTGPTGAGATGATGATGVSTTATYAFANNTSGTAISVLLGGTNVPLPNNQNIGPGITVSGGNTVFTVANAGNYYIAYTINLTAGLLVSSRITVNGSPLAGTINAPTVATGSFSATIIANLPAGAAVSLQLFGVVAVATLSTATPGATLTIIRLS

SEQ ID NO: 27735 - protein, 1522 aa, Bacillus cereus m1550
MEAKKTVNNETPKLGEEVEYRISFKNTVENGKLAEVTIKDDLPNGLEYVKDSLRAEGSKPDPVELKVKDGKVIAKYPEIMDTEERSIVFKAKVKEEFKVGEGIVNKVVVDDTKDPTTSEVTITPEYKDGKLKAEKFVNNKKPKLGEEVEYRISFKNTVENGKLVEVTVEDEIPAGLEYVENSLQAEGSKPSPVELKFENGKVMAKYLEIADTKERSIIFKVKVKEEAEIGKEIVNKAIVVDTKNEPEEPRVEITPQYKDGKIAAQKVANNHKPKLGEEVEYRISFKNTVENGKLVEVNIKDTLPNGLEYVEGSITAEGSKPKPVELQVKNNKVMAKYPEITDTEERSIVFKAKVKESTKVGEEIVNEAIVDDTKNLPEEPYVPITPQYKDGKIEARKEVSNHEPKLGEEIEYRIIFNNTVKDGKLAEVKIEDEIPAGLEFVEGSEKAEGEEPKPVELKVENGKVMAKYSEIMDTKERSIVFKVKVKDSVAIGKDITNKAIIHVDDPNHPVIDPTAKITPQYKDGKIATHKKVNNHKPKLGEEIEYRISFNNTVKDGKLAEVKIEDEIPSGLEYVKDSLKAEGDKPAPVELKEEAGKVSAKYENITDMKERSIIFKVKVKDSVEVDKAIVNKAIVDDTKNPPERPEVEITPQHKDGKVKADKKVNKKEPKLGEEVEYRISFKNTVENGKLAEVKIEDQLPTGLEYVKDSLKSEGNEPAPVELKEEAGKITAKYENITDTAERSIIFKVKVTEVAKVGKKIVNTAIVDDDNPKNPPQKPEAIITPEYKDGKLKAEKTVNNPAPKLGEEVEYRITFRNVVEHGKVAKVKIKDELPTGLEFVEGSERAEGENPKPLYVKVKNGIVLAEYPEITDMKERSIVFKVKVKEKAKVGEEIVNKAIVEDTINPPEQPNISIQPQYKDGALQAEKTVSNHEPKLGEEVEYRISFENTVENGKLTEVKVEDEIPAGLEYVQDSIKSDGPEPYPVELKVENGKVTAKYPEITDTKKRSIIFKVRVQETVQVGKEIVNKAIVDDNNPTTPPVESLIPITPQYKDGKLEARKEVSNHEPKLGEEIEYRITFNGTVDGGKLVDVKIEDEIPSGLEYVKDSLEAVGDKPVPTELKVENGKVTVKYPEITDTKERSVIFKVKVKETAKVGGEITNKAIIEVDDPKHPVIEPTAKIKSEYKDGKLTAAKTVSNKEPKLGEEVEYRISFKNTVENGKLDVVTIEDEIPAGLEYVQDSLRFEGAEPNPVELKMEFGKVIAKYLDIADMKERSIIFKAKVKEAPSKGITNRAVVDDGINPPLEPTVTILPKTKEDFKIPEEPEVKPEDPKEPEVKPEDPKEPEVKPEDPKEPEVKPEDPKEPEVKPEDPKEPEVKPEDPKEPKEPEVKPEDPKEPKEPEVKPEDPKEPKEPEVKPEEPKEPKEPEVKPEDPKEPKEPKEPEVKPEDPKEPKEPEVKPEDPKEPKEPEVKPEVRLEKLIKEPQVKTERELPKTGAASPWMMSVGAGISFLVGGVLFVLGRRRKQ

SEQ ID NO: 27736 - protein, 431 aa, Bacillus cereus m1550; identical to SEQ ID NO: 26534

SEQ ID NO: 27737 - protein, 965 aa, Bacillus cereus MC67
MNKKLKINKVMLSISTMALSLGVIQTNVLAEEKVPYNVLHSKPVGIEKPVDEIGHASKAEETLSFQERLKVGDFSQRPASIMKSSKVKQVKESYSMADLNKMSHQELIETLGSIKWNQITDLFQFNEDAKVFYKDNGKMQVIIDELAHRGSTFTKDDSKGIQTFTEVLRSAFYLAFYNNELSALNERSFQDKCLPALKAIAKNPNFKLGTNEQDTVVSAYGKLISNASSDVETVQYASNILKQYNDNFNAYVDDRMKGQAVYDMMQGIDYDIQSYLIEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDTYRETLSKDPKLNKEYQAYMQQLIDNQDKYNVPEVADDYLTEHAPKSLTEVKKEISETLSMKDTKMTKYESQFFNTFTLEGTFTGSVTKGESEDWNAMSKRVNEALEQLPQKEWSGYKTVTAYFVNYRVNSSNQFEYDVVFHGIAKDDGENKAPTVNINGPYNGLVKEGIQFKSDGSNDEDGKIVSYSWEFGDGRTSTEVNPVHAYEREGTYKVALRVKDDKGKESRSETNVTIKDGSLTESEPNNRPEEANRIGLNTTIKGSLISGDHTDVYTFNVASAKDIDISVLNEHGIGMTWVLHHESDMQNYAAYGQANGNHIEAKFNAKPGKYYLYVYKYDNGDGTYALSVK

SEQ ID NO: 27738 - protein, 47 aa, Bacillus cereus MC67
MIQLGDHKLTVTNIEKSQGGEFDKPKDGHEFLIAKVTIENGGKEEIS

SEQ ID NO: 27739 - protein, 1072 aa, Bacillus cereus MC67
MERIEKERMIYMQKRNNFMFQKPMKVLATSAILTTTLFSPIMTNGLTVHAETIAAQTTNQYEQREFELPGTGSFSSEAKRERRSEQKTYMPTGIYVKPNEQITIEVSGTQKVRAIIGTHQYDKQWGKEVNLSPGSNTISSPNGGLLGFDNSQDTGAVKVKVTQGGSPVPFFELGKHTKEDWITMMKMYPDAHAVQLKSEKAVLTVTRDSAQKYIVDQDPVPLLEKYDEMIRAQDKISGLSETDPNPLHRSTRRIWAFVENPNKPDWGMYASLDGAVFTTAGNAIESALDVNKFGWGQMHEAGHARQQSPWTWSDFRGMGEVTVNLYSLAAQKRLFPDQPTRLEKNKDYEKAFTYLKQTDKDYKNIDDLFVKLVMIWQLQLAYGEDFYPNLHKLYRELPEDLLPKTDEEKIQAFIYNTSKVAKQNSLPFFDQWGLKASQETRQKIEALNYPILTAPIWQATDSKPVIVEKNGETPDMEPKLTVPVGATMNVSDQFDPMSGVSATDKEDGDITDKVTVDGKVDTSKPGTYELTYTAKDSKGHKVTAKQTVTVKEKEETKDEAPVLKVPSETTITEGDKFYPMKDVSATDKEDGDITSEVKYEGNVDTNTPGTYTITYTVKDSAGHLATQTQTITVKEKPAEDKEPELTVPEETVLTVGDQFDPMSGVKAIDKEDGDITSKVTYSGDQGTDKEGTYKIKYVVEDSKGHRVIKLRTVIVKAAEKPSEDQAPVLKVLFTTTLHVGDTFDPMSGVSATDKEDGNLTSKVKYKGNVDTTKPGKYIIEYSVVDSKGVNAIATQTVIVEESGETPDMEPKLTVPVGATMNVGEQFDRMAGVSATDKEDGDLTSKVTVEGKVDTTKPGTYVLTYTVKDSAGHLATQTQTVTVKEKEKPVEDQEPGLTVPAEVNMNVGDKFDPMSGVKAIDKEDGDITDKVIQFAEVDTSKTGTYEVKFLVRDSGGNEVTTIQKVVVKDKDNGTGSDNGSNGSGNNNDSDNGNNNTNNGNSPDNGSTGTNNSNGSDTGNSNISINSTSDKKEDTYKELPKTGASTNNSAALGILMVLAGMVITFGRKFKKVLK

SEQ ID NO: 27740 - protein, 100 aa, Bacillus cereus MC67
MDPKDPSIDPKDPSIDPKDPSIDPKDPSVDPKDPSVDPKDPSTDPKDPSTDSKVPPTKENNKTSVWLPKTGGTSMEMISYIVGMLLMALGGFVFVRQRMR

SEQ ID NO: 27741 - protein, 954 aa, Bacillus cereus MC67
MGNSTTKSKKLVGFVATATLATSMIAGVGNASAQTTDTLRVSEPVHEKAKDKKEERPESLFPYIDVNYETTIYVGDPFDPMAEVSAYDSKDGDITDKINIAGEVNPFEPGGYNLDYTVTNSRGFSVIKQVHVWVKRGEKPTLRLPYRVSINVGDKFDPMAGVSAIDEKDGDITSKIKVDGNVDTSKPGTYEVTYTVTNSKGLTIVRKQPVKVKETEGTKNEAPVLTVPFSTTLHVGEEFDPMAGVSATDKEDGNLTNKVKFKGNVDTSKPGKYIVEYWVVDSKGVNATATRSVIVKENEEIPDMEPKLTAPTKTTINVGDKFDPMAGVKAIDNEDGDITSKVTVDGNVDTSKPGTYELTYTVLDSKGHKVTTKQTVTVKQTVETKNEAPVLTVPVELILHVGDTFNPMQGVKAIDKEDGDITSKVICTGADEVDTSKPGKYILVYGVTDSQGENTIAVSNVYVMEKEETPDMEPKLAVPVGATINVGDKFDPMAGVSATDKEDGDITSKVTVDGSVDASKPGTYDLTYTVSDSKGHTVTAKQTVTVKQRVEPKDEVPVLTAPTQATINVGDKFNPLSGVKAIDKEDGDITSKVTVDGNVDTSRAGTYELTYTVLDSKEHKVTSKQTVTVKQKVETKNEAPVLTVPFTTTLRVGEKFDPMAGVSATDKEDGNLTNIIRYEGNVDTSKTGKYIVEYWVVDSKGVNATATQTVIVKENEKTPDMEPKLTVPTETTINVGDKFNPLSGVKAIDNEDGDITNKVIVDGSVDASKPGTYELTYKVTDSKGHTVTAKQTVTVKQTVVPKDEVPVLTVPTEVTIHVGDKYNPLSGVKAIDKEDGDITDKVIHMGEVDTSKAGNFEVKFLVRDTSGNEVTATQKVIVKDKGTENGSDNSYNNTNTGNVSDNNNTSSTLDNKKDTIKELPKTGASSNNGTTVGILAILAGMLITFGRKFKKAIK

SEQ ID NO: 27742 - protein, 130 aa, Bacillus cereus MC67
MYNESLYYPYINNNQYFDRQLPDLQIPGLPGTSGFLGGPGFPGEQSSQAPTSPPPSFIPQQSTASPFAVDPGAISFCLFRNTYIWPTNGEQFWYYPIFVGPRSVTGFRWNGRFWMIFGIDTRRISSFTCF

SEQ ID NO: 27743 - protein, 175 aa, Bacillus cereus MC67
MYKKMGTLVITGALAISLAGCSDTEETAKKVSNDTKTEQTTEKKEEKKKFKVGETIKLGNHKLTVTNVEKSPGGEFDKPKEGHEFLIANVTIENGGEEEIHYNAHDFSLQNSEGNIVDPTLTMINQDTQLNFGKLAQNGKITGTIAFESKQGDPKLQLIFKPISLSEEEVRVNLQ

SEQ ID NO: 27744 - protein, 878 aa, Bacillus cereus MC67
MVKYSRISKLIVGVGLVTISCSGLQIQAETKEKNVKNVLQMEPVGLRKSVDELAHPSNVQENGSFTKRLKLADLSQRPPMPNENAKQLVEEKKYSMAELNQLSNKQLTDLLVTIQWYQIPELFQFNNDSLKFYQDDSRMQAIIAKLAEQGQAYTKDDSKGIETLVEVLRSGFYLGFYHQELSKLSERVYHDKCLPALKTIAKNPNFKLGTTEQNKVISSYGMLIGGASADVEVIQYAGEIFKQYNDNLSTFIEDRTKGDAVYNLMKEVDYEVQSYMNATGKEPKDMLWYGKIDGFINEINRFALIGTVTDKNGWLINNGIYYASRFGKFYSTPTKGQQVVTEAMGIYPYLGQQYFVAAEQIATNYGGIDANGKTVNLDQIREDGKKHYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPQQSIYSLEELFRHEFTHYLQGRYEVPGLWGQGEMYQNERLTWFEEGNAEFFAGSTRLDSVVPRKSIIGGLSNDPAKRYTAAQTLNAKYGTWDFYNYSFALQSYMYNNRPDMFDKVHDLIRTNDVSGYDAYRSTLSKDNKLNEEYQTYMQMLIDNRDKYTIPQVSDDYVAQHNPKPLSDVAADVTNEAKLKNVKVTKNKSQFFNTFTLQGTYTGSAAKGENEDWKVMNQATNDMLKHLAEKEWSGYKTLTAYFVNYRVNAAGQFEYDVVFSGVNTEEGTAVEKEPNNSFDAANPLSLNALLRGNLSDQDQVDRFVIDVKDPKDLQITVTNEQNLGLNWVLYSESDLNNYVTYATKHDGNKLLGNYNAKPGKYYLSVYKYGGGTGNYTVEVK

SEQ ID NO: 27745 - protein, 162 aa, Bacillus cereus MC67
MLKKVSRIVLICGMAFSLSACTETKNSDESKQEDVQDKVYKIGETVDVDGLQVTLDSVQLGYPDYTTDKKKDDILGIVFTVKNNSKKDILFAFYEFEITDKKGAKFKEYQYDSFTSKKVAPDGKIQDVMLFDVTKENTYIATYRPEFTHENRTIKFELKPNK

SEQ ID NO: 27746 - protein, 1093 aa, Bacillus cereus MC67
MGKRVVKRIFALLSVLALFFNVFLPNASAEVMTHEKYSMNWSYSNSLGKDIRTEIIKNSSGQIAYCLTLGLKSPNGEDLPEMGKTDNVVYRVLLNGYPQKSAEQLGVENKNEAHYATQLAVWNALGQLDVNELKHMNKNVEKAAKAIIDGANRSEDTQDIFMNVIPAEKQKAELKGEFFETNLYTVQTNAKSGSYKVLSKNAPSGVKIVSENGEVKDQLSVGEKFRIQIPKNTTTGEFNLSVAANLTKVQAIAYRGTDTVQNATVLLERNEEKLSSDLAVNWEANGSLKIKKVGENGEVLAGAVFEVFNTNNESVGNITTGADGIAELNNLPIGTYTVKEIKAPTGYVSGDKPQTIEVKTGETGAVQVVNNKVKGNIEIKKLSDSGKVLPNVEFTVFTEDGKEVKKVVTKENGIANVDGLTYGKYYFLETKTPNGYIGNKTKYPFEIKEHNKTLTFTVENTEVKGSVKLLKVDNEDISKKLEGAVFELKDESGKVIGEYKTDKNGEVNVKDLAYGKYSFVEKTSPNGYVLVKEPIVFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTLKGKLMDKETNKPLVVNGKEVTAETKFTPKEANGSITLDFTFDATGLEEKEVVVFEELLKDGKVVTTHADINDKGQTVKFVKPSVKTTATNKADGGKEIHANDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTASNKADGSKELDATKSVTIQDKVEYKDLIVGKEYVVKGKLMDKATNKPLLVDGKEVTAESKFTAKEKNGSITLDFTFNASALQGKEVVVFEELYQDNVLVAIHVDIEDKGQTVKFKEAKPEQPKPEQPNPDKNTPTSEQPKEQVKEQPQPKKEIQSKIGWLPQTGTNLTSWISMAAGALLLIVGGVIFLKRKNA

SEQ ID NO: 27747 - protein, 182 aa, Bacillus cereus MC67
MNKKLLTTLLCSTFLFGLSACSSHDTSSSNTKNEQETSKETKNDELSNKDPQKELPTHEDSSGVYISIGSVDSLDVIGNGEVKAQGVFKVLDVRVHNGHEEPITLNSNNFKLIDGTGREYHISNEFQLVLKAANTATFKFGVLNPSENLEGNIVFDVPKKTQGLTLKINGDMLDKGIELKVE

SEQ ID NO: 27748 - protein, 769 aa, Bacillus cereus MC67
MKKLKPILGAVSSLTMALTITSPALAETKPEQGGKVETFQEDTNLKEGQNIIYGDSGKKGIMIMEEPQENNDWDDDGIPNDVEEKGFKIVFNEKTGKNEAQLYDLVKDFGKKRFITNPKSANSDGDPFTDSYEVEHYDSDSDTDFNPMIANVPNLQIAVKRIDITPVTSITDSNGESRTKSWEKSLSVQHSFNVGLAVEGGAEGSAVGPVPSGKGSLNVGYGYSNTKTETESISNSFDWSTATTVDSAKAANVRFHLEYKNTGTASAGDVSPHFNIRLGNKIINTVKATQDRYKANLLTTAKGGNNKTEILMDSIEGQADVKISLTLDELKAVEQGAPLSIEVLPTSTMNVYTMKDGKFENLGDWSHFASNVNASTTLVETNLGSIPKFRVYTPRTNKTKPASVDYNLSLDEFFENSGIGKGAWVAKHIVNGQPKENLVRYGPNRSLLERGVNLGFFDQRALQPTLSYSSYDYSKKKIYASVIPGIFNLNKEIFVTVRNKKGESQKVTLVRNQNSNVYESKENEPVDIAVNRASLGESHAKFELIDVKDNKTEVFTPLVSNKNYLDAIDKIVVDNSGEPIVEGKQYYLKSATNFANGVNESWSAGTLSQSINGRYVHFSLKGNNWDGLRLGPIQQAIHGPDVQATPVILERKGKSRPEELFKKDEEVFMKFTNSSHSNYQYLNIGNGYDYSWLDTDHNRSAIKLEKLTNQKNFYIKSDSNYITSRENQWTSSVADNGIAPLVGAGERVLKSEHTTSPGNYHQWELESIK

SEQ ID NO: 27749 - protein, 878 aa, Bacillus cereus MC67
MVKYSKISKLILGVGLVTISCNGLQIQAETKEKNVKNVLQMEPVGIQKSVDELAHSSKVQENASFTKRLKLSDLSQRPLAPNEDVKPLAEEKKYSMAELNQLSNKQLTDLLVTINWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVISSYGKLIGNASADVETVLYAGEIFKQYNDNIATFIEDRTKGDAIYELMKGIDFDIQTDMYTTGKEPKDTMWYRNIDNFINEVSRFALIGTVSDKNGWLINNGIYYAGRLGKLHSTPTKGQQVVTDAMRIYPFLGEQYFVAAEQITTNYGGLDANGKTVNLDQIREEGKKKYLPKTYTFDDGAIVFKAGDKVSEEKIKRLYWAAKEVRSQFYRTVGSDKPLESGHVDDVLTMVIYNSPDEYQFNRQLYGYETNNGGMYIEGTGTFFTYERTPQQSIYSLEELFRHEFTHYLQGRYEVQGLWGQGEMYQNERLTWFEEGNAEFFAGSTRLDSVVPRKSIIGGLSYDPAKRYTAAQTLNAKYGTFDFYNYSFALQSYMYNNRPEMFDKVHDLIRANDVSSYDAYRSTLSKDNKLNEEYQSYMQMLIDNRDKYTIPQVSDEYLTQHDPKSLSDVTSDITNESKLKDVKVTKNKSQFFNTFTLQGTYTGSAAKGEIEDWKVMNQATNDMLKRLSGKAWTGYKTLTAYFVNYRVNNAGQFEYDVVFSGLNTEEGTAVEKEPNNSFDTANPLSLNILLRGNLSDQDQGDKFVIDVKDQKDLQISVTNEQNLGLNWVLYSESDLNNYVTYATKRDGNKLLGNYNAKPGKYYLSVYKYGGGTGNYTVQVK

SEQ ID NO: 27750 - protein, 503 aa, Bacillus cereus MC67
MLNKKMVAMAMTVPLVMGTISTVSALEKQQQVKLEAYSPQKKAIEYLKGHATEYGLKADLSDLQYISTTETSVASYVRLQQVVNGAPVFSKQITVTLNGEGKGLLAVSDYQPVTGVKEVTKKISEKDAEQKSMAYVGGESEQNLWAPTEKEFGYIVEEGVALPVYKVVVHSNNPFGAWETFIDAENGKLIKKVDINRKAEGTGKVFLPNPVVSSGSKTGLKDSNDADSTALTNQLKTVTLKGLDGTGFLIGEYVTISSKAKTKSTNLQFNYTRANDSFEDVMSYYHIDTLQRYIQGLGINNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPRDITNEVHDDGEIWAQGQYEMAQAFGRDVATKIILQSHWSLTPNSKFSDGAKAIKQADALLYGGQHAADIDRIWAARGISTN

SEQ ID NO: 27751 - protein, 431 aa, Bacillus cereus MC67; identical to SEQ ID NO: 27147

SEQ ID NO: 27752 - protein, 333 aa, Bacillus cereus MC67
MKGKLLKGVLSFGIGLGALYSGSSAQAEMSTNQNDTLKVMTHNVYMLSTNLYPNWGQNERADLIGAADYMKNQDVVILNEVFDNSASNRLLGNLKKEYPNQTAVLGRSSGSEWDKTLGNYSSSTPEDGGVAIVSKWPIVEKIQYVFEKGCGPDNLSNKGFVYTKVKKNDRFVHVIGTHLQAEDSMCGKTSPASVRTKQLQEIQEFIKNKNIPNNDYVLIGGDMNVNKINAENNSDSEYASMFKTLHASIPSYTGHTATWEATTNSIAKYNFPDSPAEYLDYIITSKDHANPSYIENKVLQSKSPQWTVTSWLKKYTYNDYSDHYPVEATISMK

SEQ ID NO: 27753 - protein, 131 aa, Bacillus cereus MC67
EKPEVKEKPEILVTPEEEENKEETTKELTEEKPEEPKVTEEPNVLEKPEVKEKPEVSNKQEVQDKVEVQNKQEVQSKQDVQNKSEVPSSKENNKQSKLLPQTGGASTESTSLIAGMFALILGARLFRRKKN

SEQ ID NO: 27754 - protein, 40 aa, Bacillus cereus MM3
MKKEGDKLPNTATHYPASILMGLSTFLIGMLLFIRRKNAK

SEQ ID NO: 27755 - protein, 965 aa, Bacillus cereus MM3
MNKKSKINKVMLSISTMALSLGAIQTNVSAEEKVPYNVLHSKPVGIEKPVDEIGHVSKAEETLSFQERLKVGDFSQRPASIMKSSEVRQMKESYSMADLNKMNNQELVETLGSIKWNQITDLFQFNEDAKAFYKDKGKMQAVIDELAHRGSTFTKDDSKGIQTFTEVLRSAFYLAFYNNELSDLNERSFQDKCLPALKAIATNPNFKLGTYEQDAVVSAYGKLISNASSDVDTVQYASNILKQYNDNLHTYVDDRMKGQAVYDMMQGIDYDMQSYLFETRKEAKDTMWYGKIDGFINEINRIALLNEVTSENKWLVNNGIYFASRLGKFHSNPNKGLEVVTQAMHMYPRLSEPYFVAVEQITTNYNGKDYSGNTVDLETIRKEGKEQYLPKTYTFDDGSIVFKTGDKVSEEKIKRLYWAAKEVKAQYHRVIGNDKALEPGNADDVLTIVIYNTPDEYQLNRQLYGYETNNGGIYIEETGTFFTYERTPEQSIYSLEELFRHEFTHYLQGRFEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDSKLNKEYQEYMQQLIDNQDKYNVPEVADDYLAEHAPKSLTAVEKEISDTLPMKEAKITKHSSQFFNTFTLEGTFTGSVTKGESEDWNEMSKRVNEALEQLAQKEWSGYKTVTAYFVNYRVNSSNEFEYDVVFHGIAKDDGENKAPTVNINGPYNGLVKEGIQFKSDGSNDEDGKIVSYLWEFGDGSTSAEVNPIHAYEGEGIYKVALRVKDDKGKESRNETTVTIKDGSLTELEPNNRPEEANRIGLNTTIKGSLIGGDHTDVYTFNVASTKNIDISVLNEYGIGMTWVLHHESDMQNYAAYGQANGNHIEAEFNAKPGKYYLYVYKYDNGDGTYELSVK

SEQ ID NO: 27756 - protein, 333 aa, Bacillus cereus MM3
MKGKLLKGVLSFGIGLGVLYGGSSAQAETSTNQNNTLKVMTHNVYMLSTNLYPNWGQSERADLIGAADYIKNQDVVILNEVFNNSASDRLLGNLKKEYPNQTAVLGRSNGNEWDKTLGSYSSSTPEDGGVAIVSKWPIVEKIQYVFAKGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKEYTYNDYSDHYPVEATISMK

SEQ ID NO: 27757 - protein, 179 aa, Bacillus cereus MM3
MFKKIATVTLAGTLAFSLSACDEKKEVAKTVSNDTKEEQSSAKKENTKNEDTREYNVEKTTEIRNQKLTVHKVQIAQVAEYDKLEKGNEFVIVHVTVENIGNQKVRINPLDFYLERGDGSIVDHTFSTSNKNIFKIKDVDPNGKLTGAITFEAKKGDSNLELIYRPDVMSKEEVKVELK

SEQ ID NO: 27758 - protein, 503 aa, Bacillus cereus MM3
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQSVKGVKEVTTKISEKDAIQKSMAYVGEASEQNLWAPTEKEFGYIVEEGIARPVYKVVVHSNNPFGAWETFIDAENGKLIKKVDINRKAEGTGKVFLPNPVVSSGSKVGLKDNNDADSTALTNQLKTVTLKGLDGTGFLIGEYVTISSKAKTKSTNLQFNYTRANDSFEDVMSYYHIDTIQRYIQGLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDVTNEVHDDGEIWAQGQYEMAQAFGRDVATKIILQSHWSLTPNSKFSDGAKAIKQADALLYGGQHAADIDRIWAARGISTN

SEQ ID NO: 27759 - protein, 218 aa, Bacillus cereus MM3
MKQLKPVISVLGSVSMALTLASPALADVKQLNPGGTVEIFKENANVKKEDKNFTLGSDGEIGSLITQNIEMANNDWDKDGISNDLEMNGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSV

SEQ ID NO: 27760 - protein, 517 aa, Bacillus cereus MM3
MGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNVATEQLETDIGNIPKFRVYTPKDKSIADKPVLSYNEVFQHVNIDTKKVNHIVNKAKSTNNVSVVSANNGTDALNDLKAGQGDRGYLHKDSVHGAFAKLQQPTLVEGSYDSVTQKIRATILPGLFGVSKEIPTIYSKKWNAPSQTVTLVKRENGFTYESRENIPPIKSEIAAHRKVTFEINDAHNLTPTQKIDTEIKANKEFEDYVVDNSGEFVTEGVPYTVASYGNTAYWGSHHAGNKWEYLWAEKSSDEKVNVIIERVGQPKPGKPIKKDEEVLIKFRNPIYSDYAYLKLQDSYIHLDQKQNASTFKFNHAYPKNFTGYHKQWNILSNGNKLKVGYLIDYMKYGNGENGTDTIAWNLSRVQ

SEQ ID NO: 27761 - protein, 974 aa, Bacillus cereus MM3
MLYFWLEYINGGNVMNKNLKFTQMMIGISTMALSFGSIQTQVSAEETAPYNILQMKPMGTETSKDEIVHATKADETLTFEERLKVGDFSQRPTLVMKRDEIQLKQSYTLAELNKMPNSELIDTLSKISWNQITDLFQFNQDTKAFYQNKERMNVIINELGQRGRTFTKDNSKGLETFVEVLRSAFYVGYYNNELSYLKDRSFHDKCLPALKAIAKNSNFTLGTAEQDRVVAAYGKLIGNASSDTETVQYAINVLKQYNDNLTTYVSDYAKGQAVYEIVKGIDYDIQSYLQDTNKQPNETMWYGKIDNFINEVNKIALMGNITNENSWLINNGIYYAGRLGKFHSNPYKGLEVITQVMSLYPRLSGPYFVAIEQIKTNYGGKDYSGNAVDLQKIREEGKRQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGELYQNERLTWFQEGNAEFFAGSTRTNNVVPRKSMISGLSSDPASRYTAKQTLFSKYGSWDFYKYSFALQSYLYNHQFETFDKLQDLIRANDVKNYDSYRESLSNNTQLNAEYQAYMQQLIDNQDKYNVPQVTNDYLIQHAPKSLAEVKNEIVDVANIKDAKITKYESQFFNTFTVEGKYTGGTSKGESEDWKTMSKQVNRTLEQLSQKGWSGYKTVTAYFVNYRVNAANQFEYDIVFHGVATEEKEKTNTIVNMNGPYSGIVNEEIQFHSDGTESENGKIISYLWNFGDGTTSTEANPTHVYGEKGTYTVELTVKDSRGKESKEQTKVTVKKDPQTGGSLEEEKLLPFNTLVKGNLVTPDQTDVYTFNVTDPKEVDISVVNEQNIGMTWVLYHESDMQNYVACGEDEGNVIKGKFAAKPGKYYLNVYKFDDKNGEYSLLVK

SEQ ID NO: 27762 - protein, 70 aa, Bacillus cereus MM3
MKDKDTSKAKGITNNSNNGNIPNSINSDKKESTYKKLPNTGASETNSTAMGIWMIIVGTVLTLVRKFRKI

SEQ ID NO: 27763 - protein, 563 aa, Bacillus cereus MM3
MIEVVKGIREMKKIFSVLLVFFLTFSTWSSVLVKAASPSKGTLTIHKYEQEKDGAPGLEGDGSANQEVPTNAKPLKGVTFEVKRVASFEKNSNDGKIVKEDVKPVMGATPTQVVTDDNGQAVLKDLPLGRYEVKEVAGPPHVNLNPNTYTVDIPLTNKEGKVLNYDVHMYPKNEIKRGAVDLVKTGANEKALAGAVFSLFKKDGTEVKKELATDGNGHIRVQGLEYGEYYFQETKAPKGYVLDPTKHEFFIKTSGTINEDGTITSGTVVKVEVQNYEEPNIDKKINGNLEALPINPLTNYNYDIKTLIPEDIKEYKKYVVTDTLDNRLMIQGKPVVKIDGAEVNASIVDVAVEGQKVTATVKDFTKLDGKKEFHLQIKSQVKEGVLSGSEILNTAKIDFINKNDVIGEKESKPVVVVPTTGIIELTKIDGADKKKLKGAEFVLKDKNGKIVVVAGREVTGVSDENGVIKWTNIPYGDYQIFETKAPTYTKEDGTTASYQLLKDPIDVKISENNQTVKLSIENNKSGWILPVTGGIGTTLFTVLGLALMATAAFVFFRKKFANN

SEQ ID NO: 27764 - protein, 455 aa, Bacillus cereus MM3
MNNRLLKQLQNMKMNKKSLGAVALTAGIIGTTLIPQNAYAHGFVEKPSSRSALCSPTYGALNANCGSVMYEPQSLEAPKGFPQAGPVDGQIASAGGKFGGVLDQQTADRWFKNTITGGENTFTWKYTAPHLTSKWDYYITKKGWNPNKALTRADFEPIGTVLHDGSAASNHLTHKINVPTDRSGYHVILAVWDVADTANAFYNVIDVNLINDVKPDIEAPSTPNGIQTQKVTANSIELTWNASTDNVGVKGYQIFRNGEMIDTVPGTHFIDKKLQPSTKYSYTVKAIDAAGNVSKESAMLTVKTTVEAPDTEAPTQPKGLHSMGTTASSVDLMWSPSDDNIGVDHYDIYRETEGLMKKIATSNTTSYMDKNLLPNTTYKYVVKAVDLAGNESVQSDIFIITTKAESASYEDWDAKKAYEKGDRVLHEGKVYEAVQSYQGNGDPNWIYALSLWKTV

SEQ ID NO: 27765 - protein, 382 aa, Bacillus cereus MM3
MHMKEKRYKNMKTKQTIAASTLALAMIAGANSAHAEVTDATPQQSTGDRLAELKQHRQELDAKLQQHKENVDQTLNELNQVKENVDTKVNELHERKQVADEKINEMKQRKQELDAKLQQDKQIAEDKIAEIKEHKKQVEDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQKAREDLLNKINEIKQAKQTVSDDLTKKKQDLDIKINDFKHTEKKIDDKLAEVHTTKQNVDNKINEVSQSKQTETKTGTTNTNNNARELPNAGSEQSNNMALGMLSVLGGVLLVTRNKIKALFSK

SEQ ID NO: 27766 - protein, 565 aa, Bacillus cereus MM3
MLPKASAEIEKIPSLKTTATNKADGGKDMHAKESITIQDKVEYTNLVVGKEYTVKGKLMNKVINKPLLIDGKEVTAETKFTAKETNGFVTLDFPFVGAEQQGREAVVFEELYEDGVLVATHADINDVGQTVRFVEPTIKTTATNKADGGKEMHAKDSITIQDKVEYKDLIVGKEYVVKGKLMNKVTNKPLLIDGKEVTAETKFTAKEKNGFVTLDFPFVGAEQQGRELVVFEEVYEDGVLVAIQSDINDVGQTVRFVEPTIKTTATNKADGGKEMHAKDSITIQNKVEYKDLIVGKEYVVKGKLMNKVMNKPLLIDGKEVIAEAKFTAKEKNGFVTLDFPFVGAELQGTEVVVFEEVYEDGVLVAIQSDINDVGQTVRFVEPTIKTTATNKADGGKEMYANESVTIQDKVEYKDLIVGKEYVAKGKLMDKATKKPLLVNGKEVAVESKFTAKEKNGSIILDFTFNASKLQGKEVVVFEKLYQDDILVAINVDIEDAGHTVKFKMGKLGKPQQEKPQLEQPKTGKTSKAGTLPATGGNMYFTWFSVGAGLLLLTLGAILFMKRRNA

SEQ ID NO: 27767 - protein, 837 aa, Bacillus cereus MM3
MLVRDQDKCSKFQAPIPFPASGITGPTGPTGPTGSLGGPTGPQGIQGVQGPIGPTGPTGIQGVQGVQGEIGPTGPTGLTGPQGAQGSQGPMGEQGPQGIQGVQGIQGERGPTGPTGIQGIQGIPGPMGGTGPTGIQGIQGVQGEIGLTGPTGIQGIQGVQGEIGPTGPTGNTGIQGVQGNLGSSGLQGVTGIQGIQGPIGPTGPTGSQGIQGPQGPMGSTGATGVQGLQGPQGEMGLTGPTGSQGIQGVQGVIGPTGATGLQGDPGPTGSTGQAGVTGPTGSATGPTGATGPTGPPGGPTGPTGPAGSPGGPTGPTGSTGATGATGATGATGIQGVQGIQGPTGATGLTGLQGVQGPMGATGPTGDQGIQGPQGVMGATGPTGLQGLQGVQGPIGVTGPTGQQGVQGAQGPIGQAGPQGIQGIQGEQGVMGATGPTGLQGLQGIQGPIGQTGPQGIQGVQGISGITGPTGPQGIQGIQGPQGDIGPTGATGIQGVQGPEGPTGPTGATGPQGIQGIQGIQGPTGPQGIQGLQGIQGPIGPTGPTGPQGIQGITGSTGPTGATGATGPTGVTGPQGPQGIQGPQGVTGPTGATGATGVTGPQGIQGIQGPQGITGPTGATGVTGITGPQGIQGIQGPQGVTGATGATGSTGSTGATGPTGIQGIQGITGATGGTGITGPTGATGPTGLTGATGSSAISTGGGYFFSTSTSTIAANANIPINSGSTVYGTGVSLTSATTVTVSTPGIYLVSYYFQGDATGGNETVSVRLLLNGTQVTGSFIQNVTTSTVVIEPAISNTLLVNVTSANSTLILQNGPLGVGHVTTIAGAITASLNVVRIL

SEQ ID NO: 27768 - protein, 824 aa, Bacillus cereus MM3
MALPLPLIGATGPTGNSGPTGPTGGHEGPVGPPGITGPIGATGPQGPQGIEGIQGPRGTTGAQGIQGAIGDTGEQGITGPVGLQGPQGLIGGQGPVGDIGLQGLEGIQGITGSAGSQGIQGAQGIQGEIGERGQTGAQGMQGVVGEAGITGVTGPQGPQGVQGIQGEDGTTGIQGEEGPQGIQGITGEQGPQGDQGIQGVTGPTGSTGIQGPQGISGIKGITGVIGPQGPQGIQGIQGVRGSTGFQGPKGIRGITGATGSTGTQGAEGPPGGPTGITGPIGPSSGVTGPSGPPGPPGGPPGPTGETGERGVTGGTGAIGAQGLQGITGPTGAQGARGAQGSQGIIGVAGVQGAQGIQGVQGITGATGAEGPQGTQGPQGEIGPTGAEGPKGVQGIQGITGPTGAQGIQGLQGIIGPTGTTGAAGAQGPQGIRGETGAAGAQGIQGPQGIRGETGAAGVQGIQGPQGIQGEIGLTGAQGAQGLQGVQGIIGPTGAIGLQGPQGIQGIVGPTGAQGSQGMQGIQGITGPTGAQGIRGLQGNIGESGITGPQGVQGAQGIEGPEGPQGNVGITGVTGETGATGATGATGVQGIQGVQGIIGIQGSTGSTGSTGATGVTGIQGTQGIQGLQGPTGVSGMTGVSGSQGPAGAQGSQGPIGAVGPTGATGSQGPIGFLGIVGATGATGLPSGGGYFFSTSTSAIAANALIPINSGATTFGSGVSLTNATTVTLSTPGIYLVSYYFQGDPNGGNETISVSLTLNGTQVAGSFIFYVTGGTFVLEPAVSNTMVINVASSNATLSLQNGPLAIGHVTTLSGVITASLNVLKIV

SEQ ID NO: 27769 - protein, 416 aa, Bacillus cereus MM3
MAVCMKKANGIAKSVAVASVIMSGSLGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNYPEWGIYNRDSFNTFYGNQLFMKSRSYNEGTNNFVSKDTVPALTGYGFSPNVVAVITADKTESTSDLKITNRRISDQYNIEWVSSKWWGTNNKDTYNEFFTNNYKLDWKNHQVTLDNQKALEEQMSSINNVNNQLNKGKGKLSFSMNGNQLKATSSNAGYGISYEDKNWGIFVNGEKIYTFNEKTTVGNISNDINKLNIKGPYIEIKQI

SEQ ID NO: 27770 - protein, 971 aa, Bacillus cereus MM3
MKGYSKKVLVGVSFASLMLGGFQGGTLAESKKGEQVSYRNVLKMEPVGVQLPMQELAHSSKVLENKSFEKRLQFADLSQRPPEVKKESKQLAAAKTYTIAELNQLSNQQLVDLLVTIDWEQITGLFQFNKDSLAFYQNDSRMQAIIDKLKQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSTLSKDANLNKEYQDYMQMLVDNREKFNVPLVSDDYLATHAPKPVSDIAAEITAEAKLSNVSVKKNKSQFFNTFTLQGTYTGTTAKGEYEDWKTITQNVNDTLKRLSAKEWTGYKTVTAYFVNYRVNASGQFEYDIVFHGMNTEEGAVNKAPVAIINGPYNGNVNEAISFKSDGSKDEDGKIVAYKWEFGDGTVSNEQNPTHVYTKEGTYTAKLTVTDDKGLTNTITTNVTVQKKEDNSVEKEQNNSFQTANKLQLNQVLRASLGNGDTSDYFEINVETAKNLQINVTKENNIGVNWVLYSETDLNNYVTYAQQEGNKLVGSYYTYPGKYYLHVYQYGGGTGNYTVEVK

SEQ ID NO: 27771 - protein, 760 aa, Bacillus cereus MM3
MLAGATLAIGVIAPQVLPTTAHADEQTGESTVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDTNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVSGVDAVLMGHSHTEVKDVFNGVPVVMPGVFGSNLGIIDMQLKKVNGKWEIQKEQSKPQLRPIADSKGNPLVQSDQQLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVINPAADKNWTFKPIVADKLNTTFDSSPNAQKYIKKDGKISYVGPSENEFAKYAIDITKKNDDDKETGGENPTTPPTGEGNNGGNPTTPPTGEGNNGENPTTPPTNEANNAGSGQTTTDNQNSKETTTVSENKEDRDLPKTGTSVASTIGAGLAFVGAGLLLLFRRKKANR

SEQ ID NO: 27772 - protein, 43 aa, Bacillus cereus MM3; identical to SEQ ID NO: 27733

SEQ ID NO: 27773 - protein, 1007 aa, Bacillus cereus MM3
MKDGKLAEVKIEDEIPSGLEFVKDSLKAEGDKPAPVELKEEAGKIIAKYENITDMKERNIIFKVKVKDDVEVDKAIVNKAIVDDSQNPVEQPEVDITPQYKDGKVKADKKVSKKDPKLGEEVEYRIRFKNTVENGKLAEVKIEDQLPTGLEYVKDSLKAEGNEPNPVELKEEAGKITAKYENITDTAERSISFKVKVTEAAKVGKTIVNKAIVDDHNPKNPPQKPEAIITPEYKDGKLKAEKTVNNEAPKLGEEVEYRITFRNVVEHGKVAKVKIKDELPNGLEFIEGSERAEGENPKPLHVKVKNGIVLAEYPEIVDTKERSIVFKVKVKEKAKIGEEIVNKAVVEDTIHPPEQPNVAIQPQYKDGALQAEKTVSNHEPKLGEEVEYRISFENTIENGKLTEVKVEDEIPAGLEYVQDSIKSDGPEPNPVELHVENGRVTAKYPEITDTKKRSIIFKVRVQESVQVGKEIINKAIVDDNNPTTPPVESLIPITPQYKDGKLEARKEVSNHEPKLGEEIEYRITFNGTVDGGKLVDVKIEDEIPAGLEYVQDSLKAVGDKPAPAELTVENGKVIVKYPDIMDMKERSIIFKVKVKETVKVGGEITNKAIIHVDDPKHPVIEPTATIKPEYKDGKLKATKTVSNKEPKLGEEVEYRISFKNTVENGKVAEVKVEDEIPVGLEYVQDSLRFEGAEPNPVELKMEFGKVSAKYLDIADTKERSIIFKAKVKETVETGEKIVNKAIVGDTINQPEEPVVSIIPQYKDGKLEARKEVSNKEPKLGEEVEYRISFKNMVENGKLAEVKIEDQLPAGLEYVQDSVKAKEAIEVKVENGKLTAKYENIIDTKERNITFKVKVKEKAGEEIVNRAIVDDGINQPLEPTVSIKPKEPEVKPEDPREPEVKPEDPKEPEVKPEDPKEPEVKPEDPKKPEVKPEDPREPEVKPEDPKEPEVKLEDPEIRLEKLIKEPQVKVERELPKTGAASPWMMSVGAGISFLVGGVLFILGRRRKQ

SEQ ID NO: 27774 - protein, 431 aa, Bacillus cereus MM3; identical to SEQ ID NO: 26715

SEQ ID NO: 27775 - protein, 2805 aa, Bacillus cereus MM3
MKSLNVKEGDYFTFQLPEYFIVHNTITQDLIDGKGHTIGSFVVTPDGKVTMTFNEYVDDYPNIAGHLNIRTEFNEVKITGTTEKQIPFPIKEKDVIIELDFKPKVTKSIDKKGVPDRPINTNQINWKVEMNKTKDKLTNAVFQDNIPNGASLNEDSIKVYYLEVDINGKTTRGAEVPKEEYELTSSSDKLNIAFKKETNKAYEIEYATKITDESVTTFKNNANVSSKNQKDVSANATVTVSRGTHLEKTSKYNPKTQTIEWTITYNGDQRKIKKEAALLKDILDKDHKIDQSSIVVKNASYNDSGQIGTGDDATNFTIKETTEGFALQFTTDIDSAYVITYTSKAAGDVIADGEIENEIIADGGSSKTNKVTLQKQNIIKKHNKNAKDTDYNAKTTKWTIIVNDNNYVLNDAVIKDTFDYGGLTLQKDSFKITDGSRTLDPNFDYTLDVTDKGFEVRLTGDYKSNMDKTLTITYTTDFNYENLSKEKNNKSFKNTAKLSWKDIGGKDKNSSSDDTFNPDGYTKGNGFKYGSYNAQTKEIKWDIGFNYNNMTIKDPSIVDVLRDNQKLIPESIEVRHMKLTGGAHGFEVSDPVPSSEYTIEAPTKDNNNTLTIHFKNEIKTAYHISFKTSLAGEQINERYDNYADLKDGSKTVTTIHGAFEITNGGSGVTKTAKQNDKHIDWSVSINASQSTIENAVVTDDPTDNQIIDEKSFHLYPTTVAENGTLTKDTANELKEGTDYKLKVITDNNTGKQQFKVEFLHTINRAYILEYRTLINADHNEKVSNKATITGHRLTLTKTEDVKFVNVKVSSGSGGGSATKGRGNLHIKKYDEADKEKKLSGAVFTLFDRTGTNVIRTITTDEKGIAQFNNLKRDEYLLRETEAPDGYVISKELRDGIIVKLDTEVNETKTYPLPNKKFVGKVILTKIDRYSKEKLEHAVFSLLDQNKQVIPEHKELTTNDKGQITVDNLKPGTYYLKETKAPEHYQLDDQLIEVKIAKDQTAVIEKEAKNNLITGSAILTKVDKNGETLAGAVFSVRDRNNKIIPGYGKLTTNDQGQIEAKDLRPGDYQFVEEKAPEHYDIDKKPIEFTIVKSQKKAVTVTATNHLIKGGVILTKTDDIDNKTTLAGAIFKIVDANDEKKVIRENVKTGADGKVTVKDLEPGTYKFIETEAPKDYVLNANPIEFTIDKSQQSFATVTATNSLKTGEVELLKVDEFGDKKPLEGAVFKIVDLNNNDVRTDLTTDADGKTKADKLRPGNYKFIETKAPEHYVLDETPIPFKIDRSQKETLLVKAENALKPGDVELTKVDDIDGTTLEGAVFKIVDANDEKKVIRENVKTGADGKAIATGLRPGDYKFIEVTAPKYYDKNTNPIKFTITESQTTSATVTAKNSLTKGGIELTKVNAADEKETLEGAVFKIVNRDTNEDVRTELVTNSKGILVVDDLRPGNYKLIETKAPTYYDVNVEPIEFTIEKGQQKLLPLTFKNSLTKGKVKLIKEDDVDSKIALAGAVFKLQDATGTDIMKDLKTDDYGVLVIPDLAPGDYQFIETEAPEHYKLDQTPIKFTIKKGSTEDLPIPVTVKNSLLTGGVTLTKVDDVDGITLEGAEFIIVDAHDTKKVVRKGLTTDEHGKVSASDLRPGDYQFIEVKAPKDYDLSKNPIPFTIGKSQQENITVTATNSLTKGGVILTKIDDIDRTMLKDAVFKIVDMKGNEVRTNLVTNDNGEISVSNLRPGDYQFIETAAPEHYMLDETPIPFTIERSQTEKITVTGKNTLKKGSVELTKIDDIDTDTKLANAVFNLLDADGEIVEEGLKTNAEGKIVVENLRPGTYKFIETAAPEHYDLNKKTIEFTIKKSQTETLHVTAKNALTKGAVELSKVDDIDDTTLEGAVFNIVDMNGTVIHKDLVTNGKGKIEINDLRPGDYQFIETEAPKHYVLDETPINFTIEKGQKKTISLTAKNSLKQGSIELIKVDDLNDQTKLADAVFNLLDQNGKVLKTDLKTNSEGKIIVENLRPGTYQFVETTAPKHYDLDKKPIVVTVKKSQKDIATVTMKNSLTKGGVELTKVDDVDGTTLEGAVFNIVDMNGTVIRKNLTTNSQGKISVSNLRPGDYQFIETKAPKHYDLNKEPIPFTIEKGQAEPISVTAKNSLTKGAVELSKVDDIDGTALEGAVFKIVDDKNNDVRTDLTTVKDGKISVPDLRPGDYQFIEIKAPEHYKLDSTPLKFTIKKSQAEKLQVTATNSLIEGTVELIKVDDINPDTKLSDAVFNIIDAKGKVVRTNLTTDKDGKVSASNLRPGDYQFVETKAPKNYDLNKTPIPFTIEKSQPAHVSVTAKNGLTKGGVELTKVDSLDAKETLEGAVFKITDMNGNDIRTNLVTNKDGKIIAKDLQPGDYQFIETKAPKHYDLNEEPIKFTIERSQTKHVFVTATNSLTKGSVELIKVDDVEENTTLEGAVFKIVNKDGHDVRTDLTTDKNGRLVVDELPPGDYEFIETKAPNHYDLNETPIKFTVKKGQEKIASVTATNSLMKGAVELSKVDDVDGSVLKDAVFKIVDMNGHNVRSDLTTDKDGKISVSDLRPGDYQFVETKAPIGYDLSAKPIPFTITKGQSQVTSVTALNSLTTGSMELTKIDIDHHGTLAGALFNILDHDGKVVREGLQTDGHGKLIVNDLKPGNYQLVETKAPKGYQLDASPINFTIEKAQAAPLQVTVSNKKIDSSSGGDDKPITPPNKEEETGKETSEELEKGNPDTHGKGTSEELEKENPDTQINKQQDDRNKGKELPNTGHKNDPSQTVGIVLLLAGLLSILATKRKKYY

SEQ ID NO: 27776 - protein, 103 aa, Bacillus cereus MM3; identical to SEQ ID NO: 26821

SEQ ID NO: 27777 - protein, 174 aa, Bacillus cereus MM3
MYKKLGTIALTGALAFSLAACGETEVKEVSKNDAPKQEQKKDDKAASKVYKTGETVEVNGLQITFNSAQFVEPNEYTKPEKGKVLEITFSAKNNGKKDAYIGSEELKIADANGNQFKGYFGADNAFMNENVVPGNQITGKMYFDVAESDKYTGTYKPNFTFDEKSVKFEFTPGK

SEQ ID NO: 27778 - protein, 43 aa, Bacillus cereus MM3
MNPEKPEKELPKTGQKMPVEPYMGALLIMMSFGLLVLGRKQQR

SEQ ID NO: 27779 - protein, 191 aa, Bacillus cereus MSX-A1
MKSRSYNAGIYNFISKDTVPVLTGYGFSPNVIAVITADESEAMSGFKITNRRVSDQYNIEWVSSKWWGTNNKDVHNEFSTNYYKLDWKIHKVIPDNQKVFEEQMNGFEDVNSKINKGHGFLSFSLTDNQLIATTNNAEYGISYEDINWGIFVNGEKVHTFNEKTTVSNIANTINNLKIKGAYIEIKKINVF

SEQ ID NO: 27780 - protein, 659 aa, Bacillus cereus MSX-A1
MFNQRTRNGVKKILAITAASTVFSMFGSSISIIEAASAPGVYVTPKNSVSSDIISIDWSPVQTAPYTYWAVHNWNQGGEAGGYAGFQQQSGFDENGKRTLHFAVWDPISSKEAIKAEYVSPTSVASNFGGEGTGLKIQTTYDWKNYNWYRMTMRSWQENGHTKFGQWLKDVSKNQWKLIGIMDFPVPNVTFNYGQTLFQEDWLGNGQDVREARVKNGYGRNISDKKWTSWNTQSIEGQEPLNNNWDGGATSEYLWFKAGGDSRSTIGTGKTFTLNQPSQPEIGKLDYDVKSTYYENEKLNITWQLKDSSTPQFKGKIEIYNNENMTGQPINVINDIKSYQNGISQSISLPTNTYAKIVLTDIFDQTVEKKVKIKNESPNILEGDWFAWSMKGIGDFEFAKLDLNKSTEELQVSLIAGTPHNYFDSTYASIKVQDTSGKVVYNKEIYGNNRQNAETKTVPVKVGNFIELTHLEGGERATLTNLDNNKRESFDKKVIYEVTKDGLKKINQIVNPKPDTESPTQPQGLYASNVASDGVELKWNPSTDNVGVKGYQVLRNGQLIQTVQGTMFTDQNLTANKEYKYTVKAVDAAGNISDQSNILTVTTKSQNVTYEKWDPKKAYTKGDKVEYQGKFYEAVQSYQGNGDPTWIFALSLWQPFYMK

SEQ ID NO: 27781 - protein, 160 aa, Bacillus cereus MSX-A1
MKNKKCMLKKITITSIIMWNCFTLNLPTAHADTKIESIVDIGDNGQNAKVYNNFSTLFDEQAKIKTSLLVSIIDDPYSNKQIAVIKTDGSNISANKSVEGLTDEYGHEAGYMSAVLKWASSYNIGMELTNDNSQFYKVSPINTIDTKNITSTIGYNIGGK

SEQ ID NO: 27782 - protein, 163 aa, Bacillus cereus MSX-A1; identical to SEQ ID NO: 26541

SEQ ID NO: 27783 - protein, 183 aa, Bacillus cereus MSX-A1; identical to SEQ ID NO: 26531

SEQ ID NO: 27784 - protein, 276 aa, Bacillus cereus MSX-A1
MILKNQKVVHACMIGASVVSLFTVPSGTSAETTMTQQCHATSPLHFHSECKIEAMDWGNNLFNLWDKLTPRIEKDIIRGYTAANYQTINGYLRSEYFNPLDQEKVERSVKLMDRAFSRVRLQEDMIVYRRVSERSFGLKSGEFGELMNEESRINMSAFETFKRLFQGKYKKDPTYISTSIVKDAAESFSHLPILMKIHIPKGVPAIYVAPLSHLPEEDELLLPRNRTYKVTNILPVIEEDREYIMLDIEILDIASNYRNKRSNDIVYDDNLPSLSK

SEQ ID NO: 27785 - protein, 697 aa, Bacillus cereus MSX-A1
MKGIDYDIQSYLQDTNKKPNETMWYGKIDNFINEISRIALVGNITNENSWLINNGIYYAGRLGKFHSNPNKGLEVITQAMSMYPSLSEAYFVAVEQVKTNYGGKDYSGNVVDLQKIREEGKQQYLPKTYTFDDGAIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEIYQNERLTWFQEGNAEFFAGSTRTNNVVPRKSIISGLSSDPASRYTAKQTLFAKYGSWDFYKYSFALQSYLYNHQFDTFDKIQDLIRANDVKNYDAYRESLSKNTQLNAEYQTYMQQLIDNQDKYNVPQVTNDYLIQHAPKALAEVKKEIEDVANIKDAKITKHDSQFFNTFSVEGTYTGGISKGESEDWKTMSKQVNQTLDQLSQKGWSGYKTVTAYFVNYRVNAANQFEYDIVFHGVATEEKEKSTTIVNMNGPYSGIINEEIQFHSDGTESEDGKIISYLWNFGDGTRSTEANPIHVYGEKGTYTVELSVKNSMGQESKEQTKVTVKQDPQTGGSLEEEKVLPFNTLVKGNLITPDQTDVYTFDVTNPKELDISVINEQNIGMTWVLYHESDMQNYVACGEDEGNTIKGKFVAKPGKYYLNVYKFDDKNGEYSLVVK

SEQ ID NO: 27786 - protein, 163 aa, Bacillus cereus MSX-A1
MNWSTSTSYDQPDYKTVLETDTANKVQWRIPFISTMNQGYGPYNRDSDDSIYRNQLFMKSRNAATWAKDNFISSDEMPALASYGFSPGMIAVVIADKLEDISTFKITYTRNSDDYRMDWTSFFNGVHGSGAGWWVGGNIKDVSKSISVHNYSVDWKNHRLIEN

SEQ ID NO: 27787 - protein, 667 aa, Bacillus cereus MSX-A1
MIRKKHPFCTLAKTAVALTMIIPTSQAISHTFAYAQENIAKSQQQVAPFWNKNKDYPGESYVTYEGKIYHSVYWVNAGTLPTQQFSGWELYTGSEYIPDNSDPNDLFGEGITWPTHVFAPYVDNGMNPQNLLKYAQETNTSFFTLSFIVADKNGNPVWGGSHTPIGDGNLDDQIKQIRKIGGDVKVSFGGANASNTPGLGADLAAAITDVNKLKDAYKSVINTLHLTHMDFDIEGVLVAHPESIERRSKAIALLQKELKAEGKDVKIGYTLPVMPYGLTNDGINVIQSAIKHDVDLNSVNIMTMDYGQQNQQMGQAAIDAINSLHGQLTNLYKGTIKDSDIWKMIAVTPMIGKNDTQNETFTLNNAKELFQFAKEKGIGEISMWSVYRDKKATESWQIGQATGDASGLPDVDDGAFSKLFSAFNSSTEIDVIAPTAPSNLRSVSKTTTTVELQWEASTDNIGVKEYEVYRDGKKVGTTKTTRYEDAGLQANTKYNYTIKATDAAGNKSKSSNEVSITTKEENPEQIAPTAPTGLQASETTTNSVHLIWEESISNVGIKEYEIYRNGTKIATSPSTYYTDENLLASTEYRYMVKAIDTQGKVSVASNEIKITTKDTPSSEYKAWDSYAAYKKGDRVEHQGKIYEAVQSYQGYGDPNWIFSLALWKVIK

SEQ ID NO: 27788 - protein, 431 aa, Bacillus cereus MSX-A1; identical to SEQ ID NO: 26534

SEQ ID NO: 27789 - protein, 412 aa, Bacillus cereus MSX-A1
MKKVNKVAKCFVVASVLMSGAFSVESSSAFAESKGTVEDLKNGGKVYNSFSTTYNAKQNIKNSIKVSFIEDPYADKKIAIVTTDGSNIDAKYEINGEYYNAGLKWPSAYHTEVEITSDDSAQFHKAAPVNTMTSAKVTSEVGYTLGGTVKLGVNDKGPNADASITGSFAWKESVSYDQADYKTVLETLTDKKLNWKVGFQSFNYPSWGIYNRDSYNTLYGNQLFMKSRSYNEGIQNFVSKDTVPALTGYGFSSNVIAVITADESEATSDLKITNRRVSDQYNIEWVSSKWWGTNNKDVHNEFFTNYYKLDWKNHKVLLDSQAATEEQLKGFKDVNSKLNKGQGILSFSLADNQLKATTNNAGYGVSYEDINWGIFVNGEKVHTFNEKNTVSDIANTINNLKIKGPYIQIKKI

SEQ ID NO: 27790 - protein, 455 aa, Bacillus cereus MSX-A1
MNNRFLKQLQNMKMNKKSLGAVALTAGIISTTLIPQNAYAHGFVEKPGSRSALCSPTYGALNVNCGSVMYEPQSLEAPKGFPQGGPVDGQVASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTKKVTANSVELTWNSSTDNVGVKGYQIFRNGEMIDTILGTHFIDKKLQPSTEYSYTVKAIDAAGNVSKESTALTVKTTVATPDTEAPTQPKGLHSMGTTASSVDLMWSPSDDNIGVDHYDIYREIEGLMKKIATSNTTSYMDKNLLANTTYKYVVKAVDVAGNESVQSDISTITTKAESASYEAWDAKKAYKKGDRVLHEGKVYEAVQSYQGNGDPNWIYALSLWKTV

SEQ ID NO: 27791 - protein, 965 aa, Bacillus cereus MSX-A1
MNKKSKINKVMLSISTMALSLGALQTHAVAEEKVPYNVLKTKPVGIEKPVDEVGHVSKVDETLSFQERLKVGDFSQRPASITKKTAVKQVKESYSMADLNKMNNQELVETLGSIKWHQITDLFQFNEDTKAFYKDKGKMQVIIDELAHRGSTFTKDDSKGIQTFTEVLRSAFYLAFYNNELSELNERSFQDKCLPALKAIAKNPNFKLGTDEQDTVVSAYGKLISNASSDVETVQYASNILKQYNDNFTTYVNDRMKGQAIYDIMQGIDYDIQSYLVEARKEANETMWYGKVDGFINEINRIALLNEVTSENKWLVNNGIYFASRLGKFHSNPNKGLEVVTQAMHMYPHLSEPYFVAIEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLINNQDTYTVPEVADDYLAEHATKSLTAVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNVNGPYNGVVKEGIQFKSDGSNDEDGKIVSYLWEFGDGSTSAEVNPVHVYEREGSYKVSLRVKDDKGKESRSETTVTIKDGSLTESEPNNRPEEANRIGLNSTIKGNLIGGDHTDVYTFNVASAKDIDISVLNEYGIGMTWVLHHESDMQNYAAYGQANGNHIEAKFNAKPGKYYLYVYKYDNGDGTYELSVK

SEQ ID NO: 27792 - protein, 112 aa, Bacillus cereus MSX-A1
MKEYQVLRDGKFIQTVQGNTFTDSKLTANIEYKYTVNAIDAAGNESIQSSVLSIKTKEQNTFYEKWDPRKAYTKGDRVEYQGKIYEAVQSYQGNGDSNWIFSLSLWKIILIS

SEQ ID NO: 27793 - protein, 1093 aa, Bacillus cereus MSX-A1
MGKRVIIRVFTLLSVLALFLNVFLPRASAEVMTHEKYSMNWSYSNSLGKHIRTEMIKNSSGQIAYCLTLGLKSPNGEDLPEMGKTDNVVYRVLLNGFPQKSVQQLGVANQNEAHYATQLAVWNALGQLDVNELKHENKNVEKAAKAIISNANNSEETQDVFMNVIPAEKQKAELKGEFFETNLYSVQTNAKGGSYKVVAKNAPNGVKIVSENGEVKDQLSVGEKFRIQIPKNTKTGEFNLSVAANLTKVQAIAYRGTDTVQNATVLLERNEEKLSSDLAVNWEAAGSLKIKKVGENGEVLADAVFEVFNANNESVGKITTGADGIAELNNLPIGTYTLKEIKAPTGYVSDDKPQTIEVKTGETGAVQIVNNKVKGNIEIKKLSDSGKVLPNVEFTVFTEDGKEVKKVVTKENGIANVEGLTYGKYYFLETQTPNGYIGNKTKYPFEIKEHNKTLTFTVENTEVKGSVKLLKVDNEDVSKKLEGAEFELKDASGKVIGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTVKGKLMNKETNKPLVVNGKEVTAETKFTPTEANGFITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKSVTIQDKVEYKDLIVGKEYVVKGKLMDKATNKPLLVDGKEVTVESKFTAKEKNGSIILDFTCNASALQGKEVVVFEELYQDNILIAIHAEIEDKGQTVKFKEVKPEQPKPEQPNSDENTPTPEQPNEQVKEQPQPKKEIQSKIGWLPQTGTNLTSWISMAAGALLLIVGGVIFLKRKNA

SEQ ID NO: 27794 - protein, 336 aa, Bacillus cereus MSX-A1; identical to SEQ ID NO: 26466

SEQ ID NO: 27795 - protein, 104 aa, Bacillus cereus MSX-A1
EVEESKEEVKEPTKEVEEAKEPKKEVRESATGLDQEPKGNNQVVENEGRKADTLNKQHTNKPEEGKKFLPSTGGEASTSTLLSGITLVLSALSMFVFRKRLFKK

SEQ ID NO: 27796 - protein, 348 aa, Bacillus cereus MSX-A1
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFIHVIGTHLQAEDSMCGKTSPASVRTNQLKEIQDFIKNKNIPNNEYVLIGGDMNVNKINAENKNDSEYTSMFKTLNASVPSYTGHTATWDATTNSIAKYNFPDSPAEYLDYIIASKDHANPSYIENKVLQPKSPQWTVTSWFQKYTYNDYSDHCELHNINLLKGVGHELVTKMINLVP

SEQ ID NO: 27797 - protein, 94 aa, Bacillus cereus MSX-A1
PGTPDPEKPGTPDPEKPGTPDPEKPGTPDPEKPGTPNPEKPGTPDPEKPGTPGPEKPEKELPKTGQKMPVEPYMGALLVMMSFGLLVLGRKQQR

SEQ ID NO: 27798 - protein, 117 aa, Bacillus cereus MSX-A1
MSMGSAESLDVLGTGEVKAQGVFKVLDIAVYNHKEEPITLDINNFKLIDGFGREYHISNEYQSVLKAANISTFKFNIVNPNESSEGNIVFDVPKNTQGLTLKINNDKLDKELQLKVE

SEQ ID NO: 27799 - protein, 893 aa, Bacillus cereus MSX-A1
MGNKKEIAIVALTTGFVLTSVTPYGLGHAEETGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGDSAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVQSVKENKTSNFISLTGTGKDDLGVTRTFGISKQTSGNYALADYTRGQGIETYDVNYRDITNEESYYPGILATSVSTTFNDPKAVSAHFLATKVYDFYKEKYKRNSFDNKGNKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSIFRNMKNPTAINFSDGLPYPDDYSKYNDLNGEDYGGVHFNSSIINKVAYLIAQGGTHNGVNVNGIGEDKMFDIFYYANTDELNMTSNFSELKLACLKVATNKYGTNSIEVQAVQNAFDAAKIIEKVKENEKTAENQAPELTVPFTITLRVGDTFDPMRNVKAVDKEDGDLTNKVKHKGDVNTSKPGTYIVEYLVVDSKGGNATAIQTVIVEGNGEISDLEPKLTVPVGAILHVGDSSVPMAEVLAIDKEDGDLTSKIKVDGEVDTSKAGTYVLTYTVTDSKGHEVTAKQTVTVKVREEIKNEKPILKVPATTSITEGDQFDPLIGVSATDKEDGDLTSKVAYKGTIDTTKAGIYEIIYSVRDSVGNEVNTIQKVLVKDKETSKPNGLANKTNKSNISNNSNSDKKEYTYKELPKTGVSTTNSAAIGILMIITGTVLTLIRKFRKIQK

SEQ ID NO: 27800 - protein, 975 aa, Bacillus cereus MSX-A1
MKGYSKKMLVGVSFASLMLGSFQGVSLAEDTKGEQVSYRNVLKMEPVGVQLPVQELAHSSKLLESKSFEQRIQFADLSQRPPEVKKESKQLAVAKTYTIAELNQLSNQQLVDLLITIDWEQITGLFQFNTDSLAFYQNDSRMQAIIDKLKQQGQAYTKDDSKGIETLVEVLRSGFYLGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGSFHSTGTKGLQVVTDAMKIYPYLGEQYFVAAEQIATNYGGKDANGKVVNLDQIREDGKKKYLPKTYMFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLFDNREKYNVPLVSDDYLANHAPKPVSDIAAEITAEAKLKNVSVKKNKSKFFNTFTLQGTYTGTAAKGEYEDWKIITQNVNDTLKRLSAKEWTGYKTVTAYFVNYRVNASGQFEYDVVFHGINTEEGAENKAPVAVINGPYSGNVNEAISFKSDASKDEDGKITSYKWEFGDGTVSNEQNPTHVYTKEGAYTAKLTVTDDKGATNTATATVTVQKKEDNSLEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 27801 - protein, 503 aa, Bacillus cereus MSX-A1
MFNKKMVAMAMTVPLVMGTISTVSALEKQQQVKLEAYSPQKKATEYLKENAAQYGLKADLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 27802 - protein, 563 aa, Bacillus cereus MSX-A1
MIEVVKGIREMKKIFSVLLVLFLTFSTWSSVLVKADSPSKGTLTIHKYEQEKDGAQGLEGDGSANQEVPKDAKPLKGVTFEVKKVASFEKISNDGKIVKEDVKPVMGATPTQVVTDDNGQAVLKDISLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPIIDKKINGKLEALPINPLTNYNYDIKTLIPEDIKEYKKYVVTDTLDNRLVIQGKPIVKIDGAEVNASIVEVAIEGQKVTATVKDFTKLDGKKEFHLQIKSQVKEGVPSGSEILNTAKIDFTNKNDVIEEKESKPVVVVPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKSANN

SEQ ID NO: 27803 - protein, 458 aa, Bacillus cereus MSX-A1; identical to SEQ ID NO: 26537

SEQ ID NO: 27804 - protein, 367 aa, Bacillus cereus MSX-A1; identical to SEQ ID NO: 26533

SEQ ID NO: 27805 - protein, 412 aa, Bacillus cereus MSX-A1; identical to SEQ ID NO: 26538

SEQ ID NO: 27806 - protein, 155 aa, Bacillus cereus MSX-A12
TEEPKELEKPEVTEKPEIHVKPEEEQVEEETTEEIKEEKPEEPKVTEEPKELEKPEVTEKPEIHVKPEEEKVEEPNKSEVKEQPKVSNKPEIQGKVEAENKQDVQNKNEVSSSKESNKQSKLLPQTGGAAAESTSILAGMFALILGAIMFRRQKN

SEQ ID NO: 27807 - protein, 187 aa, Bacillus cereus MSX-A12; identical to SEQ ID NO: 26434

SEQ ID NO: 27808 - protein, 372 aa, Bacillus cereus MSX-A12; identical to SEQ ID NO: 26433

SEQ ID NO: 27809 - protein, 203 aa, Bacillus cereus MSX-A12
MKKPFYKKWWFWVIVVIVVLGAYGNSSKDTEDTKTASTEPKQEAKQETKKDEPKKDEAKKEEPKKEEPKKELSKEGESSKVKIAVGSVESTDSVGGQYLSEKAQGVFKIVEVSITNNQKDAITVDANSFKLVDNQDREFKYSTQAQTAFDVGNGGKSDFFLKQLNPGLTQTGKIIFDVPADAQGLVLKARGGMMGKEIKLKVE

SEQ ID NO: 27810 - protein, 175 aa, Bacillus cereus MSX-A12; identical to SEQ ID NO: 26353

SEQ ID NO: 27811 - protein, 333 aa, Bacillus cereus MSX-A12; identical to SEQ ID NO: 26429

SEQ ID NO: 27812 - protein, 431 aa, Bacillus cereus MSX-A12; identical to SEQ ID NO: 26428

SEQ ID NO: 27813 - protein, 564 aa, Bacillus cereus MSX-A12; identical to SEQ ID NO: 26430

SEQ ID NO: 27814 - protein, 503 aa, Bacillus cereus MSX-A12; identical to SEQ ID NO: 26421

SEQ ID NO: 27815 - protein, 238 aa, Bacillus cereus MSX-A12
RADLTTDKDGKISVSDLRPGDYQFIETKAPTGYDLNAKPIPFTITKGQSQVTSVTALNSLTTGSIELTKVDMDHNGTLEGAIFNILDQDGKVVREGLKTDGHGKLIINDLKPGNYQLVETKAPEGYQLDASPISFTIEKAQAAPLQITVSNKKIESSSGGDNESITPPNKEEKPGKETSEELEKGNPETQINKQQDDRNTGKELPNTGHKKDSTQTVGILLLLAGLLSILATKRKKYY

SEQ ID NO: 27816 - protein, 965 aa, Bacillus cereus MSX-A12; identical to SEQ ID NO: 27672

SEQ ID NO: 27817 - protein, 456 aa, Bacillus cereus MSX-A12; identical to SEQ ID NO: 26352

SEQ ID NO: 27818 - protein, 553 aa, Bacillus cereus MSX-A12; identical to SEQ ID NO: 26419

SEQ ID NO: 27819 - protein, 455 aa, Bacillus cereus MSX-A12; identical to SEQ ID NO: 26424

SEQ ID NO: 27820 - protein, 971 aa, Bacillus cereus MSX-A12; identical to SEQ ID NO: 26826

SEQ ID NO: 27821 - protein, 77 aa, Bacillus cereus MSX-A12
NNGENPTTPPTGEGNNTGSGQTTTDNQNVKETTTVSEKKEERDLPKTGTSVVSTIGAGLAFVGAGFLLLFRRKKANR

SEQ ID NO: 27822 - protein, 965 aa, Bacillus cereus MSX-D12
MNKKSKINKVMLSISTMALSLGAIQTHASAEEKVPYNVLHSKPVGIEKPVDEIGHVSKAEETLSFQERLKVGDFSQRPASIPNKAAVKQVKESYSMADLNKMNDQELVETLGSIKWHQITDLFQFNEDAKAFYKDKGKMQVVIDELAHRGSTFTKDDSKGIQTFTEVLRSAFYLAFYNNELSELNVRSFQDKCLPALKSIAKNPNFKLGTAEQDTVVSAYGKLISNASSDVETVQYAANILKQYNDNLHTYVDDRMKGQAVYDIMQGIDYDIQSYLIEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPAVADDYLAEHAPKSLTAVEKEMTETLPMKDAKMTKHSSQFFNTFTLEGTYTGSVTKGESEDWNAMSKKVNEVLEQLAQKEWSGYKTVTAYFVNYRVNSSNEFEYDVVFHGIAKDDGENKAPTVNINGPYNGLVKEGIQFKSDGSKDEDGKIVSYLWDFGDGSTSAEVNPVHVYEREGSYKVALIVKDDKGKESRSETTVTVKDGSLTESEPNNRPEEANRIGLNTTIKGSLIGGDHTDVYTFSVASAKNIDISVLNEYGIGMTWVLHHESDMQNYAAYGQANGNHIEANFNAKPGKYYLYVYKYDNGDGTYELSVK

SEQ ID NO: 27823 - protein, 161 aa, Bacillus cereus MSX-D12
MKKLLASATAFTLLTVGYSSAAFAAKSPNDTKNCGHFKNQQEAQAFWNQNGYGVGNDPHRLDNDKDGIPCEDYTYQTSTSTTTDNKGTNPQEQTKQENTQQNNQVTNNKQQTEQTAVKAETKKQGEKLPNTASNGVTMMLASAALVLVGSIIVFRRKKTNA

SEQ ID NO: 27824 - protein, 503 aa, Bacillus cereus MSX-D12; identical to SEQ ID NO: 27697

SEQ ID NO: 27825 - protein, 960 aa, Bacillus cereus MSX-D12
MNKNLKFTQMMIGISTMALSFGSIQTQVSAEETAPYNILQMKPMGTETSKDEIVHATKADETLTFEERLKIGDFSQRPTPVMKRDEIQLKQSYTLAELNKMPNSELIDTLSKISWNQITDLFQFNQDTKAFYQNKERMNVIINELGQRGRTFTKENSKGIETFVEVLRSAFYVGYYNNELSYLKERSFHDKCLPALKAIAKNPNFKLGTAEQDRVVTAYGKLIGNASSDTETVQYAVNILKQYNDNLSTYESDYAKGQAVYEIVKGIDYDIQSYLQDTNKQPNETMWYGKIDNFINEVNRIALVGNITNENSWLINNGIYYAGRLGKFHSNPYKGLEVITQAMSLYPRLSGPYFVAVEQMKTNYGGKDYSGNAVDLQKIREEGKRQYLPKTYTFDDGSIVFKTGDKVTEEKIKKLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSNPASRYTAKQTLFSKYGSWDFYKYSFALQSYLYNHQFETFDKLQDLIRTNDVKNYDSYRESLSNNTQLNAEYQAYMQQLIDNQEKYNVPQVTNDYLIQHAPKPLAEVKNEIVDVANIKDAKITKYESQFFNTFTVEGKYTGGTSKGESEDWKAMSKQVNQTLEQLSQKGWSGYKTVTAYFVNYRVNAANQFEYDIVFHGVATEEKEKTTTTVNMNGPYSGIVNEEIQFHSDGTKSENGKVISYLWNFGDGTTSTEANPTHVYGEKGTYTVELTVKDSRGKESKEQTKVTVKQDPQTGESYEEEKVLPFNTLVKGNLITPDQTDVYTFNVTDPKEVDISVVNEQNIGMTWVLYHESDMQNYVACGEDEGNVIKGKFAAKPGKYYLNVYKFDDKNGEYSLLIK

SEQ ID NO: 27826 - protein, 456 aa, Bacillus cereus MSX-D12; identical to SEQ ID NO: 26566

SEQ ID NO: 27827 - protein, 93 aa, Bacillus cereus MSX-D12
EGNNGENPTTPPTGEGNNGENPTTPPTDEGNNTGSGQTTTDNQNVKETTTVSEKKEERDLPKTGTSVVSTIGAGLAFVGAGFLLLFRRKKANR

SEQ ID NO: 27828 - protein, 333 aa, Bacillus cereus MSX-D12
MKGKLLKGVLSFGIGLGVLYGGSSAQADTSTDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFVENKVLQPKSPQWTVTSWLKKYTYDDYSDHYPVAATISMK

SEQ ID NO: 27829 - protein, 336 aa, Bacillus cereus MSX-D12
MKRSKTYLKCLALSAVFASSALVLSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQITWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKSFTLDWKNKKLVEKK

SEQ ID NO: 27830 - protein, 99 aa, Bacillus cereus MSX-D12
MNIGQRLKELRKEKNLTQSELALRINSNQETISRVEKGKFSPNLDWLETTCHALDVTIEDFFISSKSQKVKQLNLCLQNLTEEQLDLLVKLINSFTIKK

SEQ ID NO: 27831 - protein, 141 aa, Bacillus cereus MSX-D12
PEIWVNLEEEENKEGTTEETTEEIEDLIKPEEPNVTEEPNVLEKPEVTEKPETWENLEEEKNKEETAEDLNVLEKREVKEQQEVSNKSDAQGELEVPSSKESDKQSKLLPQTGGTATESTSILAGMLALILGARVFRRSKK

SEQ ID NO: 27832 - protein, 553 aa, Bacillus cereus MSX-D12
MKRIFSLFLICMLAFSTLSNMIVSAESKSTGTLTIHKFEQSKDSKTTTEGNGKEGQTVPEDAKPLEGVTFEIKRIESFEKISNDGTVIKEDAKPVKDAAITKVTNAKGEAVFSNLPLGRYEVKAIEGPKHIALDKTTFIVDIPMTSTDGKDLNYDVHIYPKNETKRGSVEFVKIGEAGQVLKDAEFHLFKKNKDGTSTQVKTPSSLVTGEDGKVRVDSLEYGDYYYFIEHKAPNGYITSKEERPFSIKESGEVVKLEDIKNYKEPTITKSINNGSKVAGINKETDYTYDIKTLLPEDIKLYKKYVVTDILDDRLEIKGQPIVMVDGKKVEDGSVKVVVEGQKVTATIEDFSKINGKELHLQITAKIKSDVESGVKIPNKAVLDFVNKDDVSSEKDGKPSNEVVVTPTAGNIKIEKVDGKDKTLKLEGAKFQLQDKKGNVIKVNGKEMNDITDANGIITWNEIPYGEYQIVETEAPKYKDKDGAVEHYQKLRDPINITLDEKHQKIELQVENNKSGWIIPATGGMGTILFTVVGLILMAVATFIFFRKKPVKNS

SEQ ID NO: 27833 - protein, 455 aa, Bacillus cereus MSX-D12
MKNQFLKQLQNMKMNKKSLGAVALTAGIIGTTLIPQNAYAHGFVEKPSSRSALCSPTYGALNVNCGSVMYEPQNLEAPKGFPQTGPVDGQIASAGGKFGGILDQQTADRWFKNTITGGENTFTWKYTAPHLTSKWHYYITKKGWNPNKALTRADFEPIGTVQHDGSAASNHLTHKINVPTDRSGYHVILAVWDVADTSNAFYNVIDVNLINDVKPDTEAPSIPNRIQAQKVTANSIELAWTASTDNVGVKGYQIFRNGEMIDTVPGTHFIDKKLQPSTEYSYTIKAIDAAGNVSKESATLTVKTTVEAPDTEAPTQPKGLHSMGTTASSVDLMWSPSDDNIGVDHYDIYRETKGSMEKIATSNTTSYMDKYLLSNTTYKYVVKAVDVAGNESVQSDIFIITTKTESVSYEEWDAKKAYEKGDKVLHEGKVYEAVQSYKGNGDPNWIYALSLWKTV

SEQ ID NO: 27834 - protein, 372 aa, Bacillus cereus MSX-D12
MKTKQTIAASTLALAMMAGANSAHAEVNDATPQQSTGDRLAEIKQHKQELDAKLQQHKENVDQTLNELNKVKENVDTKVNELHERKQVADEKINEIKQRKEEFDAKLQQDKQIAEDKIAEIKEHKKQVEDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDDLSKKKQDLDIKINDFKHTEKKIDDKLAELHTTKQNVDNKINEVSQSKQTETKTGTTNANNNARELPNAGSEQSNNMALGMLSVLGGVLLIARNKIKTLFSK

SEQ ID NO: 27835 - protein, 971 aa, Bacillus cereus MSX-D12
MKGYSKKVLVGVSFASFMLGSFQGDALAEGTKGEQVSYRNVLKMEPIGLQLPVQELAHSSKVLENKSFEKRLQFADLSQRPPEVKKESKQLAVAKTYTIAELNQLSNQQLVDLLVTIDWEQITGLFQFNKDSLAFYQNDSRMQVIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTIWYQKIDSYINELSRFALIGTVTAKNGWLINNGIYYTGRLGTFHSTETKGLQVVTDAMKIYPYLGEQYFVAAEQIATNYGGKDANGKVVDLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLSNVSVKKNKSQFFHTFTLQGTYTGTTAKGEYEDWKTITQNVNDTLKRLSAKEWTGYKTVTAYFVNYRVNAAGQFEYDVVFHGINTEEGAVNKAPVAVINGPYSGNVNAAISFKSDGSKDEDGKIVAYKWEFGDGTVSNEQNPTHVYTKEGTYTAKLTVTDDKGLKNTATTNVTVQKKEDNSVEKEPNNSFQTANKLQFNQVLRASLGNGDTSDYFEINVETAKNLQINVTKENNIGVNWVLYSEADLNNYVTYAQQEGNKLVGSYYTYPGKYYLHVYQYGGGTGNYTVEVK

SEQ ID NO: 27836 - protein, 147 aa, Bacillus cereus MSX-D12; identical to SEQ ID NO: 26827

SEQ ID NO: 27837 - protein, 112 aa, Bacillus cereus MSX-D12
TYKETIAPNGYVINEETFGFEIKEDGEIIKHIVKNKKEEKASFPSKPNKPTPNGEVKPSADVKPMQQPSTHNEVRLPATGGVGNEFTVLFVLGLGFIIAGAYVLKMKNRKEM

SEQ ID NO: 27838 - protein, 431 aa, Bacillus cereus MSX-D12; identical to SEQ ID NO: 26428

SEQ ID NO: 27839 - protein, 503 aa, Bacillus cereus NC7401; identical to SEQ ID NO: 26421

SEQ ID NO: 27840 - protein, 240 aa, Bacillus cereus NC7401
MGPVLPVMPVGPVMPVGPVLPVDPVFPVGPVFPVGPVMPVGPVMPVGPVLPVDPVLPEGPVMPVGPVLPVDPVLPEGPVMPVGPVLPVDPVMPVGPVLPVDPVTPVDPVMPVDPVMPVGPVLPVDPVTPVGPVMPVDPVMPVGPVMPVGPVLPVDPVMPVDPVMPVGPVLPVDPVLPVDPVFPVGPVLPVDPVLPEGPVLPVDPVLPEGPVMPVGPVLPVDPVLPEGPVLPVAPLSTKTI

SEQ ID NO: 27841 - protein, 270 aa, Bacillus cereus NC7401
MNSDEKLSLNKGMVRPENIGPTFPVLPPIYIPTGATGVTGATGATGVTGATGATGATGSTGATGSAGATGATGVTGATGVTGATGATGVTGATGATGATGSTGATGSAGATGATGVTGATGVTGATGATGVTGATGATGVTGTTGATGATGATGATGATGATGATGATGATGATGATGPTGVIGPITTTNLLFYTFSDGEKLTYTDSDGLAQYGTTHILSPDEVSYINLFINGILQPHPLYQVSTGQLTLLDNQPPSQGSSIILQFIIIN

SEQ ID NO: 27842 - protein, 298 aa, Bacillus cereus NC7401
MFDENKILQANIFNSNLIGPTLPPIPPFTLPTGPTGETGPTGATGSTGATGSTGATGTTGATGSTGATGSTGATGSTGATGSTGATGSTGATGSTGATGSTGATGPTGATGSTGATGPTGATGPTGATGSTGATGSTEGCLCDCCVLPMQNVLQQLIGETVILGTIADAPNVPPLFFLFTITSVNDFLVTVTDGTTSFVVNISDVTGVGFLPPGPSITLLPPVDSGCECDCRERPIRELLDTLIGSTVNLLASTGSTAASFNVEQTGLGIVLGTLPISPTTIVRFAISTCKITAVNIL

SEQ ID NO: 27843 - protein, 431 aa, Bacillus cereus NC7401; identical to SEQ ID NO: 26428

SEQ ID NO: 27844 - protein, 455 aa, Bacillus cereus NC7401; identical to SEQ ID NO: 26424

SEQ ID NO: 27845 - protein, 558 aa, Bacillus cereus NC7401
MVLAFILMLSTLPSAFAANEVPTKGSLTIHKYAHEKDGQKGEEGTGEPGQKVPEGATPIKGVKYEVVKVATFKVIERNGEIVKEAVEKVDNATPISDVTGEDGTVTFKDLPIGRYLVKEVSGPDNVNINTEPYTIDIPMTDKEGKKLNYDVHIYPKNEIKRGAVELTKVDDAGKPLKDVEFTLYHKGTDKVVVDKAGKELKDLKTDKDGKIRVDGLLYGEYYFKESKALEGYVLDPKKYEFKVEKSGAFPKDGQAGYGEIVKLDKIINYKKPTIDKKINGNLNGLPINVDEEFTYDIKTKLPGDIHLYKKYVITDNVDPRLTIIGTPVVTIDGEKVSSDVVKVTLGEKTAAGQLVTVTVENFAALKDKKELHLQIKAKVNGDINGGTVIENIAKIDYETGDKVTPPDDETTTPPVKVIVTDGKISLKKIDGATKDALEGAKFELRKDGKVVKVKGVDVVGVSDKDGIINWNNIPYGEYEIVEIEAPKYTDKGEVKSYQKLREPIKVKIDKDNQTVKLTVENNKSGWILPATGGIGTILFTVVGLVLMGAAFMFLRRKA

SEQ ID NO: 27846 - protein, 965 aa, Bacillus cereus NC7401; identical to SEQ ID NO: 26426

SEQ ID NO: 27847 - protein, 372 aa, Bacillus cereus NC7401; identical to SEQ ID NO: 26433

SEQ ID NO: 27848 - protein, 849 aa, Bacillus cereus NC7401; identical to SEQ ID NO: 27338

SEQ ID NO: 27849 - protein, 824 aa, Bacillus cereus NC7401; identical to SEQ ID NO: 27339

SEQ ID NO: 27850 - protein, 338 aa, Bacillus cereus NC7401; identical to SEQ ID NO: 27331

SEQ ID NO: 27851 - protein, 971 aa, Bacillus cereus NC7401; identical to SEQ ID NO: 26826

SEQ ID NO: 27852 - protein, 683 aa, Bacillus cereus NC7401; identical to SEQ ID NO: 26432

SEQ ID NO: 27853 - protein, 187 aa, Bacillus cereus NC7401; identical to SEQ ID NO: 26434

SEQ ID NO: 27854 - protein, 339 aa, Bacillus cereus NC7401
MLPVAPVGPVFPVDPVFPVGPEFPVGPVVPVTPVEPVLPVAPVGPESPVAPVIPVGPVLPEGPVFPVGPESPVAPVIPVGPVVPVVPVTPVGPVFPVGPVEPVSPVGPVFPVSPVGPVSPVAPVFPVDPVGPVLPVGPVAPVSPVAPVSPVAPVSPVAPVLPVGPVVPVTPVEPVGPVVPVTPVEPVLPVAPVGPVAPVGPEFPEGPVIPVGPVTPVEPVLPVAPVGPVLPVGPVSPVAPVSPVGPVLPVGPVSPVAPVIPVGPVLPVGPVLPVAPVGPVLPVGPVLPIAPVLPVGPVLPVGPVSPVDPVEPVLPVGPVIPVGDTIVVFGNVGPMTLGS

SEQ ID NO: 27855 - protein, 794 aa, Bacillus cereus NC7401; identical to SEQ ID NO: 26420

SEQ ID NO: 27856 - protein, 570 aa, Bacillus cereus NC7401
MRDRNNKGNANDREWTTMKKIFSLFLICTLAFSTLSNMIVSAESKSTGTLTIHKFEQSKELKTTTEGNGKEGQTVPEDAKPLEGVTFEIKRIESFEKISNDGTVIKEDAKPVKDAAITKVTNAKGEAVFSNLPLGRYEVKAIEGPKHIALDKTTFIVDIPMTSADGKDLNYDVHIYPKNETKRGSVEFVKKGEAGKVLKDAEFHLFKKNKDGTSTQVKTPSSLVTGEDGKVRVDSLEYGDYYYFIEHKAPTGYLTSKEERPFSIKESGEVVKLDDIKNYKEPTITKSINNGSKVAGINKETDYTYDIKTLLPEDIQSYKKYVVKDILDDRLEIKGLPIVMVDGKKVEDGSVKVVVEGQKVTATIEDFSKINGKELHLQITAKIKSDVESGVKIPNKAVLDFVNKDDVSSEKDGKPSNEVVVTPTAGNIKIEKVDGKDKTLKLEGAKFQLQDKKGNVIKVNGKEMNDITDANGIITWNEIPYGEYQIVETEAPKYKDKDGAVEHYQKLRDPINITLDEKHQKIELQVENNKSGWIIPATGGMGTILFTVVGLILMAVATFIFFRKKPVKNS

SEQ ID NO: 27857 - protein, 426 aa, Bacillus cereus NC7401; identical to SEQ ID NO: 26422

SEQ ID NO: 27858 - protein, 456 aa, Bacillus cereus NC7401; identical to SEQ ID NO: 26352

SEQ ID NO: 27859 - protein, 175 aa, Bacillus cereus NC7401; identical to SEQ ID NO: 26353

SEQ ID NO: 27860 - protein, 203 aa, Bacillus cereus NC7401; identical to SEQ ID NO: 27347

SEQ ID NO: 27861 - protein, 336 aa, Bacillus cereus NVH0597-99
MKRSKTYLKCLALSAVFASSALALSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKSFTLDWKNKKLVEKK

SEQ ID NO: 27862 - protein, 372 aa, Bacillus cereus NVH0597-99
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKIAALQEARQDLINKINEIKQSKQTVSDDLSKKKQDLDIKINDFKHTEKKIDDKLAEIHTTKQNIDNKINEVSQSKQTETKTGTTNANNNARELPNAGSEQSNNMALGMLSVLGGILLVTRNKIKTLFSK

SEQ ID NO: 27863 - protein, 592 aa, Bacillus cereus NVH0597-99
MGRKYVIRILALLSVISLFFNLMLPKANAEIEKIPSLKTTAINKADGGKEMHAKEFIMIQDKVEYTNLVVGKEYTVKGKLMNKVINKPLLIDGKEVTAETKFTAKETNGFVTLDFPFVGAEQQGREVVVFEELYQDGVLVATHADINDVGQTVRFVEPTIKTTATNKADGGKEMHAKDSITIQDKVEYKDLIVGKEYVVKGKLMNKVTNKPLLIDGKEVTAETKFTAKEKNGFVTLDFPFVGAEQQGREVVVFEELYQDGVLVAIQSDINDVGQTVRFVEPTIKTTATNKADGGKEMHAKDSITIQNKVEYKDLIVGKEYVVKGKLMNKVMNKPLVIDGKEVTAETKFTAKEKNGFVTLDFPFVGAEQQGREVVVFEEVYQDGVLVAIQSDINDVGQTVRFVEPTIKTTATNKADGGKEMYADESVTIQDKVEYKDLIVGKEYVAKGKLMDKATKKPLLVDGKEVAVESKFTAKEKNGSITLDFTFNASKLQGKEVVVFEELYQDDILVAINVDIEDAGHTVKFKEKKLGKLQPEKPQSEKPQLEKPKTGQTSKAGTLPATGGNTFFMWFSVGSGLLLLTLGAILFMKRRSA

SEQ ID NO: 27864 - protein, 74 aa, Bacillus cereus NVH0597-99
MIQAISSSILNLTINDSIQFAIESRIGGGPGVRATSARTDLLSLNQGDVLRVRIREATGDIIYSNASLVVSKVD

SEQ ID NO: 27865 - protein, 971 aa, Bacillus cereus NVH0597-99
MKGYSKKVLVGVSLASLMLGSFQGSALAEGTKGEQASYRNVLKMEPVGLQLPVQELAHSSKVLENKSFEKRLQFADLSQRPPELKKESKQLATAKIYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGMNTEEGAVNKAPVAVINGPYSGNVNEAISFKSDGSKDEDGKITSYKWEFGDGAVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 27866 - protein, 780 aa, Bacillus cereus NVH0597-99
MKKSKKMLAGATLAIGVMAPQVLPATAHADEKTGEITVNLRILETSDIHVNLMNYDYYQTKTDNKVGLVQTATLVNKAREEAKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTTPPTGEGDNGENPTTPPTGEGNNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 27867 - protein, 369 aa, Bacillus cereus NVH0597-99
MSSWRNNINGYCSCNNQNGVHVDSCCFSCDGTVPKLGPTGPTGATGATGATGITGATGITGITGATGATGATGVTGARGPTGATGATGATGATGATGATGVTGVTGATGITGATGATGATGATGVTGITGATGITGATGITGATGATGATGATGATGATGATGATGATGATGATGATGVTGATGITGATGPTGATGITGATGATGATGATGATGPTGATGPTGEIGPTGVTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 27868 - protein, 564 aa, Bacillus cereus NVH0597-99
MKKLFSMVLVFILMFSTLPSAFAANEAPTKGSLTIHKYAHEKDGQEGEAGTGEPGQKIPEGATPIEGVEYEVIQIASFEVITKDGGIVKEGEKEVKNATPIKDKTGKDGTVKFDNLPIGRYLVKEISGPTNVNLNTDPYTIEIPMTDKEGKKLNYDVHIYPKNEIKRGAVELTKTDDAGKPLENVEFTLYHKGTDKVVVDKAGKELKDLKTDKDGKIRVDGLLHGEYYFKESKALPGYVLDPKHREFKIEKSGAFPKDGQAGYGEIVKLDTIINYKKPTIDKKINGNLNGLPINVDEEFTYDIKTTLPGDIHKYKKYVITDNVDPKLTIIGTPVVTIGGEKVSSDVVKVTLGEKTAAGQLVTVTVENFKALEGKKELHLQIKAKVNGDINGGTEIKNIAKIDYETGDEVTPPDDETTTPPVTVIVTDGKISLKKIDGATKDALEGAKFELRKDGKVVKVKGVDVVGVSDKDGMINWENIPYGEYEIIEIEAPKYTDKGEVKSYQKLREPIKVKIDKDNQTVKLTVENNKSGWILPATGGIGTILFTVVGLVLMGAAFMFLRRKA

SEQ ID NO: 27869 - protein, 431 aa, Bacillus cereus NVH0597-99; identical to SEQ ID NO: 26106

SEQ ID NO: 27870 - protein, 306 aa, Bacillus cereus NVH0597-99
MNIKQSFKLLAMFLSILFVLFPLQKAFAEVMDHTKYQMDWSYSKSKKKPIRTELIKTADGKIAFCLNVDLKSPSGQDLPEMGKVDINVYRVLLNGYPQKSPQELGVSDWREAHYATQLAVWDALKQIDIKDLDFRNKNVEKVTKDIVAKASASEELQEITMSVTPTEEQQAVLKNDFFETGLYTVETNAKSGTYKVQATGAPAGAKFVNEKGETKTEFNVGEKFRILIPKQTPAGGFSFKVIGKLTKLQGIAHKGTPTIQNAVVLLERSEEETSPELSVSWKKGNGHDNNKPHTPNEPHKPNQYKR

SEQ ID NO: 27871 - protein, 503 aa, Bacillus cereus NVH0597-99; identical to SEQ ID NO: 26661

SEQ ID NO: 27872 - protein, 412 aa, Bacillus cereus NVH0597-99
MEKAKGVAKSVAVASVIMSGSIGLQATSAFADSKGTVENLQNGGKVYNSFKTTYDMKQNIKNSIKVSFIEDPYADKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNGGTNNFVSKDTVPALTGYGFSPNVVAVITADKKESTSDLKITNRRISDQYNIEWVSSKWWGTNNKDTYNEFFTNNYKLDWKNHQVTLDNQKAPEEQMIGINNVNNQLNKGKGKLSFSMNGNQLKATSSNAGYGISYEDKNWGIFVNGEKVYTFNEKTTVGNISNDINKLNIKGPYIEIKKI

SEQ ID NO: 27873 - protein, 3592 aa, Bacillus cereus NVH0597-99
MKKSLKCFNVVTIIALLLSITLPSPSAFAEIHKKSWDELQGNDVRIKAEQVNAEIYRGEVAEREHVFQYTIENTGDTPIQELVLKQNNENEITFLSQSMKVNGEKLPENKVADFYVEEKDKGGKLLSSNLKIRDLKSHEKMTVLIKASRTQHFNKEYKQKISVQKDQVQIGSMSFDVEGIPSEDKVEATVDDEADSSKKSVVPSVNNTTKKVDEKLKVSVEDTNKPTSNTELVKQPVTEAEKQPEKEVAKQSDAEVQAASENASKVQIQVGDKQGFGDPLYSTIAAGNLVQTGNVTLGLTTDHYGRQSMGYKTNKMTVDVDNDDSTFNSSTGAFPNIPAGSKVKKAYLFWTAAMGTPSDARTDYRVSDEDVRQPIKMKMGNKQYAEVSADSIRKADYLPYIANHYSSGAGYVAYADVTNVIAKQGISQTVTVANVPQIKFEKGSGYYWGNWNLILVYENYKETVKDMKIWEGLVSQKSTAWTDISVNKINTPKEGAFKAKFSYFSSQGDPAENDGYAWDYGEYDFGLGYQKLKNINGKETDVNDSSMTEVQVDGTNEFVTKKYPGYNPDWTNSFSTDIHTYHLEGPNQVKNDLKEAKMRFRANGATGDIYVLNNATFVTEHNAPNLQVDKKALDSAGKEIKEVKAGEEITYKIEVKNDTKNNQAPVSNVKGFDKLDDRLEYVPGSIQYVTGSNTGQKTDDASDDEAEFVNNQIDFRIGEGADAKDGGVLKPGESAVLTFKVKVKESIKSDTTVKNVVAVKGQDSAEIKYESEDDANVTVTIPKEVPGEIEARKIASNKSPKLGDEVEYRITFKNKVKDGRLDVLTIEDELPSSLEFVKDSLKAEGVQPEPVELKFENGKIIAKYPAITDMEERSIVFKTKVKETAKIGEEIVNKAIVSDKTNPPKNIEEKITPQHKAGKIDAKKKATNKKPKLGEEFEYQISFNNTVENGKLEAVTIEDEIPANLEFVQGSERAEGAGPSPVELKVENGKVIAKYPEITDTKERSIIFKVKVKEEAKAGETIVNKAVVSDPNGQSEHPEEKVTPDYKDGKVDVDKSVTNQTPKLGEEVEYRITFHNTVENGKLEKVMIEDTLPAGVAYVKDSLKAEGIKPEPVELKMENGKIIAKYPEITDTEKRSIVFKVKVKDSAKVGEAIVNKAIAKDPKNKPVESDVVITPQSKKGEIAATKVVNNKKPKLGEEIEYRISFHNMVENGKLAEVRVEDTIPKGLEYVENSIKAEGEAPSPVELTVEAGVVKAKYIDITDTKERSIVFKVKVKEEVEVGKEIVNKAIVDDTKHQPIEPEERITPQHKDGIINAAKAVDNPSPKLGEEVEYRISFKNTVENGKLEKVKIEDTIPNGLEYVKGSEKAEGDKPAPVKLHVKDGKVIAEYENITDTKERSIVFKVKVKEEAEIGKEIVNQAIVDDTKDSKKPEAKITPLHKDGKIKAKKSVNNETPKLGEEVEYRISFKNAVENGKLAEVKIEDTLPEGLEYVENSLKAEGAGPNPVELKMENGKVMAKYPEITDIEERSITFKVKVKEEVKVGEKIVNKAIVDDTKHDPINPKAEITPQYKDGKIEAEKVVNNPSPKLEEEVEYRISFKNTVEHGKLAGVIIEDDLPNGLEYVKGSLQAEGSKPDPVELKFENGKVMAKYPEITDTKERSITFKVKVKGNVSDTIINQAIVSDTKHPPETPKAEIIPQHKDGKLEAKKVVNNLLPKLGEEVEYRISFKNTVENGKLAEVKIEDTLPEGLEYVENSLKAEGAGTDSVELKFENGKIMANYPEITDTKERSITFKVKVKDEVKIGGKIVNKAIIDDTKKEPETPTAEITPQHKDGKVEAEKTVNNPSPKLGEEIEYRISFKNTVENGKLAEVKIEDTLPNGLEYVKDSLQAEGSKPNPVELKVKDGKVIAKYPEITDIEERSIVFKAKVKEDFKVGEGIVNKVVVDDTKDPKTREVTVTPEYKDGKLKAEKFVNNKKPKLGEEVEYRINFKNTVENGKLVEVKVEDEIPAGLEYVENSLQAEGSKPNPVELKFENGKVMAKYPVITDTKERSIVFKAKVKEEAEIGKEIVNKAIVVDTTHEPEKPYVEITPQYKDGKIVAEKVANNHKPKLGEEVEYRIRFKNTVENGKLAEVNIKDTLPKGLEYVEGSITAEGSKPKPVELKVENGKVTAKYPAITDTEERSIVFKAKVKESVKAGEEIVNEAIVDDTKNVPEEPYVPITPQYKDGKIEARKEVSNYEPKLGEEIEYRIIFNNTVKDGKLAEVKIEDEIPAGLEFVQGSEKAEGAEPKPMELKVENGKVIATYAEIMDTEERSIVFKVKVKESVTIGKAITNKAIIHVDDPNHPIIEPTAKITPQYKDGKVKADKKVSKKDPKLGEEIEYRISFSNTVKDGKLAEVKIEDEIPSGLEYVKDSLNAEGDKPAPVELKEEAGKVTAKYENITDTKERSIIFKVKVKDTAEVDKAIVNRAIVDDTKNPPERPEVEITPQYKEGKVKADKKVSKKDPKLGEEVEYRISFKNTVENGKLAEVKIEDQLPAGLEYVKDSLKAEGNEPNPVELKEEAGKITAKYENITDTAERSIVFKVKVTEAVKVGKEIVNTAIVDDHNPKNPLQKPEAIITPEYKDGKLKAEKTVNNSAPKLGEEVEYRITFRNVVEHGKVAKVKIKDELPTGLEFIEGSERAEGENPKPLHVKVKNGIVLAEYPEIVDTKERSIIFKVKVKEKAKVGEEIVNTAVVEDTINPPEQPNIAIQPQYKDGALQAEKTVSNQEPKLGEEVEYRISFENTVENGRLTEVKVEDEIPAGLEYVQDSIKSDGPEPNPVELKVENGKVTAKYPEITDMKKRSIIFKVKVQETVQVGKEIINKAIVDDNNPTTPPVESLIPITPQYKDGKLEARKEVSNHEPKLGEEIEYRITFNGTVDGGKLVDVKIEDEIPAGLEYVKDSLEAVGDKPVPTELKVENGKVTAKYPEITDTKERSIIFKAKVKETVKVGGEITNKAIIHVDDPNHPVIEPTATIKPEYKDGKLKATKVVSNKEPKLGEEVEYRISFKNTVENGKVAEVKVEDEIPAGLEYVQDSLRFEGAEPNPVELKVEFGKVIAKYLDIADGKERSIIFKAKVKETVETGKKIVNKAIVGDTINQPEEPVVSITPQYKDGMLKAEKEVSNKEPKLGEEVEYRISFKNTVENGKLAEVKIEDQLPDGLEYVKDSVKAKGAIEVKVENGKLTAKYENIIDTKERNITFKVKVKEKAGEEIVNRAIVDDGINQPLEPTVSIKPKEPEVKPEDPKEPEVKPEDPKEPEVKPEDPKEPEVKPEDPKEPEVKPEDPKEPEVKPEDPKEPEVKPEDSKEPEVKPEDPKEPEVKPEDPKEPEVKPEDPKEPEVKPEDPKEPEVKPEDPKEPEVKPEDPKEPEVKPEDPKEPEVKPEDPKEPEVKPEDSKEPEVKPEDPKEPEVKPEDPKEPEVKPEDSKEPEVKPEDPKEPEVKPEDPKEPEVKPEDPKEPEVKPEDPKEPEVKPEDPKEPEVKPEDLKEPEVKPENPKKPEVKLEKPEVRLEKLIKEPQVKVERELPKTGAASPWMMSVGAGISFLVGGVLFVLGRRRKQ

SEQ ID NO: 27874 - protein, 910 aa, Bacillus cereus NVH0597-99
MEGNSGESKIKSSLNSNFKLSSGLVGPTFPPVPTGMTGITGSTGATGNTGPTGETGATGSTGVTGNTGPTGETGVTGSTGPTGSTGVTGNTGATGPTGSTGATGSTGATGSTGPTGSTGVTGSTGATGSTGVTGNTGATGSTGATGSTGPTGSIGATGSTGATGSTGVTGSTGATGSTGVTGNTGSTGETGPTGSTGAIGNIGPTGSTGATGSTGPTGSTGATGNTGPTGETGATGSTGVTGNTGATGATGPTGSTGAIGNTGPTGSTGATGNTGPTGETGVTGSTGPTGSTGATGSTGPTGSTGVTGNTGATGPTGSTGETGATGGTGVTGNTGPTGETGVTGSTGPTGSTGVTGNTGATGSTGVTGSTGATGSTGVTGNTGATGSTGATGNTGPTGSTGVTGSTGATGNTGATGNTGPTGSTGPTGETGATGPTGSTGETGATGGTGVTGNTGPTGETGVTGSTGPTGSTGVTGNTGATGSTGVTGSTGATGSTGVTGNTGATGSTGATGNTGPTGSTGVTGSTGATGNTGATGNTGPTGSTGPTGETGATGPTGNTGTTGETGPTGATGAGGSTGPTGSTGVTGSTGATGNTGAMGNTGPTGETGVTGSTGPTGSTGATGSIGPTGETGATGSTGPTGEAGATGSTGVTGEAGATGSTGVTGSTGVTGNTGATGETGVTGPTGSTGATGETGPTGSTGVTGNTGATGSTGPTGSTGATGSIGPTGETGATGSTGVTGSTGVTGSTGPTGSTGTTGNTGVTGDTGPTGATGVSTTATYAFANNTSGSVISVLLGGTNISLPNNQNIGPGITVSGGNTVFTVANAGNYYIAYTINLTAGLLVSSRITVNGSPLAGTINSPTVAAGSFSATIIASLPAGAAVSLQLFGVVALATLSTATPGATLTIIRLS

SEQ ID NO: 27875 - protein, 3314 aa, Bacillus cereus NVH0597-99
MKKLFNICLIVFVLFSQFISFPYNQAKAETLQDTSLFDTVEMKDATDHIIDGAKNPNNLIKIGSTIQVEYAWSIKDQQVVHANDTAVIQIPLALKVSKDLQGDLVTDQKNIGQYFITAKDNKLKLIFNDQVENSKDAKGKIKIDTVFNPTLKAEEKSVQIAFPLGTLVQPITVPIQVEDSKEDGTKQDTNKQVPDQVAKPATDNPEQNPATKPATDNPEQNPATKPATDNPEQNSATKPATDNPEQNPATKPATDNPEQNPATKPAADNPEQNLASDPAESTNSGPKQITTNILTGVKLTDKDGKPFTEDNRPSTDSPANIEFTWELLKSMNVKSGDYYIFDLPKHFKIYNTINSPLYDSENNPIGNFTVTKDGKVTMTFNDYVEEHPDVVGNLQLKTEFNKAEIKGTTTQEIPFPIKDKDVSITVDFKPNIQTTTNKKGLPDRPINTNEINWTVEMNKTKDTLKNAVFKDNIPQGTSLNKDSIKVYYLEVDVNGNATRGKEADPADYKIISSDGSKLEIAFKDSIKEAYQIEYVTKITDENVKNFQNNVTITSDNQGQQKASSTVTVSRGTHLNKTSKYDPKTQTIEWTITYNGDQRNIKKTDALLKDIFDDTHELDVNSIVVKNASYDDKGRLVTGDAVNNYTVSNKKNGFDLQFNEDINSAYVITYKTKPTNNVIKDGKIKNIVTADNGSSKENEAGFQQQNIIKSNNKAETNYKDKTTTWTITVNNNNYPLNNAIITDTFDHGGLQLKDKKLEIKDGDYTLQAGTDYVLDVTDKGFKITLIGTYQSNMTKTLVVKYTTDFDYTKLESGKTSFKNTGNLSWIDTDSNPQSNKVEANFDPDNFTKANGYKYGSYNAQTKEITWVIGFNYNNVEIKDPYVIDVIQDKQKLVPGSIEVRDMILNGSPDNAQPGNAVPTEKYELEEPTEKNKNTLKVHFKQSINSPYYIIFKTSLDGELIQGTYKNEAELKDGSKIVNTLKGDAQVKKGGSFVTKKAVQDDNYINWSIAINESQSTITDAVVTDDPTDNQVLVEDSFHLYPTTVDYYGNVTKDTANELKQGTDYKLKITTDNNTGKQHFEIAFLKKIDRAYILEYRSLINADDKEKVSNKAKIAGNQLTVKNTETTETIEVRMSSGSGGGSATKGRGNLEIIKVDNDNKNTLLTGAEFTLYDRTGKTVIRKITTDKDGIAKFNNLKRDKYLLKETKAPEGYVISWDLKQGKIVALGTQETTTYKLANKKFVGKVVLTKSDDLNKNVTLQGAVFTLLDKDKKIISEHEKLTTNNKGQITVEHLKPGTYYLKETKAPEHYKLDDRLIEVKIAEDQTTVINRTATNSLIPGSAILTKVDKDGKTLTGAEFSVRDRHNNVIRGYEKLTTNDQGQIEATNLRPGDYQFVEEKAPKDYDIDKTPIEFTIVKSQKKAVTVTATNHLIKGGVTLTKTDDIDGTALAGAIFKIVDANDEKKVIRENVKTGTDGKVTVKDLEPGTYKFIETEAPKDYVLNANPIEFTIDKSQQSFATVTATNSLKTGEVELLKVDEFGDKKPLKGAVFKIVDVNNNDVRTDLTTDADGKTKADKLRPGTYKFIETAAPEHYVLRAEPIEFTIDRSQKETLLVKAENALKPGDVELTKVDDIDGTALAGAVFKIVDANDEKKVIRENVKTGADGKAIATGLRPGDYKFIEVTAPKYYDKNTKPIEFTIKESQGISPITVTAKNSLTKGGIELTKVNAADEKETLEGAVFKIVNRDTNEDARTNLVTNSEGKLVVDDLRPGNYKLIETKAPTYYDVNVEPIEFTIEKGQQTLLPLTFKNSLTKGKVKLIKEDDVESSIALAGAVFTLQDANGTEIAKDLKTDEHGVLVIPDLAPGDYQFIETAAPEHYKLDQTPIKFTIKKGSKDDLPVPVTVKNSLLTGGVTLTKVDDVDGTTLEGAEFIIVDAHDTEKVVRKGLTTDEHGKVSASDLRPGDYQFIEVKAPKDYTLGNDPIPFTIGKSQKENITVTATNSLKKGAVTLTKIDDIDRTMLKGAIFKIVDMDGNEVRTNLVTDKNGKIYVPDLRPGDYQFIETKAPEHYVLDETPIPFTIERSQTKEINVTGKNTLKKGSVELTKIDDIDTDTKLANAVFNLLDADGEIVEEGLTTNAEGKIVVENLRPGTYQFVETIAPEHYDLNKTPIEFTIKKSQTETLHVTAKNALTKGAVELSKVDDIDGTKLEGAVFNIVDMNGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKKPIVVTVEKSQKNIATVTMKNSLTKGGVELSKVDDVDGTTLEGAVFNIVDMNGTVIRKSLTTNSQGKISVPDLRPGDYQFIETKAPKHYDLNKEPIPFTIEKGQAEPISVTAKNSLTKGAVELSKVDDIDGTALEGAIFKIVDMNGHDVRTGITTDAKGKISISDLHPGDYQFIETTAPKHYKLDATPIKFTIEKSQAEKLQVTAKNSLIEGAVELIKVDDITPDTKLSDAVFNIIDAKGKVVRTNLTTDKDGKISASNLRPGDYQFVEMKAPKDYDLNETPIPFTIEKSQSTHVSVTAKNGLTKGGVELTKIDSLDTKETLEGAVFKITDLNGNDIRTNLVTNKDGKIIAKDLQPGDYQFIETKAPKHYDLNETPIKFTIERSQTKHVFVTAINSLTKGSVELIKVDDVEENTTLEGAVFKIVNKDGHNVRTDLTTDKNGRLVVDELPPGDYEFIETKAPTHYKLNETPIKFTVKKGQEKIASVTATNSLTKGAVELSKVDDIDGSALKGAVFKIVDMNGNDVRTDLTTDKDGKISVSDLRPGDYQFIETKAPTHYDLNQTPINFTVEKSQTATASVTAKNSLTKGAVELTKVDDIDGTTLEGAIFKIVDQNGNDVRTDLTTDKDGKISVSDLRPGDYQFIETKAPKHYDLNQTPINFTVEKSQTATASVTATNSLTKGAVELTKVDDIDGATLEGAVFKIVDMNGNDVRTDLTTDKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPETHGKETSEELENGNPKTQTNKQHDDRNTGKELPNTGHKNDSTQTVGIILLLAGLLSVLATKRKKYY

SEQ ID NO: 27876 - protein, 965 aa, Bacillus cereus NVH0597-99
MNKKSKINKVMLSISTMALSLGALQAPVLAEEKVPYNVLKTKPVGIEKPVDEIGHVSKAEETLSFQERLKVGDFSQRPASITNKATVKQVKESYSMADLNKMNDQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHASKSLTAVEKEITETLPMRDAKMTKHSSQFFNTFTLEGTYTGSVTKGESEDWNAMSKKVNEALEQLAQKEWSGYKTVTAYFVNYRINSSNQFEYDVVFHGIAKDDGENKAPTVNINGPYNGFVKEGIQFKSDGSKDEDGKVVSYLWDFGDGSTSAEVNPVHVYEREGSYKVALIVKDDKGKESKSETTVTVKDGSLTESEPNNRPEEANRIGLNNTIKGSLIGGDHTDVYTFNVASTKNINISVLNEYGIGMTWVLHHESDMQNYAAYGQANGNHIEANFNAKPGKYYLYVYKYDNGDGTYELSVK

SEQ ID NO: 27877 - protein, 148 aa, Bacillus cereus NVH0597-99
MKKKLLPICAIALLTVGYSSVASADTGTVTKEEATQLQQDKAKKEAAIKEQQKIEEEKKRIAQEQLKNDMAKKEEAIKAQQKSEEGKKEAAQVQQKNAATKKEVAKPAVQGEKLPNTASNNVVMMGLSACLVAIGTLFGLKRRNKVKA

SEQ ID NO: 27878 - protein, 455 aa, Bacillus cereus NVH0597-99
MNNRLLKQLQNMKMNKKSLGAVALTAGIIGTTLIPQNTYAHGFVEKPGSRSALCSPTYGALNVNCGSVMYEPQSLEAPKGFPQGGPVDGQIASAGGKFGGILDQQTADRWFKNTITGGENTFTWKYTAPHLTSKWHYYITKKGWDPNKALTRADFEPIGTVQHDGSAASNHLTHKINVPTDRSGYHVILAVWDVADTANAFYNVIDVNLINDVKPDTEAPSIPNRIQAQKVTANSIELAWNASTDNVGVKGYQIFRNGEMIDTVTGPHFIDKKLQPSTEYSYTVKAIDAAGNVSKESATLTVKTTVEAPDTEAPTQPKGLHSMGTTASSVDLMWSPSDDNIGVDHYDIYREIEGSMKKIVTSNTTSYMDKNLLPNTTYKYVVKAVDVAGNESVQSDIFIITTKTESASYEEWDAKKAYEKGDRVLHEGKVYEAVQSYKGNGDPNWIYALSLWKTV

SEQ ID NO: 27879 - protein, 333 aa, Bacillus cereus NVH0597-99
MKGKLLKGVLSFGIGLGVLYGGSSAQADTSIDQNNTLKVMTHNVYMLSTNLYPNWGQSERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 27880 - protein, 213 aa, Bacillus cereus NVH0597-99
MYKKMGTIALAGALAFSLAACGSNEKTSNGVETKEKEQPKQETKKDNSKEGKTESTKGNRSNPIAFNETASIDDVILNTDGGEFKKFKAKVEVSVLEVIRGEQAFGILKKENEFNEPAPEGKEWVLVKVKGKVVDAETQDFEYLLSDMNFKLVSKEGQVYNHELSAVTPNQLHQKLYKGAEGEGYISQVVNTGDDFTIQFETHKQNKVFFKSK

SEQ ID NO: 27881 - protein, 553 aa, Bacillus cereus R309803
MKKIFSMLLIFALTFSMLPSMFVSAASKNTGSLTIHKYAQEKNGELGVDGDGSANQTLPEKVSPLKGVTFEIKQIASFEKISNDGKIVKENVKPVTNAESIKMTTTDKGEAVFTNLSLGRYEVKEVAGPEHVNLNPHTYTVDIPMTSKTGDVLNYDVHMYPKNEIKRGAVELTKTGAKDKVLSGVEFSLYTEDGKVVKEKLVTGTDGKIRVEGLEYGKYYFQEKEAPKGYVKDLTKHEFSITESGTLNEDGSITSGKVETVEVKNYEEPSIDKKINKDLEFLPINTQTDYNYDIKTLIPEDIKDYKQYVVTDTLDNRLVIQGKPVVYIDGVEVDSSVVEVVVEGQKVTATVKDFSKLNGKKELHLQIKSQIKEDVAAGTKIPNTATIDFENNNNVKDQKESKPVIVVPTAGSIELTKVDGADNKKLQGAEFELQDKKGNVVVVGKQEVKGVSDENGIITWNNLPYGDYQVVETKAPTYEKEDGTKASYQKLRDPINVTINAEHKKIELKVENNKSGWVLPSTGGMGTMLFTVVGLVLMAVAAFVFFRRNTAKN

SEQ ID NO: 27882 - protein, 955 aa, Bacillus cereus R309803
MISISTMALSLGVIQTHVSAEEKVPYNVLHSKPVGIEKPVDEIGHVSKVEETLSFQERLQVGDFSQRPASIMKSSEVKQMKENYSMADLNKMNGQELVETLGSIKWNQITDLFQFNEDAKAFYKDKGKMQVVIDELAHRGSTFTKDDSKGIQTFTEVLRSAFYLAFYNNELSDLNERSFQDKCLPALKAIATNPDFKLGTYEQDSVVSAYGKLISNASSDVETVQYASSILKQYNDNFHTYVNDRMKGQAVYDMMQGIDYDMQSYLFETRKEAKDTMWYGKVDGFINEINRIALLNEVTTENKWLVNNGIYFASRLGKFHSNPNKGLEVVTQAMHMYPRLSEPYFVAVEQITTNYNGKDYSGSTVDLETIRKEGKEQYLPKTYTFDDGSIVFKTGDKVSEEKIKRLYWAAKEVKAQYHRVIGNDKALEPGNADDVLTIVIYNTPDEYQLNRQLYGYETNNGGIYIEETGTFFTYERTPEQSIYSLEELFRHEFTHYLQGRFEVPGLFGRGDMYQNERLTWFQEGNAEFFAGSTRTNNVVPRKSIISGLSSDPASRYTAERTLFAKYGSWDFYNYSFALQSYLYTHQFETFDTIQDLIRANDVKNYDAYREKLSKDSKLNKEYQEYMQQLIDNQDKYNVPEVADDYLAEHATKSLTAVEKEISETLPMKDAKMTKHSSQFFNTFTLEGTFTGSVTKGESEDWNAMSKRVNEALEQLAQKEWSGYKTVTAYFVNYRVNSSKQFEYDVVFHGIAKDDGENKAPTATINGPYNGLVKEGIQFKSDGSKDEDGKIVSYSWDFGDGSTSAEVNPVHAYEREGTYKVALIVKDDKGKESRSETTATIKDGSLAESEPNNRPEEANRIGLNTTIKGSLIGGDHTDVYTFNIASAKNIDISVLNEYGIGMTWVLHHESDMQNYAAYGQANGNHIEAKFNAKPGKYYLYVYKYDNGDGTYELSVK

SEQ ID NO: 27883 - protein, 333 aa, Bacillus cereus R309803
MKGKLLKGVLSFGIAAGALYSGTSAQAETSTNQNDTLKVMTHNVYMLSTNLYPNWGQSQRADLIGAADYIKNQDIVILNEVFDNSASNRLLGNLKKEYPNQTAVLGRSNGNEWDKTLGSYSSSTPEDGGVAIVSKWPIVEKIQYVFAKGCGPDNLSNKGFVYTKIKRDDRFVHVIGTHLQAEDSMCGKTSPASVRTNQLKEIQDFIKNKNIPNDEYVVFGGDMNVNKINAENDSDSEYASMFKILHASIPSYTGHTATWDATTNSIAKYNYPDAPAEHLDYIIASKDHANPSFVENKVLQVKSPKWSVTSWFKKYTYDDYSDHYPVEATISMK

SEQ ID NO: 27884 - protein, 209 aa, Bacillus cereus R309803
MLKKFTTCILGGALVFNLSGCGNTSDKTSSESKETNSKQEEKKVQTTDEAKTKENTKQKNTEQTKENSKIKEKEYAVNKDFHTPKFDVTVKRVVERDRVGKESIGFQKPEDGHVFIVVEAEGKNITNESMKLAVLPSVDLVDENDNAYQSDVLAASSYEVEKGETYSITKELKPGEVRRQNKVYVINKEKFDTGKWYVVVNREYKEQIK

SEQ ID NO: 27885 - protein, 503 aa, Bacillus cereus R309803
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQSVKGVKEVTTKITEKDAIQKSMAYVGEASEQNLWAPTEKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQGLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNAKFRDGAKAIKQADALLYGGQHAADIDRIWAARGISTN

SEQ ID NO: 27886 - protein, 456 aa, Bacillus cereus R309803
MNKKILGQFRKMATNKKGLSAAAVAVGIMSTTLIPQNAYAHGFVEKPGSRAALCSQNYGALNSNCGNIMYEPQSLEAPKGFPQGGPADGKIASAGGLFGGILDQQTADRWFKNTIKGGENTFTWKYTAPHSTSQWHYYITKKGWNPNKPLTRADFEPIGTVKHDGSKASNNLSHKINVPTDRSGYHVILAVWDVADTVNAFYNVIDVNLINDEKPDTEAPAQPSGLQVVKTTSNSVELNWKPATDNVGVKEYQVLRNGELINTVVGTSVIDKKLNPNTEYTYTVRAVDAAGNISEKSEALVIKTTEEKPDTEAPTQPKGLHSMGTTTSSIDLMWSPSEDNVDVSHYIVYREVGGAMKEIGTANTTSFMDKDLQANTVYKYVVSAVDTSGNESMKSDAITVTTKGQENSYEQWDARKAYKAGDRVVHENKVYEAVQSYQGNGDPNWIFALSLWKEVN

SEQ ID NO: 27887 - protein, 374 aa, Bacillus cereus R309803
MKTKQTIAASTLALAMIAGANSAHAEVTDATPQQSTGDRLAEIKQHRQELDAKLQQHKENVDQKLNELNQVKENVDTKVNELHERKQVADEKINEMKQRKEELDAKLQQDKQIAEDKIAEMKEHKKQVEDKVAEVKEHKQNIDNKVNEIKEHKQTIDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIEDKLAEVHTTKQNVDNKINEVSQSKQTQTDNNNTTAPAKNNARELPNAGSEQSNNMALGMLSVLGGVLLVTRNKIKTLFSK

SEQ ID NO: 27888 - protein, 971 aa, Bacillus cereus R309803
MKGYSKKVLVGVSFASLMLGSFQGNISAEDTKREQVSYRNVLKMEPVGVQLPVQELAHPSKVLESKSFEKRLQLADLSQRPPEVKKESKQLVATKTYTIAELNQLSNQQLVDLLVTIDWEQITGLFQFNKDSLAFYQNDSRMQAIIDKLKQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSALVDNLSAGNAIYDIMQGVDYDIQSYLYDTRKVPKDTIWYQKIDSYINELSRFALIGTVTAKNGWLINNGIYYTGRLGTFHSTGTKGLQVVTDAMKMYPYLGEQYFVAAEQIATNYGGKDANGNVVDLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYVATHATKPVSEITAEITAEAKLSNVSVKKNKSQFFNTFTLQGMYTGTTAKGEYEDWKTITQNVNDTLKRLSAKDWTGYKTVTAYFVNYRVNAAGQFEYDVVFHGINTEEGAVNKAPVAVINGPYSGNVNEAISFKSDGSKDEDGKIVAYKWEFGDGTVSNEQNPTHVYTKEGTYTAKLTVTDDKGLTNAVTTNVTVQKKEDNSVEKEANNSFQTANKLQLNQVLRASLGNGDTSDFFEINVETAKNLQINVTKENNIGVNWVLYSEADLNNYVTYAQQQGNKLVGSYYTYPGKYYLHVYQYGGGTGNYTVEVK

SEQ ID NO: 27889 - protein, 774 aa, Bacillus cereus R309803
MLAGATLAIGVIAPQVLPTTAHADENNGESTVNLRILETSDIHVNLMNYDYYQTKTDNKVGLVQTATLVNKAREESKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVDGKWEVQKEQSKPQLRPIADSKGNPLVQSDQKLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKTVADNQEFIVATNNYRGSSQTFPGVSKGEVVYQSQDETRQIIVKYMQETPVIDPAADKNWTFKPIVADKLNTTFDSSPNAQKYIKKDGKISYVGPSENEFAKYAIDITKKNDDKETGGENPTTPPTGEGNNGENPTPPPTGEGNNGENPTPPTGEGNNGENPTTPPTDEGNNGNNAGNGQTTTDNQNTKETTVSENKEERDLPKTGTSVVSTIGAGLAFVGAGFLLLFRRKKANR

SEQ ID NO: 27890 - protein, 99 aa, Bacillus cereus R309803
MTVSGGNTVFTAANAGNYYISYTINITASLLVSSRITINGAPLAGTINSPALATTSFSATIITTLAAGSAISLQLFGLLAIATLSTTTPGAVLTIIRLS

SEQ ID NO: 27891 - protein, 162 aa, Bacillus cereus R309803
MKKKLLPICAMALLTVGYSSVASADTGTVTKEEATQLQQDKAKKEALIKEQQKSEEEKKRISQEQLKNDMAKKEAAIKEQQKSEEEKKRLAQEQLKNDMAKKEAAQVQQKNGATKKEVAKPAVQGEKLPNTASNNVAMMALSACLVGIGTLFGLKRRNKVKA

SEQ ID NO: 27892 - protein, 431 aa, Bacillus cereus R309803; identical to SEQ ID NO: 26106

SEQ ID NO: 27893 - protein, 128 aa, Bacillus cereus R309803
MTEELNELEKPEVTEKPEIRVDLEEEEQVEVEVTEELQGERLEEPKVTEELNVLEKLEVKEQPEVSNKPEAQGKVEVQNKSEVPSSKENNKQSKSLPQTGGASTESASTLAGMFALIMGAMLFRRPKK

SEQ ID NO: 27894 - protein, 570 aa, Bacillus cereus R309803
MLPKASAEIEKIPSVKTTATNKADGGKEMHAKESITIQDKVEYTNLVVGKEYTVKGKLMNKVTNRPLLIDGKEIKAETKFTAKEKNGFVTLDFPFVGAEQQGREVVVFEELYQDGVLVATHADINDVGQTVRFVEPTIKTTATNKADGGKEMHAKDSITIQDKVEYKDLIVGKEYVVKGKLMNKVTNKPLLIDGKEVKAETKFTAKEKNGFVTLDFPFVGAEQQGREVVVFAEVYQDGVLVAIQSDINDAGQTVRFVEPTIKTTATNKADGGKEMHAKKSVTIQNKVEYKDFIVGKEYVVKGKLMNKVMNKPLLIDGKEVKAETKFTAKEKNGFVTLDFPFVGAEQQGREVVVFEEVYQDGVLVAIQSDINDVGQTVRFVEPTIKTTATNKADGGKEMYANESVTIQDKVEYKDLIVGKEYVAKGKLMDKATKKPLLVDGKEVAVESKFTAKEKNGSITLDFTFNASKLQGKEVVVFEELYQSDILVAINVDIEDAGHTVKFKEKKLGKPQPEKPQSEKPQSEQPKTGKTSKAGTLPATGGNMYFTWFSVGAGLLLLTLGAILFMKRRNA

SEQ ID NO: 27895 - protein, 163 aa, Bacillus cereus Rock1-15; identical to SEQ ID NO: 26509

SEQ ID NO: 27896 - protein, 949 aa, Bacillus cereus Rock1-15; identical to SEQ ID NO: 26797

SEQ ID NO: 27897 - protein, 176 aa, Bacillus cereus Rock1-15
MYKKLGTIALTGALAFSLSACGETEVKEVSKNDAPKQAEKKDKKEKAESKIYKIGDTVEVNGLQLTFSSAKFVEPNEYVKAEKGKVLEIGFNAKNNGKKDIYFGTSELKIADTNGNQFKEYFGGENTFINENIAPGNQITNKMLFDVPEGDKFVGTFKPTFTFDEKSVKFEFEVAK

SEQ ID NO: 27898 - protein, 333 aa, Bacillus cereus Rock1-15
MKGKLLKGVLSLGVGLGALYSGTSAQAEVSTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTNQLKEIQDFIKNKNIPNNEYVLIGGDMNVNKINAENNNDSEYASMFKTLNASVPSYTGYTATWDATTNSIAKYNFPDSPAEYLDYIIASKDHANPSYIENKVLQPKSPQWTVTSWFQKYTYNDYSDHYPVEATISMK

SEQ ID NO: 27899 - protein, 209 aa, Bacillus cereus Rock1-15
MLKKFTTCILGGALVFNLSGCGNTSDKTSSESKETNSKQEEKKVQTTDEAKTKENTKQKNTEQTKEKSKIKEKEYAVNKDFHTPKFDVTVKRVVERDKVGKESIGFQKPEDGHVFIVVEAEGKNITNEPMKLAVLPSVDLVDENDNAYQSDVLAASSYAVEKGETSTITKELKPGEVKRQNKVYVINKEKFDTGKWYVVVNHEYKEQIK

SEQ ID NO: 27900 - protein, 183 aa, Bacillus cereus Rock1-15
MRKLSILLTFILVLVSVTAACTQDKTDSAVENGSIEEPTAKNENEELINFEEKEDMSRLEQGILLVGESVKGGYYLTAVQSAYLNASNDSVVVNVSVKNVRGQTIGLSELKYNLKDEKDGKIYKGKVLDQNPSDIQVKPNETVELKIAFEVPRTADEYMFYIESSLDPLQTYWKIDKLQSQTN

SEQ ID NO: 27901 - protein, 336 aa, Bacillus cereus Rock1-15
MKRSKTYLKCLALSAVFASSAVTLSTPATYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKLFTLDWKNKKLVEKK

SEQ ID NO: 27902 - protein, 503 aa, Bacillus cereus Rock1-15; identical to SEQ ID NO: 26634

SEQ ID NO: 27903 - protein, 163 aa, Bacillus cereus Rock1-15
MSRKDRFNSPKIKSEISISPDLVGPTFPPIPSFTLPTGITGPTGNTGPTGDTGPTGPTFNINFRAEKNGAQSFTPPADIQVSYGNIIFNNGGGYSSVTNTFTAPINGIYLFSANIGFNPTLGTTSTLRITIRKNLVSVASQTIDIQFSAAESGTLTVGSSNFF

SEQ ID NO: 27904 - protein, 572 aa, Bacillus cereus Rock1-15
MKKIIFDDGSIVFKTGDKVTEEKIKRLYWTAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSIISGLSSDPASRYTAKQTLFAKYGSWDFYKYSFALQSYLYNHQFDTFDKLQDLIRANDVKNYDAYRELLSKNTQLNAEYQAYMQQLTDNQGKYNVPQVTNDYLIQHAPKPLAEVKNEIVDVANIKDAKITKHESQFFNTFSVEGTYVGGISKGESEDWKTMSKQVNQTLEQLSQKGWSGYKTVTAYFVNYRVNAANQFEYDIVFHGVATEEKEKTTTIVNMNGPYSGIVNEEIQFHSNGTTSENGKVISYLWNFGDGITSTKANPTHIYGEKGTYTVELTMKDSRGKESIEQTKVTVKQDPQTGGSLEEEKILPFNTLVKGNLVTPDQTDVYTFNVTDPKEVEISVVNEQNIGMTWVLYHESDMQNYVACGEDEGNTIKGKFVAKPGKYYLNVHKFDDKNGEYSLLVK

SEQ ID NO: 27905 - protein, 893 aa, Bacillus cereus Rock1-15
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILTTSVSTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLMAQGGTHNGVNVNGIGEDRMFDIFYYANTDELNMTSNFSELKLACLKVATNKYGANSIEVQAVQNAFDAAKITGTVKENEKTAENQAPELTVPFTITLRVGDTFDPMRNVKAVDKEDGDLTNKVKHKGDVDTSKPGTYIVEYLVVDSQGRNTTARQTVIVEGNGETSDLEPKLIVPVGATIHVGDSFVPMAEVLAIDKEDGDLTSKIKVDGEVDTTKAGTYVLTYTVTDSKGHEVTAKQTVTVKVREEVKNDKPILKVPATTSITEGDQFDPLVGVSATDKEDGDLISKVAYEGTIDTTKAGTYEIIYSVRDSVGNEVNAIQKVLVKDKETSKANGLANKENKSNISNNSNSDKKEYTYKELPKTGVSTTNSAAIGILMIITGTVLTFVRKFRKIQK

SEQ ID NO: 27906 - protein, 563 aa, Bacillus cereus Rock1-15
MIEVVKGIREMKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGALFSLFKKDGTEVKKELVTDANGHIRVQGLVYGEYYFQETKAPKGYVIDPTKREFFVKNSGTINEDGTITSGTVVKLEVKNYEEPTIDKKINGKLEALPINPLTNYNYDIKTLIPEDIKEYKKYVVTDTLDNRLVIQGKPIVKIDGAEVNASIVEVAIEGQKVTATVKDFTKLDGKKEFHLQIKSQVKEGVPSGSEIFNTAKIHFSNKNDVIGEKESKPVVVIPTTGIIELTKIDGANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 27907 - protein, 117 aa, Bacillus cereus Rock1-15; identical to SEQ ID NO: 27259

SEQ ID NO: 27908 - protein, 455 aa, Bacillus cereus Rock1-15
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGSILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVLGTHFIDKKLQPSTEYSYTVKAIDAAGNVSKESAALTVKTTVETPDTEAPTQPKGLHSMGTTASSVDLMWSPSDDNIGVDHYDIYRETEGAMKKIATSNTTSYLDKNLLANTTYKYVVKAVDVAGNESVQSDIFTITTKTENASYEAWDAKKAYKKGDRVLHEGKVYEAVQSYQGNGDPNWIYALSLWKTV

SEQ ID NO: 27909 - protein, 878 aa, Bacillus cereus Rock1-15; identical to SEQ ID NO: 27315

SEQ ID NO: 27910 - protein, 91 aa, Bacillus cereus Rock1-15
MDKELKANTSYKYVVTAVDLAGNESSRSDVLDVTTKAENSTYEKWDARKAYTKGDRVVYEGKVYKAVQGYQGNGDTNWIFALSLWKPVLSK

SEQ ID NO: 27911 - protein, 837 aa, Bacillus cereus Rock1-15
MLVKNQDKCSKFQAPIPFPPPGITGPTGPTGPTGALGGPTGPQGIQGVQGPIGPTGPQGIQGVQGVQGENGPTGPTGLTGPQGSQGNQGPMGERGPQGIQGVQGIQGERGPTGPTGIQGIQGIPGPIGPTGPTGIQGIQGMQGEIGPTGPTGIQGIQGVQGEIGPTGPTGNTGIQGVQGNLGGSGLQGVTGIQGIQGPIGPTGPTGSQGIQGEQGPMGPQGETGVQGLQGPQGEMGQVGPTGIQGIQGVQGVIGPTGPTGLQGDPGPTGPTGATGITGPTGSATGPTGATGPTGPPGGPTGPTGPAGSPGGPTGPTGATGATGATGATGATGIQGVQGIQGPTGATGVTGLQGVQGPMGATGPTGDQGIQGPQGIQGVTGPTGPQGLQGIQGPVGATGPTGPQGVQGAQGPIGPTGPQGIQGIQGEQGVRGATGPTGLQGLQGIQGPSGSTGPQGVQGIQGPSGITGPTGPQGIQGIQGPQGSIGPTGPQGIQGVQGPQGVTGQAGATGPQGIQGIQGPIGPTGPQGIQGIQGVQGPQGPTGQAGPQGLQGITGQAGPTGPTGPSGEAGATGPQGPQGIQGPQGATGPTGATGETGATGSQGPQGIQGPQGITGPTGATGPTGATGPQGPQGIQGPQGVTGQAGATGQTGLTGATGPTGIQGIQGITGATGGTGVTGPTGATGPTGLTGATGSSAISTGGGYFFSTSTSTIAANANIPINSGSTVYGTGVSLTSATTVTVTTPGIYLVSYYFQGDANGGNETVSVRLLLNGTQLTGSFIQNVTTSTVVIEPAISNTLLVNVTSANSTLILQNGPLGVGHVTTIAGAITASLNVVRIL

SEQ ID NO: 27912 - protein, 824 aa, Bacillus cereus Rock1-15
MALPLPLIGATGPTGNSGPIGPTGGHEGPVGPTGVTGPTGATGPQGPQGIRGIQGPQGTTGAQGIQGAIGDTGEQGITGPTGLQGAQGLIGNQGLIGDIGVQGLEGIQGATGPAGSQGIQGTQGIQGEIGERGQTGAQGMQGERGITGVSGVTGPQGPQGVQGIQGEQGAIGIQGEDGFQGIQGITGEEGPQGAQGIQGEVGPTGSTGMQGAQGISGIKGITGAIGLQGPQGVQGIQGITGATGFQGIKGIRGITGATGSIGTQGSEGPPGGPTGVTGPIGPSSGVTGPAGPPGPPGGPTGPTGATGSTGVSGGIGPIGGQGVQGITGPTGHQGVRGAQGAQGVVGAVGVQGAQGPQGNQGITGPTGAEGSQGIQGPLGVTGPTGAEGPKGIQGIQGVIGPTGAQGMVGIQGIAGPVGVTGAEGAQGAQGIRGATGPAGAQGIQGVQGIQGETGAVGTQGPQGVQGIQGTTGLTGTQGAQGPQGVQGIIGPTGAIGLQGPQGLQGIMGPTGAQGVQGIQGVQGIIGPTGAQGIRGPQGNTGEIGITGPQGVQGAQGSQGPQGPQGNVGITGATGETGATGATGATGPQGVQGVQGITGIQGITGTTGNTGATGSQGIQGIQGVQGLQGPTGASGVTGASGSIGPVGAQGSQGPSGVVGPTGATGSAGSIGFFGIAGATGATGLPSGGGYFFSTSTSTIAANALIPINSGSTVFGSDVSLTNATTVTLSTPGIYLVSYYFQGDPTAGNETISVRLTLNGTQVAGSFIFYVTGGTFILEPAVSNTMVIEVTSSNATLSLQNGPLAIGHVTTLSGVITASLNVLKIV

SEQ ID NO: 27913 - protein, 939 aa, Bacillus cereus Rock1-15
MTHEKYSMDWSYSNSLGKYIRTEMIKNSSGQIAYCLTLGLKSPNGEDLPEMGKTDNVVYRALLNGFPQKSAEQLGVANKNEAHYATQLAVWNALGQLDVNELKYENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNVNNESVGKITTGADGMAELNNLPIGTYTLKEIKAPTGYVSDDKPQTIEVKTGETGAVQIVNNKVKGNIEIKKLSDSGKILPNVEFTVFTEDGKEVKKVVTKENGIANVEGLTYGKYYFLETKTPNGYIGNKTKYPFEIKEHNKTLTFTVENTEVKGSVKLLKVDNEDISKKLEGAVFELKDASGKVVGEYKTDKNGEINVKDLAYGKYSFVEKASPNGYVLVKEPIMFEIKEHGKIIELLAVNHLIKGDLEITKVDVADGNNKLQNAEFTIYNEAGKEVVKGKTDDKGIAKFEKLPFGKYTYKETVAPKGYVLNEETFSFEIKENGQIIKHIVKDEKIPSIETKATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGSKELDASKSVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEQPNSGKNTTTPEQPNEQVKEQPQLKKEIQSKIGWLPQTGTNLTSWISMAAGALLLIVGGVIFLKRKNA

SEQ ID NO: 27914 - protein, 971 aa, Bacillus cereus Rock1-15
MKSYSKKMLVGVSFASLMLGSFQGGSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSVKEWTGYKTVTAYFVNYRVNASGQFEYDVVFHGIDTEEGAENKAPVAVINGPYSGNVNEAISFTSNGSKDEDGKIISYKWEFGDGAVSNEQNPTHVYTKEGAYTAKLTVTDDKGATNTATATVTVQKKEDNSVEKEPNNSFQTANKLQLNQVLRASLGNGDTSDFFEINVENAKNLQINVTNENNIGMNWVLYSEADLNNYVTYAQQQGNKLVGSYYTYPGKYYLHVYQYGGGTGNYTVEVK

SEQ ID NO: 27915 - protein, 769 aa, Bacillus cereus Rock1-15
MLAGATLAIGVIAPQVMPTTAHADENAGESTVNLRILETSDIHVNLMNYDYYQTKTDNKVGLVQTATLVNKAREEAKNSVLFDDGDALQGTPLGDYVANKIKDPKNPVDPSYTHPLYRVMNLMKYDVISLGNHEFNYGLDYLNKVIEKTDFPVINSNVYKDDHDDKEENDENYFKPYHILKKEVVDEAGQKQIVKIGVMGFVPPQIMNWDKANLEGKVKAKDIVATAKIMVKKMQDEGADIIVALAHSGVDKSEYKEANKMENASYHLATQVPGVDAVLMGHSHTEVQDVFNGVPVVMPGVFGSNLGIIDMQLKKVNGKWEVQKDQSKPQLRPIANSKGTPLVESDQKLVNEIKDEHEKTIEYVNTHVGETKAPINSYFSLVQDDPSVQIVTNAQKWYVEQELKKPEYEKIKDIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIVNMTYEGKPVADKQEFIVATNNYRGSSQTFPGVSKGEVVYQSQDETRQIIVKYMQKIKDIDPAADQNWTFKPIVADKLNTTFDSSPNAQKYIKKDGKISYVGPSENEFAKYAIDITKKNDDKETGEGNPTTPPTGGGENPTTPPKGDGENPTTPPTEEGNNGNEPKQDGNNTGSGQTTTDDQNTKETTTVSENKEAEKDERDLPKTGASIASTIGAGLAFVGAGLLLLFRRKKANR

SEQ ID NO: 27916 - protein, 312 aa, Bacillus cereus Rock1-15
MSSWSNNVNGYCGCNNQNGVHVDSCCFSCDGTVPKVGPTGPTGATGVTGATGGTGPMGATGVTGDTGPTGATGITGATGPTGATGITGATGPTGATGITGATGPTGATGITGATGPTGPTGATGSTGPTGATGSTGVTGPTGATGSTGPTGTTGSTGPTGATGATGSTGSTGATGTSITATYAFANNTSGTAISVVLGGTNVPLPNNQNIGPGITVSGGNTVFTVANAGNYYISYTINITASLLVSSRITINGGALAGTINSPAVATTSFSATIITTLAAGDAISLQLFGLLAVATLSTTTPGAVLTIIRLS

SEQ ID NO: 27917 - protein, 1282 aa, Bacillus cereus Rock1-15
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGPGGVQGLQGPIGPTGATGAQGIQGIQGLQGPIGATGPEGSQGIQGVQGLPGATGPQGIQGAQGIQGTPGPSGNTGATGATGATGQGITGPTGITGPTGITGPSGGPPGPTGPTGATGPGGGPSGSTGATGATGNTGATGSTGVTGATGSTGPTGSTGAQGLQGIQGIQGPIGPTGPEGSQGIQGIPGPTGVTGEQGIQGVQGIQGATGATGDQGPQGIQGVIGPQGVTGATGDQGPQGIQGVPGPSGETGPQGVQGIQGPMGDIGPTGPEGPEGLQGPQGIQGVPGPVGATGPEGPQGIQGIQGPVGATGPQGPQGIQGIQGVQGITGATGVQGATGIQGIQGEIGATGPEGPQGVQGAQGAIGPTGPMGPQGVQGVQGIQGATGAQGVQGPQGIQGIQGPTGATGDMGATGATGEGTTGPTGVTGPTGVTGPSGGPAGPTGPTGPSGPAGVTGPSGGPPGPTGATGATGVTGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGSQGPTGIQGIQGEIGPTGPEGPEGLQGPQGIQGVQGPVGATGPEGPQGIQGIQGVQGATGPQGPQGIQGIQGVQGITGATGAQGATGIQGIQGEIGATGPEGPQGVQGIQGAIGPTGPMGAQGVQGIQGIQGATGAQGVQGPQGIQGVQGPTGATGDTGATGATGEGTTGPTGVTGPTGVTGPSGGPAGPTGPTGPSGPAGVTGPSGGPPGPTGATGATGVTGDTGATGSTGVTGATGATGATGVTGLQGPQGIQGVQGEIGPTGPQGIQGPQGIQGVTGATGAQGPQGIQGPQGDIGPTGSQGIQGPQGPQGIQGATGATGAQGPQGIQGPQGEIGPTGPQGPQGIQGPQGIQGPTGVTGATGATGPQGIQGPQGIQGPQGIQGPQGIQGPTGATGATGATGPQGIQGPQGIQGVTGATGATGSQGPTGDTGPTGAGATGATGATGVSTTATYAFANNTSGTAISVLLGGTNVPLPNNQNIGPGITVSGGNTVFTVANAGNYYIAYTINLTAGLVVSSRITVNGSPLAGTINAPTVATGSFSATIIANLPAGAAVSLQLFGVVAVATLSTATPGATLTIIRLS

SEQ ID NO: 27918 - protein, 359 aa, Bacillus cereus Rock1-15
MYPRNFFSCDGRRNSGSNGNTGPTGNTGPTGNTGPTGNTGPTGNTGPTGNTGPTGNTGPTGNTGPTGNTGPTGNTGPTGNAGPSGAGFQSTTTFSLAAAPNYKKGQVVTYTGSGYVVKKDAPQGFPNISPDYIVLVESGPTGSTGPTGITGPTGNTGPTGITGTTGNTGSTGITGTTGNTGPTGNTGPTGITGPTGSADSASAKSIVFQGTNAGFQRIAGSPGIDSNVIPYVTAGAGSIVGFSASININNLPAAIYTINICRNVPTNLTTPSSSYILSTITLTTTDKITGTMVFSIKPTDSGAGQIQVFNPTPAVGPATVTWTSITTGNPVARGDAISLYITPGITASAVYSIFLITDI

SEQ ID NO: 27919 - protein, 3255 aa, Bacillus cereus Rock1-15
MKQVLKCFNVVTMITLLLSIILPSPSAFATEINKKSWDELQGNDVKIKAEQVNAEIYKGEVAEREHVFQYTIENTGATPIQELVLKQNNENEITFPSQSVKVNGEKLPENKVADFYVEEKDKGGKVLSSNLKIKDLKSHEKMTVLIKARRTQHFNNEYKQKISVQKDQLQIGNMSVDVEGIPSEEKVAANADEEADSSKKEVGPSANNTIKKVDEKLKVSVEDKNNPTSKTEPPKQPVTEAEKLEKEAENQSDAKVQAASENASKVQMQTGDKQGFGDPLYSTITAGNLVQTGNVTLGLTTDHYGRQSMGYKTNKMTVDVDNDDSTFNSSTGAFPNIPAGSKVKKAYLFWTAAMGLPGNIADRKVTEDQVRQPVKMKMGNKEYADVTADSIRKADSLPFISNYSGAGAGYVAYADVTNVIAQQGISQTLTVANVPQIKDVTGGGYYWGNWNLILVYENYKETVKDMKIWEGLVSQKSTAWTDISVNKINTPKEGTFKAKFSYFSSQGDPAEKDGYAYDYGEYDFGAGYIKIKNINGKDNDANDSSMTEVQVDGTNEFVTKKYPGYNPDWTNSFSTDIHTYHLEGPNQVKNDLKEAKMRFRANSGYGDIYVLNNATFVTEHNAPNLQVDKKALDSAGKEIKDIKAGEEFTYQIEVKNDTKNNQAPVSNVKGFDKLDDRLEYVPESIQYISGSNKGNKTDNASDDEAEFVNNQIDFRMGEGADAKDGGVLKPGESAIITFKVKVKASVQSDTTIKNIVAVKGKDSTEVNYETADDANVTVTLPKEVPGEIEARKIASNKTPKLGDEVEYRITFKNTVKDGRLDVLTIEDELPSSLEYVKDSLKAEGAKPEPVELKFENGKVIAKYPEIMDMEERSIVFKTKVKETAKIGEEIVNKATVSDKTNPPKDLEEKITPQHKSGKIAAKKKATNKKPKLGEEIEYQISFQNTVENGKLDAVTIEDEIPANLEFVQGSERAEGAEPNPVELKVENGKVIAKYPEITDTKERSIAFKVKVKEEAKAGETIVNKAVVSEPNGQTEHPEEKITPDYKYGKVDVEKSVTNQTPKLGEEVEYRITFYNTVENGKLEKVLVEDTLPKGVEYVKDSLKAEGIKPEPVELKVEDGKVMAKYPEITDTEKRSIVFKVKVKDSAKVGEAIVNKAIAKDPKNEPVESKVVITPQSKKGEIAATKVVNNKKPKLGEEIEYRISFHNTVENGKLEEVRVEDTIPKGLEYVENSIKAEGEAPGPVELAVENGIVKAKYIDIMDMKERSIVFKVKVKEEAKVDKEIVNKAIVDDTKNPPIEPEERITPQHKDGIIDSKKTVDNPSPKLGEEVEYRISFKNTVENGKLEKVIIEDTIPNGLEYVKGSEKAEGDKPASLKLSVKDGKVIAEYENITDMKERSIVFKVKVKEEAEVGKEIINKAIVDDMKHPKEPEAKITPLHKDGKIKAKKSVNNETPKLGEEVEYRISMKNTVKYGKLTDVIIEDTLPEGLEYVENSLKAEGIGTDSVELKFENGKVMAKYPEIMDTEERSIVFKVKVKEGVTVGKKIINKATIDDSQNKPVNPTAEIIPQYKDGKLEAKKMVNNETPKLGEEVEYRISFKNTVEHGKLTEVKIEDDLPNGLEYVKDSVKVEGSKPDPVELKFENGKVMAKYPEITDTKERSITFKVKVKGKVSDSIVNEAIVSDTKHPPETPTAEIIPQHKDGKVKAKKTVNNETPKLGEEVEYRISFKNTVEDGKLAEVKIEDTLPEGLEYVENSVKAEGSKPDPVELKFENGKVMAKYPEITDTEERSITFKVKVKDEVKVGKKIVNKAIIDDTKNEPETPTAEITPQHKDGKVEAKKTVNNETPKLGEEVEYRISFKNTVENGKLAEVTIKDDLPNGLEYVKDSLRAEGSKPDPVELKVKDGKVIAKYPEIMDTEERSIVFKAKVKEEFKVGEGIVNKVVVDDTKDPTTSEVTITPEYKDGKLKAEKFVNNKKPKLGEEVEYRISFKNTVENGKLVEVTVEDEIPAGLEYVENSLQAEGSKPSPVELKFENGKVMAKYLEIADTKERSIIFKVKVKEEAEIGKEIVNKAIVVDTKNEPEEPRVEITPQYKDGKIAAQKVANNHKPKLGEEVEYRISFKNTVENGKLVEVNIKDTLPNGLEYVEGSITAEGSKPKPVELQVKNNKVMAKYPEITDTEERSIVFKAKVKESVKVGEEIVNEAIIDDTKNLPEEPYVPITPQYKDGKIEARKEVSNHEPKLGEEIEYRIIFNNTVKDGKLAEVKIEDEIPAGLEFVEGSEKAEGEEPKPVELKVENGKVMAKYSEIMDTKERSIVFKVKVKDSVAIGKDITNKAIIHVDDPNHPVIDPTAKITPQYKDGKIATHKKVNNHKPKLGEEIEYRISFNNTVKDGKLAEVKIEDEIPSGLEYVKDSLKAEGDKPAPVELKEEAGKVSAKYENITDMKERSIIFKVKVKDSVEVDKAIVNKAIVDDTKNPPERPEVEITPQHKDGKVKADKKVNKKDPKLGEEVEYRISFKNTVENGKLAEVKIEDQLPTGLEYVKDSLKSEGNEPAPVELKEEAGKITAKYENIIDTAERSIIFKVKVTEVAKVGKKIVNTAIVDDDNPKNPPQKPEAIITPEYKDGKLKAEKTVNNPAPKLGEEVEYRITFRNVVEHGKVAKVKIKDELPTGLEFVEGSERAEGENPKPLYVKVKNGIVLAEYPEITDMKERSIVFKVKVKEKAKVGEEIVNKAIVEDTINPPEQPNISIQPQYKDGALQAEKTVSNHEPKLGEEVEYRISFENMVENGKLTEVKVEDEIPAGLEYVKDSIKSDGPEPYPVELKVENGKVTAKYPEITDTKKRSIIFKVRVQETVQVGKEIVNKAIVDDNNPTTPPVESLIPITPQYKDGKLEARKEVSNHEPKLGEEIEYRITFNGTVDGGKLVDVKIEDEIPSGLEYVKDSLEAVGDKPVPTELKVENGKVTVKYPEITDTKERSVIFKVKVKETAKVGGEITNKAIIEVDDPKHPVIEPTAKIKPEYKDGKLTAAKTVSNKEPKLGEEVEYRISFKNTVENGKLDVVTIEDEIPAGLEYVQGSIRFEGAEPNPIELKMEFGKVIAKYLEITDTKERSIIFKAKVKEAPSKGITNKAVVDDKINPPLEPTVTILPKTKEDFKIPEDPKEPKEPEVKPEDPKEPKEPEVKPEDPKEPKEPEVKPEDPKEPKEPEVKPEVRLEKLIKEPQVKTERELPKTGAASPWMMSVGAGISFLVGGVLFVLGRRRKQ

SEQ ID NO: 27920 - protein, 431 aa, Bacillus cereus Rock1-15; identical to SEQ ID NO: 26472

SEQ ID NO: 27921 - protein, 172 aa, Bacillus cereus Rock1-15; identical to SEQ ID NO: 27088

SEQ ID NO: 27922 - protein, 1098 aa, Bacillus cereus Rock1-15
MGKRVVVRVLAVLSVLALFLNVFLPRVSAEVMTHEKYSMNWSYSNSLGKHIRTEMIKNSSGQIAYCLTLGLKSPNGEDLPEMGKTDNVVYRVLLNGFPQKSVQQLGVANQNEAHYATQLAVWNALGQLDVNELKHANKNVEKAAKAIINAANNSGDTQDIYMNVIPAEKQKAELKGEFFETNLYTVQTNAKSGSYKVVAKNAPNGVKIVSENGEVKDQLSVGEKFRIQIPKNTKTGEFNLSVAANLTKVQAIAYRGTDTVQNATVLLERNEEKLSSDLAVNWEAAGSLKIKKVGESGEVLAGAVFEVFNANNESVGKITTGADGTAELNNLPIGTYTVKEIKAPTGYVLGDKPQTIEVKTGETGAVQIVNNKAKGNIEIKKLSDSGKVLPNVEFTVFTEDGKEVKKAVTNENGIAKVEGLTFGKYYFLETKTPNGYIGNKTKYPFEIKEHNKTLTFTVENTEVKGSVKLLKVDTEDISKKLEGAVFELKDASGKVIGEYKTDKNGEINVKDLAYGKYSFVEKTSPNGYVLVTEPIVFEIKEHGKIIELLAVNHLIKGDLEITKVDIADGNNKLPNAEFTIYNEAGKEVVKGKTDDKGIAKFEKLPFGKYTYKETIAPNGYILNEETFSFEIKENGQIIKHIVKDEKIPSIKTTATDKKDGTKEMHTSKSVTIQDKVEYKDLQVGKEYTLKGKLMDKKTNKPLVVNGKEVTAETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINEPLLIDGKEVTAETKFIAKEKNGFVTLDFTFVGAEQQGREVVVFEDLLHEGQVIATHADINDVGQTVRFVEPSIKTTATNKADGSKELDASKTVTIQDKVEYKDLIVGKEYVVKGKLMDKATKKPLLVDGKEVTVESKFTAKEKNGSITLDFTFNASALQGKEVVVFEELYQDNVLVAIHVDIEDKGQTVKFKEVKPEQPKPEQPKPEQPHQDKNTPTTEQPKEQVKEQPQPKKEVQSKIGWLPQTGADLTSWISMAAGALLLIVGGVIFLKRKNA

SEQ ID NO: 27923 - protein, 181 aa, Bacillus cereus Rock1-15
MNKKLLASLLCSTFLFGVSACSSHDAPAKNEQATSKKTENDKLSSKDPQKELPTNVDSSDVYMSMGSAESLDVLGTGEVKAQGVFKVLDIAVYNRKEEPITLDINNFKLIDGFGREYHISNEHQSVLKAANTSTFKFGIVNPDEHSDGNIVFDVPKNTRGLTLKFNNDKLDKELQLKVELE

SEQ ID NO: 27924 - protein, 380 aa, Bacillus cereus Rock1-15
MHMKEKRYKNMKTKQTIAASTLALAMIAGANSTHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNNNAKELPNAGSEQSNNMALGMLSVLGGILLLTRNKIKTLFSK

SEQ ID NO: 27925 - protein, 178 aa, Bacillus cereus Rock1-15
MVSIVIELFNGFRVVPLAGPGMVKLIFVLTTAEKPIPTSEVIVPNMGRIPKPVAPVGPVIPIPVGPVTPVGPVIPIPVGPVTPVGPVIPIPVGPVAPVGPVIPIPVGPVTPVGPVTPVGPVTPVGPVIPIPVKPVAPVGPVIPVGPVGNVNGGIDGSVGPIKFGSRAGPCKILYSSFI

SEQ ID NO: 27926 - protein, 84 aa, Bacillus cereus Rock1-15; identical to SEQ ID NO: 27275

SEQ ID NO: 27927 - protein, 162 aa, Bacillus cereus Rock1-3; identical to SEQ ID NO: 26879

SEQ ID NO: 27928 - protein, 965 aa, Bacillus cereus Rock1-3; identical to SEQ ID NO: 26880

SEQ ID NO: 27929 - protein, 333 aa, Bacillus cereus Rock1-3; identical to SEQ ID NO: 26881

SEQ ID NO: 27930 - protein, 502 aa, Bacillus cereus Rock1-3; identical to SEQ ID NO: 26882

SEQ ID NO: 27931 - protein, 738 aa, Bacillus cereus Rock1-3; identical to SEQ ID NO: 26889

SEQ ID NO: 27932 - protein, 350 aa, Bacillus cereus Rock1-3
MKQKVETTNEAPVLTVPFTTTLRVGEEFDPMAGVSASDKEDGNLTNKIKYKGNVDTSKPGKYIVEYWVVDSKGVNATATQSVIVKENEETPDMEPKLTVPTRTTINVGDKFNPLSGVNAIDNEDGDITDKVTVDGSVDASKPGTYELTYTVSDSKGHTVTAKQTVTVKQKVESKDEDPVLTVPTEVTLHVGDKYNPLSGVKAIDKEDGDITDKVIHMGEVDTSKAGNFEVKFLVRDASGNEVTATQKVTVKDTDTENGSDNSNNNSNSGNGSDNSSNNTNSGEGPDNSNTTTGNISDNNNTSSNLDNKKDTIKELPKTGASSNNGTAVGILAILAGMLITFGRKFKKAIK

SEQ ID NO: 27933 - protein, 458 aa, Bacillus cereus Rock1-3; identical to SEQ ID NO: 26890

SEQ ID NO: 27934 - protein, 890 aa, Bacillus cereus Rock1-3; identical to SEQ ID NO: 26885

SEQ ID NO: 27935 - protein, 553 aa, Bacillus cereus Rock1-3; identical to SEQ ID NO: 26888

SEQ ID NO: 27936 - protein, 444 aa, Bacillus cereus Rock1-3
MKMNKKSLGAVALTAGIIGTTLIPQNAYAHGFVEKPGSRSALCSPTYGALNVNCGSVMYEPQSLEAPKGFPQAGPVDGQIASAGGKFGGILDQQTADRWFKNTITGGENTFTWKFTAPHLTSKWHYYITKIGWNPNKALTRADFEPIGTVQHDGSAASNNVAHKINVPTDRSGYHVILAVWDVADTANAFYNVIDVNLINNVKPDTEAPSIPNGIQTQKVTANSIELTWNTSTDNVGVKGYQIFRNGEMIDTVPGTHFIDKKLQPSTEYSYTVKAIDAAGNVSKESTALTAKTTVEAPDTEAPTQPKGLHSMGTTASSVDLMWSPSDDNVGVDHYDIYREIEGTMKKIATSNTTSYMDNNLLANKTYKYVVKAVDVAGNESVQSDIFTITTKTESVSYGEWDAKKAYKKGDRVLYEGKVYEAVQNHQGNGDPNWIYALSLWRAV

SEQ ID NO: 27937 - protein, 878 aa, Bacillus cereus Rock1-3; identical to SEQ ID NO: 26892

SEQ ID NO: 27938 - protein, 380 aa, Bacillus cereus Rock1-3
MHMKEKRYKNMKTKQTIAASTLALAMIAGANSAHAEVNDTTPQQNTGDRLAEIKQHRQELDAKLQQHKENVDQTLNELNQVKENVDTKVNELHERKQVADEKINEMKQHKQELDAKLQQDKQIVDEKINEIKEHKKQVDDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQKARQDLLNKINEIKQAKQTVSDDLTKKKQDLDIKINDFKHTEKKIDDKLAEVHTTKQNVDNKINEISQSKQTQADNSTKNNNARELPNAGSEQSNNMALGMLSVLGSVLLVTRNKIKTLFSK

SEQ ID NO: 27939 - protein, 971 aa, Bacillus cereus Rock1-3; identical to SEQ ID NO: 27655

SEQ ID NO: 27940 - protein, 97 aa, Bacillus cereus Rock1-3
MSGGNTVFTAANAGNYYISYSINITASLLVSSRITINGAPLAGTINSPALATTSFSATIITTLAVGSAISLQLFGLLAVATLSTTTPGAVLTIIRLS

SEQ ID NO: 27941 - protein, 181 aa, Bacillus cereus Rock1-3
MFGSGTFVPPSNTDIAVPDVLFANAYVAVILVPVAPVAPVIPVAPVAPVEPVSPVAPVAPVEPVEPVTPVGPIAPVEPVTPVGPVAPVEPVAPVAPVAPVAPVAPVAPVAPVGPVAPVIPIAPVGPVAPVIPVAPVAPVGPVSPVAPVAPVEPVAPVGPVGSSLGTVPSQLKQHESTCTPF

SEQ ID NO: 27942 - protein, 926 aa, Bacillus cereus Rock1-3
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGLQGVQGLQGPIGPTGPIGVQGIQGVQGLQGPIGDTGPEGSQGIQGVQGIPGATGPQGIQGVQGIQGTEGPSGSTGTTGATGQGITGPTGITGPTGITGPSGGPPGPTGPTGATGPGGGPSGSTGVTGPTGATGNTGATGQGLTGPTGSTGETGAQGLQGLQGIQGIQGPIGPTGPEGPQGIQGIPGPTGVTGEQGIQGVQGIQGITGATGDQGPQGIQGAIGPQGVTGVTGDQGPQGIQGVPGPSGATGPQGVQGIQGPMGEIGPTGPEGPEGLQGPQGIQGVPGPVGATGPEGPQGIQGIQGPVGATGPQGPQGIQGIQGVQGITGATGAQGATGIQGIQGEIGATGPEGPQGVQGAQGAIGPTGPMGPQGVQGIQGIQGATGAQGVQGPQGIQGIQGPTGATGDTGATGATGEGTTGPTGTTGPTGVTGPSGGPAGPTGPTGPSGPTGVTGPSGGPPGPTGATGSTGATGDTGATGPVGVTGATGETGATGVTGLQGPQGIQGVQGEIGPTGPQGIQGPQGIQGVTGATGDQGPQGIQGPQGIQGPTGPQGIQGEQGLQGIQGVTGATGAQGPQGIQGIQGIQGPTGPQGPTGIQGVQGEIGPTGPQGVQGLQGPQGPTGDTGATGAQGPQGIQGPTGVTGATGATGATGLQGIQGPQGIQGPTGAGATGATGATGVTGVSTTATYAFANNTSGSVISVLLGGTNIPLPNNQNIGPGITVSGGNTVFTVANAGNYYIAYTINLTAGLLVSSRITVNGSPLAGTINSPAVATGSFSATIIANLPAGAAVSLQLFGVVALATLSTATPGATLTIIRLS

SEQ ID NO: 27943 - protein, 431 aa, Bacillus cereus Rock1-3; identical to SEQ ID NO: 26893

SEQ ID NO: 27944 - protein, 723 aa, Bacillus cereus Rock1-3; identical to SEQ ID NO: 26883

SEQ ID NO: 27945 - protein, 804 aa, Bacillus cereus Rock1-3
MKIYKILYTKIIIGVFIMKLIKGIFVSTIALTSFTGLELIKINEDPNVVYADSKDSSQNISQFQGDIKEGDKIILKFKSEVNFPYKDGLENQIKDEDSDLELVKIFSEFPQLTLKRLFTSVNPREIENIDKHTRETENNSSSNLLDYYIVEVPNKVTTETLMDKFKKSHLVEEVYMQEKPTLLPEVQLPTVSLNPYDDPRFLNQGYFKEAPYGINASYAWSIKGGDGKGTTFVDMEYGWLLDHEDLVNQKVELISGRNIDQHVGHGTSVLGIVSAEDNKVGNIGIAPKAKVKVVSQIRGDGSYNTADAIIDAVHNLQAGDILLLEAQASYDGYGDKYLPVEVQPDIFDAIRAGTDKGIIVIEAGANGSNDLDQFRDRNGKQVLNRNSPDFKDSGTIMIGAASSTVPHKRLWFSNYGSRIDVYGWGENVDTTRAEPNRITKNLYTTGFSGTSSASPIIAGAATSIQGVAKEHLGRPYKPAELRNILSNPNTGTKSQNPLTDKIGVLPDLKSILSNLGYSPDISNNVLEGNQFVWSMKGIGDFEFAKLDFNKTKEEMQIQLKAGVPHHYFDSTYASVKVQNSSGKVVYSKDIYGNRQQNAETQKIPVKVGDYIEFTHLEGGNRATLINVDKNIQESFGKKIVYQVTVNGLKKVDQIINPNPDTEAPTRSEGLQATSITANSVELKWNSSTDNVGVKEYQVLRDGKFIQTVQGTTFTDSKLTANIEYKYTVKAIDTAGNESIQSSVLSVKTKEQNTSYEKWDPRKAYTKGDRVEYQGKIYEAVQSYQGNGDSNWIFSLSLWKPISIS

SEQ ID NO: 27946 - protein, 213 aa, Bacillus cereus Rock1-3; identical to SEQ ID NO: 26884

SEQ ID NO: 27947 - protein, 1064 aa, Bacillus cereus Rock1-3; identical to SEQ ID NO: 26878

SEQ ID NO: 27948 - protein, 798 aa, Bacillus cereus Rock1-3
MGKATVKSKKLVGIVATATLATSMIAGTSNASAQTTDSLKVSEPVQERAEDKKLTLFVPPQNVVFVGDTFDPMKDVWAKDKNGKDITSRVTYTGDDKVDLTKMGEYELTFTVSDDEGNTVVQKQRVVVRYKHVTNTAPTILILRDKITLNIGDTFDPMEGVTGSDSEEGILTHKITYDNGLDTSKPGTYYITYYLMDSQGKMDLKTRTITVIDQSPVITTPDEFVITEGEQFDPMAGVKATDPEDGDITSKVEYEYYTGSVNKPGTYKVYYKVKDSFGNTANTVATLIVREKIKPVDEAPELKVPTATTITEGDKFNPMSGVSATDKEDGDITSKVTVDGSVDASKPGTYELTYTVSDSKGHTVTAKQTVTVKQKVEIKNEAPELTVPFTSTLRVGEKFDPMAGVSATDKEDGNLTNKVKYKGNVDTSKPGKYIVEYWVVDSKGVNATATQSVIVKENEETPDMEPKLTVPTGATINVGDKFDPMAGVKAIDNEDGDITDKVTVDGSVDASKPGTYELTYTVSDSKGHTVTAKQTATVKQKVEPTDEAPVLTVPAEATINVGDNFNPLAGVKAIDNEDGDITNKVTVDGSVDASKPGTYVLTYTVTDSKGHTVTAKQTVTVKQKVEPKDEDPILTVPAEVIINMDDNYNPLAGVKAIDNEDGDITSKVIHMGEVDTSKAGNFEVKFLVRDASGNEVTATQKVIVKDKDTENGSDNNNNNTNSGNSSDNSNNTNSGNISDNNNTSSNNNTTSTLDNKKDTIKELPKTGASSNNGTAAGILAILAGMLITFGRKLKKTTK

SEQ ID NO: 27949 - protein, 529 aa, Bacillus cereus Rock3-28
MFKKVSAITLVSLLALSPVVALAAPEGNNVKQGNVEKVDKEAGTENKDAKLKELEQKKDQNQGNKEVSKEIGQTIKPEEKKEIKEPKPNVEKKLELVEENKQEQKKENVGPKNVTPAKPVTPSEPVTNKPLAPSSSKVDEEEAIDVSNFSGNVVGKAKWNSKENHYVLDITVSVTNNSKEKASDLYLGIAIPKGLDGDFKDVHGVELEDGSEAIAIQLPEMDAGKTVTKNIKIPVLGNVAGEKVSKDIELYLIDHTNNEYEPLGKITGSANIDFSEMNKDIRFDGKVKATTCVPNLKENQFTLDFLLTTQNLTIEELKGFDVEIDVPKDIKLTIPDYYKQAEIPDYLKDASLQEGLHEGAMNLDIKWNGNTATIPVQAMIAGEGSVLYFQIVGETVKDLKDLKVTFTAKRGDQTVKKQVAIEKIENKDCKKQDDKNTAGNNNGEGKGTGNNTSNTKGTNSNQVVNKPNQVTPTPVTPTKVTPTPVKVSDKVSLPKTGASQTDNLLTLVGVVMLAGSVLVYKRSRMNVNK

SEQ ID NO: 27950 - protein, 162 aa, Bacillus cereus Rock3-28; identical to SEQ ID NO: 26879

SEQ ID NO: 27951 - protein, 956 aa, Bacillus cereus Rock3-28
MMLSISTMALSLGAIQTNVSAEEKVPYNVLHSKPVGIEKSVDEIGHVSKAEETLSFQERLKVGDFSQRPASITKNSAVKQAKESYSMADLNKMNDQELVETLGSIKWHQITDLFQFNEDAKAFYKDNGKMQVIIDELAHRGSTFTKDDSKGIQTFTEVLRSAFYLAFYNNELSALNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDSKLNKEYQEYMQQLIDNQDKYTVPEVADDYLAEHAPKSLTEVKKEISETLSMKDAKMTKHESQFFNTFTLEGTFTGSVTKGESEDWNAMGKRVNEALEQLAQKEWSGYKTVTAYFVNYRVNSSNEFEYDVVFHGIAKDDGENKAPTVHINGPYNGLVKEGIQFKSDGSNDEDGKIVSYSWEFGDGRTSTEVNPVHAYEKEGTYKVVLRVKDDKGKESRSETTVTIKDGSLTESEPNNRKEEANRIGLNTTIKGSLIGGDHTDVYTFNVASAKDIDISVLNEYGIGMTWVLHHESDMQNYAAYGQANGNHIEAKLNAKPGKYYLYVYKYDNGDGTYSLSLK

SEQ ID NO: 27952 - protein, 333 aa, Bacillus cereus Rock3-28
MKSKLLKGVLSFGIGLGALYSGSSAQAETPTNQNNTLKVMTHNVYMLSTNLYPNWGQSERADLIGAADYIKNQDVVILNEVFDNSASDRLLGNLKREYPNQTAVLGRSSGNEWDKTLGNYSSSTPEDGGVAIVSKWPIVEKIQYVFEKGCGPDNLSNKGFVYTKIKKNDSFVHVIGTHLQAEDSMCGKISPASVRTKQLQEIQDFIKNKNIPNNEYVLIGGDMNVNKINAENNSDSEYASMFKTLHASIPSYTGHTATWDATTNSIAKYNFPDSPAEYLDYIIASKDHANPSHIENKVLQPKSPQWTVTSWFKKYTYNDYSDHYPVEATISMK

SEQ ID NO: 27953 - protein, 179 aa, Bacillus cereus Rock3-28
MFKKIGTVTLAGALAFSLSACDEKKEAAKTVSNNTKEEQGSAKKENTKNEDTREYSVEKTTQIRDQKLTVHKVQIAQVAEYDKLEKGNEFVIVHVTVENIGNQKVRINPLDFYLERGDGSIVDHTFSTSNKNIFKIKDVDPNGKLTGAITFEAKKGDSNLQLVYRPDVMSKEEVKVELK

SEQ ID NO: 27954 - protein, 502 aa, Bacillus cereus Rock3-28
MLNKKMVAMAMTVPLVMGTISTVSALEKKQVKVEAYSPQKKAVEYLKGNANQYGLKPDLSDLQYISTTETSVASYVKFQQVVNGAPVFSKQITVTLNGEGKGVLAVSDYQPVTGVKEVTTKISEKDAIQKSMAYVGEASEQNLWAPTEKEFGYIVEEGVALPVYKVVVHSNNPFGAWETFIDAENGKLIKKVDINRKAEGTGKVFLPNPVVSSGSKTGLKDSNDADSTALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNAKFRDGAKAIKQADALLYGGQHAADIDRIWAARGISTN

SEQ ID NO: 27955 - protein, 738 aa, Bacillus cereus Rock3-28
MKQLKPAISVLGSVSMALTLASPALADVKQPNPGGTVEIFKENANVKKEDKNFTLGSDGEIGSLITQNIEMANNDWDKDGISNDLEMNGYKIEFNSQTGKNEAKAWDPEKDKGKPKFISNPMNANTDGDPFTDMYEVENYNNDSDTNFNPIVANMPNLQIGAKRIEVIPIATITDNNGGSVSRGWEKSVSTQHSFNVGLSGSGGVEGSAAGPVPSGSISANVGYGYSKTTTETESYTNNFDWSTATTVDTANAAKLRIHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRVYTPKDKSLADKPVLSYNEVFQHVNIDTKKVNHIVNKAKSTNNVSVVSANNGTDALNDLKAGQGDRGDLHKDSVHGAFAKLQQPTLVEGSYDSVTQKIRATILPGLFGVSKEIPTTYSKKWNAPSQTVTLVKRENGFTYESRENIHPIKSEIAAHRKVTFEINDAHNLTPTQKIDTEIKANKEFEDYVVDNSGEFVTEGVPYTVASYGNTAYWGSHHAGNKWEYLWAEKSSDEKVNVIIERVGQPKPGKPIKKDEEVLIKFRNPIYSDYAYLKLQDSYIHLDQKQNASTFKFNHAYPKNFTGYHKQWNILSNGNKLKVGYLIDYMKYGNGENGTDTIAWNLSRVQ

SEQ ID NO: 27956 - protein, 748 aa, Bacillus cereus Rock3-28
MGNNSKYKTRKILATTATVTMLATGMISSSDVFAEERQQQKNLSTSLQEEKSVKLENRTYTVPGKGDVEVLKQQERKSMAFSPYEPTGLYAKPNEQITINVEENQNIQAYIGTYSYDASWREDSKIKSFTLKPGINTIQSPNGGMIYFYNKQQGGTIRTTVTTGGTTIPFFELGKHTKQDLINMLDQYPNAHAVELKGERVLITASPARVKKYLLGSNTDPVQLLKKMDEATRIQDKVAGLSEEQVDKHYVHYVEENHSPDYYMYATSYRTAYVGDAIQYVLDIDKFVKDGWGPWHEAGHLRQQSPWKFYNMTEVQNNIYSLSVEKAFTSNQPFRLQQEGAYTKAFQYLEQSNKNYDEISDAFVKLVMLWQLQLAYGEGFYPKLHQLYRDMPSNEIPQTDENKKQLFMISASKVAKQNLIPFFEKWGLRPNNDTIQKVAALGYPILTAEIWKGTDSNPIKPDMPNGNNILEGKQFAWSLKGISDFEFAKINLNKSTEEMQIDLKEGIPHQYFNETYASIKVQNASGKVVYKKDIYGNKQQNAELQKVPVKVGDYIDLTHLEGVHRATFMNVDNSKQESFGKKAIYEVTKDGLKKVNQIVNPKPDTEAPTQPQELYASNLTSNSVELKWNPSTDNVGVKEYQVLRDGQLIQTVQGTTFTDQNLTVNKEYKYAVKAVDAAGNTSIQSNILSVKTKDQHASYEKWNPKKAYTKGYKVEHQGKVYEAVQNHQGNGDPNWIFAVSLWKPLTIK

SEQ ID NO: 27957 - protein, 458 aa, Bacillus cereus Rock3-28
MNLKLTSKLERLRKSKKGIGACVLAAGVAAITMIPQSTYAHGFVEKPSSRAALCSQNYGALNLNCGNVMYEPQSLEAPKGFPEGGPIDGKIASAGGLFGGTLDQQTSSRWFKNTIKGGANTFTWKYTAAHSTSKWHYYITKKGWDPNKPLTRAELEPIGTVKHDGSAASNNLAHTINVPTDRNGYHVILAVWDVADTSNAFYNVIDVNLVNNETPDTVAPSQPTGLNASKVSANSVEITWKASTDNIGVKEYQVLRNGEVIDTVPGTTFIDKKLKADTEYTYTIKALDSAGNISKESEKIKVKTTNATPDIEAPTQPKGLHSMGTTATTVDLMWSPSEDNVGVDHYIVYRESAGVMNKIGTADNTSFMDKNLKANTSYKYVVTAVDLVGNESSRSDVLNVTTKSEDSIYEKWDARKAYTKGDRVVYEGKVYEAVQDHQGNGDSNWIFALSLWKPVLNK

SEQ ID NO: 27958 - protein, 884 aa, Bacillus cereus Rock3-28
MKNKKEIAIVALTTGLALTAVAPYGIGHAEETDQLQVQMQEESFRSGELTQPSQKAPENVVKDALKEKTEQALSPKQVNGETGVDYKVLQKRGSYDGTTLVRMQQTYEEKEVYGHQLTAHVDNKGVIKSVSGDSAQNLKQEELKKPIKLSKEKAKQYIYTKYGNDIKFISEPEVKEVIFVDENNGQASNAYQVTFTAATPSYVSGTYLVNADNGEMLKNMVQESGLKVSEEYVEPLKESRKNNFVSLTGTGKDDLGITRTFGISEQSNGKYSLADYTRGQGIETYDVNYRDITNEEKYYPGILVTSTSQTFTDPKAVSAHFLATKVYDFYKDKYKRNSFDNKGKKVVSVVHAWDSGGTNNPKNWENAFSANINNISMLIYGDPMVKAFDIVGHEFTHAVTSSESNLEFFGESGAINEALSDIMGTAIEKYINNGEFNWTTGEQTGSVFRNMKNPSSINYSNGVPYPDDYSKYNDLNGEDNGGIHFNSSIINKVAYLIAQGGTHNGVTVNGIGEDKMFDIFYYANTDELNMTSNFSELRLACLKVATNKYGANSIEVQAVQKAFDAAKIKGAVKENEKTAENQVPELTVPSTITLHVGDTFDPMRNVTAADKEDGNLTNRVQHKGDVDTSKPGKYIVDYLVVDSQGDNATATQTVIVEENGEILDIEPKLTVPVGVTINVGDSFVPMTEVLAIDKEDGDLTSKVKVDGKVDTSKAGTYVLTYTVTDSKGHEVTAKQTVTVKVREEVKNEKPILKVPATTTINKNNQFDPMVGVSATNKENDDLTSKVKVDGKVDTSKADTYEIIYSVRDSVGNEVKAIQKVLVKDKDTSKANGLASNSNSDKKEYTYKELPKTGASTTNSAIMGMLMVIAATVLTLVRKCRKIQK

SEQ ID NO: 27959 - protein, 553 aa, Bacillus cereus Rock3-28
MKKILSMLLVVFLTFSAWSSVLVKAASPTKGSLTIHKYEQEKEGTTGVEGDGSVNQEVPTNAKPLKGVTFEVKKVASFEKISNDGKIVKEAVKPVTGATPSQVVTDDNGQAVLKDLPLGRYEVKEVAGPPHVNLNPNTYTVDIPLTNKEGKVLNYDVHMYPKNEIKRGAVDLIKTGANDKALAGAAFSVFKKDGTEVKKDLVTDANGHIRVQGLEYGEYYFQETKAPKGYVIDPTKREFFIKNSGTINEDGTITSGTVVKVELKNYEEPTIDKKINGNLEALPINPLTNYNYDIKTLIPEDIKEYKKYVVTDTLDNRLVMQGKPIVKIDGAEVNANVVDVAVEGQKVTATVKDFTKLDGKKEFHLQIKSQVKEGVPSSSEILNIAKIDFTNKNDVIGEKESKPVVVVPTTGIIELSKIDGDNKKKLKGAEFVLKDKNGKIVVVAEKEVIGVSDENGVIKWSNIPYGDYQIFETKAPTYTKEDGKTASYQLLKDPIDVKVSENNQTVKLTIENNKSGWILPVTGGIGTTLFTVLGLTLMVTAAFVFFRKKFANK

SEQ ID NO: 27960 - protein, 291 aa, Bacillus cereus Rock3-28
MASITDAIAPFPDPSNITKRYAISIGPGSYIEPLIHLKANVQLVGTSTLLTRLQIPFDINDPSWFDLNFSQDPRSGFVDLTLLSGPLDFNFQTAQSVSGKLFFVSVNITPTPIFTALSTSVNQVNIRDSMLSGGYTQNGINMAMFASFVSSGNITINSQATTDTQVNLVGGGINGNVIINVLSGHIPIDPLNLTSFAITENIFNPSPNSGNLIVNGVNDVITRVRATVDSLPIRSRINILGTNTTLIRVDDAFDLAYAPINPANWAPLPPTTVQEALDRIASLLAVTIGTP

SEQ ID NO: 27961 - protein, 444 aa, Bacillus cereus Rock3-28
MKMNKKSLGAVALTAGIIGTTLIPQNAYAHGFVEKPGSRSALCSPTYGALNVNCGSVMYEPQSLEAPKGFPQAGPVDGQIASAGGKFGGILDQQTADRWFKNTITGGENTFTWKFTAPHLTSKWHYYITKIGWNPNKALTRADFEPIGTVQHDGSAASNNVAHKINVPTDRSGYHVILAVWDVADTANAFYNVIDVNLINNVKPDTEAPSIPNGIQTQKVTANSIELTWNTSTDNVGVKGYQIFRNGEMIDTVPGTHFIDKKLQPSTEYSYTVKAIDAAGNVSKESTALTVKTTVEAPDTEAPTQPKGLHSMGTTASSVDLMWSPSDDNIGVDHYDIYREIEGTMKKIATSNTTSYMDNNLLANKTYKYVVKAVDVAGNESVQSDIFTITTKTESVSYGEWDAKKAYKKGDRVLYEGKVYEAVQNHQGNGDPNWIYALSLWRAV

SEQ ID NO: 27962 - protein, 878 aa, Bacillus cereus Rock3-28
MVKYSKISKWILGVGLVTITCNGLQIQAETKEKNVKKVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTMWYRNIDNFINEVSRFALIGTVTDKNGWLINNGIYYAGRLGKLHSTPTKGQQVVTDAMRIYPYLGEQYFVAAEQITTNYGGVDANGKTINLDQIRDDGKKKYLPKTYTFDDGAIVFKAGDKVSEEKIKRLYWAAKEVRSQFYRTVGSDKPLENGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGSTRLNSVVPRKSIIGGLSNDSAKRYTASQTLNAKYGTWDFYNYSFALQSYMYNKRPEMFDKVHDLIRANDVSSYDAYRSALSKDNNLNEEYQSYMQMLIDNRDKYTIPQVSDEYLAQHDPKSLSDITSDITNEAKLKDVKVTKNKSQFFNTFTLQGTYTGSSAKGEIEDWKVMNEATNDMLKRISGKEWTGYKTLTAYFINYRVNHAGQFEYDVVFSGVNTEEGTAVEKEPNNSFETANPLFLNTLLRGNLSDQDQGDKFVIDVKDQKDLQISVTNEQNLGLNWVLYSESDLNNYVTYATKRDGNKLLGNYNAKPGKYYLSVYKYGGGTGNYTVEVK

SEQ ID NO: 27963 - protein, 380 aa, Bacillus cereus Rock3-28
MHMKEKRYKNMKTKQTIAASTLALAMIAGANSAHAEVNDTTPQQNTGDRLAEIKQHRQELDAKLQQHKENVDQTLNELNQVKENVDTKVNELHERKQVAEEKINEIKQHKQALDAKLQQDKQIVDEKINEIKEHKKQVDDKVAEVKEHKQNIDNKVNEIQEHKQTVDEKVNEIKQHKENIDQKVNELKEVKKQVDEKLAELKKAKQTAEDKLAELKENKPNTGNTLEELKKIKGNLDSLSANLELAKQDVKNKLAELQKARQDLLNKINEIKQAKQTVSDDLTKKKQDLDIKINDFKHTEKKIDDKLAELHTTKQNVDNKINEISQSKQTQADNSTKNNNARELPNAGSEQSNNMALGMLSVLGGVLLVTRNKIKTLFSK

SEQ ID NO: 27964 - protein, 152 aa, Bacillus cereus Rock3-28
MVSIVMELSTGVRVVPLTGPGIVKLTFVLTTAANPIPTSEVIVPNTGRIPKPVAPVGPVIPIPVGPVAPVRPVIPIPVGPVAPVGPVIPIPVGPVAPVGPVIPIPAKPVAPVGPVIPVGPVGNVNGGMDGRVGPIKFGSRESPCKIISSSLI

SEQ ID NO: 27965 - protein, 84 aa, Bacillus cereus Rock3-28
MYSVSFSIVFVIQAISSSILNLTINDFIQFAIETRVGGGSGVRATSARTDLLPLNQGDVLRVRIREAIGDIIYSNASLVVLKVD

SEQ ID NO: 27966 - protein, 1072 aa, Bacillus cereus Rock3-28
MFLPRASAEVMTHEKYSMEWSYSNSLGKYIRTEFIKNSSGQIAYCLTLGLKSPNGEDLPEMGKTDNVVYKVLLNGFPQKSTQQLGVANENEAHYATQLAVWNALGQLDVNELKHENKNVEKAAKAIINNANNSEETQDIFMNVIPAEKQKAELKGEFFETNLYTVQTNAKSGSYKVVAKNAPNGVKIVSENGEVRDQLSVGEKFRIQIPKNTKTGEFNLSVAANLTKVQAIAYRGTDTVQNATVLLERNEEKLSSDLAVNWEATGSLKIKKVGENGEVLAGAVFEVFNANNESVGKITTGADGTAELNNLQIGTYTVKEIKAPTGYVSGDKPQTIEVKTGETGAVQVVNNKVKGNIEIKKLSDSGKILPNVEFTVFTEDGKEVKKVVTKENGIAKVEDLTYGKYYFLETKTPNGYLENKTKYPFEIKEHNKTLTFTVENTEVKGSVKLLKVDNEDISKKLEGAVFELKDASGKVIGEYKTDKKGEVNVKNLAYGKYSFVEKASPNGYVLIKEPIVFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDDTKEMHTSKSVTIQDKVEYKDLQIGKEYTVKGKLMDKKTNKPLVVNGKEITTETKFTPKEANGSITLDFTFDATGLEEKEVVVFEELLKNGKIVTTHADINDKGQTVKFVKPSVKTTATNKADGGKEIHANDSITIQDKVEYTNLVVGKEYTVKGKLMNKAIKEPLLIDGKEVIAETKFTAKEKNGFVTVAFTFVGAEQQGREVVVFEDLLHEGQVIATHADINDAGQTVRFVEPSIKTTATNKADGSKELDATKSVTIQDKVEYKDLIVGKEYVVKGKLMDKATNKPLLVEGKEVTAESKFTAKEKNGSITLDFTCNASALQGKGVVVFEELYQDSVLVAIHVDIEDKGQTVKFKEVKPEQPKPEQPNPDKNTPTSEQPKEQVKEQPQPKNEIQSKIGWLPQTGTNLTSWISMAAGALLLIVGGVIFLKRKNA

SEQ ID NO: 27967 - protein, 971 aa, Bacillus cereus Rock3-28
MKGYSKKVLVGVSFASLLLGSFQGSISAENTKEEQVSYRNVLKMEPVGVQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLKQQGQTYTQDDSKGIETLVEVLRSGFYLGFYNTELSKLNERSYHDKCLPALKTIASNPNFKLGTLEQNRVVSSYGKLIGNASSDVETITSAAKIFKQYNDSFSTLVDNLSAGNAIYDIMQGVDYDIQSYLYDTRKVPKDTVWYQKIDSYINELSRFALMGTITAKNGWLINNGIYYTGRLGTFHSTGTKGLQVVTDAMNIYPYLGEQYFVAAEQIATNYGGKDANGNMVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGSYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHASKPVSDIAAEITAEANVKNVSVKKNKSQFFNTFTLQGTYTGTAAKGEYEDWKTITQKVNDTLKRLSTKEWTGYKTVTAYFVNYRVNASGQFEYDVVFHGMNTEEGAVNKAPFAVINGPYSGNVNEAISFKSDGSKDEDGKIASYKWEFGDGTVSNEQNSTHIYTKEGTYTAKLTVTDDKGATNTATTSVTVKKKEDNSVEKEPNNSFQTANKLQLNQILRASLGNGDTSDFFEINVETAKNLQINVTKENNIGVNWVLYSEADLNNYVTYAQQQGNQLVGSYYTYPGKYYLHVYQYGGGTGNYTVEVK

SEQ ID NO: 27968 - protein, 312 aa, Bacillus cereus Rock3-28
MSSWSNNINGYCGCNNQNGVHVDSCCFSCDGTVPKVGPTGPTGATGVTGDTGPTGATGATGGTGPTGATGVTGDTGPTGATGITGDTGPTGATGITGATGPTGATGDTGPTGATGATGITGATGPTGATGITGATGATGATGATGATGATGATGATGATGPTGATGDTGPTGATGTSITATYAFANNTSGTAISVLLGGTNVPLPNNQNIGPGITVSGGNTVFTAANAGNYYISYSINITASLLVSSRITINGAPLAGTINSPAVATTSFSATIITTLAAGSAISLQLFGLLAVATLSTTTPGAVLTIIRLS

SEQ ID NO: 27969 - protein, 937 aa, Bacillus cereus Rock3-28
MFNVKKRWYVGGESVKERDKQNSLNSNFRISPNLIGPTFPPVPTGFTGIGITGPTGPQGPTGPQGPRGFQGPMGEMGPTGPQGVQGIQGPVGQIGATGPEGQQGPQGLRGPQGETGATGLQGVQGLQGPIGPTGPIGVQGIQGVQGLQGPIGATGPEGSQGIQGVQGIPGATGPQGIQGVQGIQGTEGPSGSTGTTGATGQGITGPTGITGPTGITGPSGGPPGPTGPTGATGPGGGPSGSTGVTGPTGATGNTGATGQGLTGPTGSTGETGAQGLQGIQGIQGPIGPTGPEGPQGIQGIPGPTGVTGEQGIQGVQGIQGITGATGDQGPQGIQGAIGPQGVTGATGDQGPQGIQGVPGPEGATGPQGVQGIQGPMGDIGPTGPEGPEGLQGPQGIQGVPGPVGATGPEGPQGIQGIQGPVGATGPQGPQGIQGIQGVQGITGATGAQGATGIQGIQGEIGATGPEGPQGVQGAQGAIGPTGPMGPQGVQGIQGIQGATGAQGVQGPQGIQGIQGPTGATGDTGATGATGEGTTGPTGTTGPTGVTGPSGGPAGPTGPTGPSGPTGVTGPSGGPPGPTGATGSTGATGDTGATGPVGVTGATGETGATGVTGLQGPQGIQGVQGEIGPTGPQGIQGPQGIQGVTGATGDQGPQGIQGPQGIQGPTGPQGIQGEQGLQGIQGVTGATGAQGPQGIQGIQGIQGPTGPQGPTGIQGVQGEIGPTGPQGVQGLQGPQGPTGDTGATGAQGPQGIQGPTGVTGATGATGATGLQGIQGPQGIQGPTGPTGAGATGATGATGVTGVSTTATYAFANNTSGTAISVLLGGTNIPLPNNQNIGPGITVSGGNTVFTVANAGNYYIAYTINLTAGLVVSSRITVNGSPLAGTINSPAVATGSFSAPIIANLPAGAAVSLQLFGLVAIATLSTITPGATLTIIRLS

SEQ ID NO: 27970 - protein, 431 aa, Bacillus cereus Rock3-28; identical to SEQ ID NO: 27130

SEQ ID NO: 27971 - protein, 79 aa, Bacillus cereus Rock3-28
MTDPKSEVTDPKGEVTDPKGEGTDRVNSQITKNNALNKQIVKKEQILPATGHDTNWLSVFGGGLMLIGAYLYRRLKRVN

SEQ ID NO: 27972 - protein, 737 aa, Bacillus cereus Rock3-28
MEGTKMKKLKPALSVVGSLTMALTLASPTLAETSLPKEGSKVEVFKEDANAQEGKNPVYDTNDKIGKLMTENIDVQNNDWDNDGISNDLEKNGYKIEFNRKTGKNEALAWDSEKDKGKLKFISNPMSANSDGDPFTDMYEVENYNSNSDTDFNPIVANIPNLQIGLKRIEVIPIATITDNNGGSISRGWEKSVATQHSFNVGLTGTGGVEGSAAGPVPSGSVSANVGYGYSKTTTETESYTNNFDWSTATTVDTAKAAKVRVHLEYKNVGTSSAENVSPHFNIRLGNKIINTVKATQDRYKANYLSTEKGGRNKTEVVIDSLEGQADVNIFLSLDELKAVEQGELLAIEVLPTSTMDVSIEKDGEFMNLGDSGKYESRVNATTEELETDIGNKPKFRVYTPKGSRAEYPVLSYNEVFKHVNIDTNKVNNIVSKSTRNNSIEVVSSSNEASYGNTLENYKNNENVGLYTNAKHGAFENLQPPKLEESSYDPITKKIRATISPGLFGAKNEISASYETRQGSTKKVTLVRSGNGHIYESRENIPFGEFLPSNKVTFEVQDSQNKLPTNKISTVVKYNTEFDNYVVDNSGEFVVEGASYTIADNNPDQYKRYWGSHHASNKWEYLQSELSSSEKVNLVIERVGQPKPGQPIKKDEEVLIKFANPIYSDYNYLKLQDGYVHLDQKRNASNFKFNSAFDGPTYYRLFKIQSSGNYIEREYDNNYMKYGTGNGKNIWNLTRAQ

SEQ ID NO: 27973 - protein, 203 aa, Bacillus cereus Rock3-28
MYKKLGTIALTGALAFSLAACGSNEKTSNGVETKKDNSKEGKTESAKGNRSNPIAFNETASIDDVILNTDGGEFKKFKAKVEVSILEVIRGEQAFGILKKENEFNEPAPEGKEWVLVKVKGKVVDAETQDFEYLLSDMNFKLVSKEGQVYNHELSAVTPNQLHQKLYKGAEGEGYISQVVNAGDDFTIQFETQKQNKVFFKSK

SEQ ID NO: 27974 - protein, 162 aa, Bacillus cereus Rock3-29; identical to SEQ ID NO: 26879

SEQ ID NO: 27975 - protein, 965 aa, Bacillus cereus Rock3-29; identical to SEQ ID NO: 26880

SEQ ID NO: 27976 - protein, 333 aa, Bacillus cereus Rock3-29; identical to SEQ ID NO: 26881

SEQ ID NO: 27977 - protein, 502 aa, Bacillus cereus Rock3-29; identical to SEQ ID NO: 26882

SEQ ID NO: 27978 - protein, 738 aa, Bacillus cereus Rock3-29; identical to SEQ ID NO: 26889

SEQ ID NO: 27979 - protein, 787 aa, Bacillus cereus Rock3-29
MKLIKGIFFSTIALTSFTGLELINMNEDPDVVYADSKDSSQNISQFQEDIKEGDKIILKFKSEVNFPYKDGLENQIKDEDSDSELVKIFSEFPQLTLKRLFTSVNPKEIENIDKHTRETENNSSSNLLDYYIVEVPNKVTAETLMDKFKKSHLVEEVYMQEKPTLLPEVQLPTVSLNPYDDPRFLNQGYLKEAPYGINASYAWSIKGGDGKGTTFVDMEYGWLLDHEDLVNQKVELISGRNIDQHVGHRTSVLGIVSAEDNKVGNIGIAPKAKVKVVSQIRGDGSYNTADAIINAVHNLQAGDILLLEAQASYDGYGDKYLPVEVQPDIFDAIRAGTDKGIIVIEAGANGSNDLDQFRNRNGKQVLNRNSPDFKDSGAIMIGATSSTVPHKRLWFSNYGSRIDVYGWGENVDTTRAEPNRITKNLYTTGFSGTSSASPIIAGAATSIQGVAKEHLGRPYKPAELRNILSNPNTGTKSQNPLTDKIGVLPDLKSILSNLGYSPDISNNVLEGNQYVWSMKGIGDFEFAKLDFNKTKEEMQIQLKAGIPHHYFDSTYASVKVQNSSGKVVYSKDIYGNRQQNAETQKIPVKVGDYIEFTHLEGGNRATLINVDKNIQESFGKKIVYQVTVNGLKKVDQIINPNPDTESPTRPEGLQTTNTTANSVELKWNSSTDNVGVKEYQVLRDGKFIQTVQGTTSIDSKLTANIEYKYTVKAIDAAGNESIQSSVLSVKTKEQNTSYEKWGPRKAYTKGDRVEYQGNIYEAVQSYQGNGDSNWIFSLSLWKPISIS

SEQ ID NO: 27980 - protein, 458 aa, Bacillus cereus Rock3-29; identical to SEQ ID NO: 26890

SEQ ID NO: 27981 - protein, 884 aa, Bacillus cereus Rock3-29; identical to SEQ ID NO: 27109

SEQ ID NO: 27982 - protein, 553 aa, Bacillus cereus Rock3-29; identical to SEQ ID NO: 27115

SEQ ID NO: 27983 - protein, 444 aa, Bacillus cereus Rock3-29; identical to SEQ ID NO: 27936

SEQ ID NO: 27984 - protein, 878 aa, Bacillus cereus Rock3-29; identical to SEQ ID NO: 27119

SEQ ID NO: 27985 - protein, 380 aa, Bacillus cereus Rock3-29
MHMKEKRYKNMKTKQTIAASTLALAMIAGANSAHAEVTDATPQQNTGDRLAEIKQHKQELDAKLQQHKENVDQTLNELNKVKENVDTKVNELHERKQVADEKINEMKQHKQELDAKLQQDKQIAEDKINEIKEHKKQVDDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAELQKARQDLLNKINEIKQAKQTVSDDLTKKKQDLDIKINDFKHTEKKIDDKLAEVHTTKQNVDNKINEISQSKQTQADNSTKNNNARELPNAGSEQSNNMALGMLSVLGSVLLVTRNKIKTLFSK

SEQ ID NO: 27986 - protein, 971 aa, Bacillus cereus Rock3-29; identical to SEQ ID NO: 27110

SEQ ID NO: 27987 - protein, 342 aa, Bacillus cereus Rock3-29
MSSWLNNTNGYCGCNNQNGVHVDSCCFSCDGTVPKLGPTGPTGSTGATGSTGATGSTGATGSTGATGSTGATGSTGATGSTGATGPTGATGATGPTGATGITGATGITGATGPTGATGITGATGPTGATGITGATGPTGVTGITGATGPTGATGSTGATGITGATGPTGATGSTGATGATGPTGATGITGPTGATGDTGPTGATGTSITATYAFANNTSGTAISVLLGGTNVPLPNNQNIGPGITVSGGNTVFTAANAGNYYISYSINITASLLVSSRITINGAPLAGTINSPAVATTSFSATIITTLAAGSAISLQLFGLLAVATLSTTTPGAVLTIIRLS

SEQ ID NO: 27988 - protein, 956 aa, Bacillus cereus Rock3-29
MKNRDNNRKQNSLSSNFRIPPELIGPTFPPVPTGFTGIGITGPTGPQGPTGPQGPRGLQGPMGEMGPTGPQGVQGIQGSVGPIGATGPEGQQGPQGLRGPQGETGATGLQGVQGLQGPIGPTGPIGVQGIQGVQGLQGPIGATGPEGSQGIQGVQGIPGATGPQGIQGVQGIQGTEGPSGSTGTTGATGQGITGPTGITGPTGITGPSGGPPGPTGPTGATGPGGGPSGSTGMTGPTGATGNTGATGQGLTGPTGSTGETGAQGLQGIQGIQGPIGPTGPEGPQGIQGIPGPTGVTGEQGIQGVQGIQGITGATGDQGPQGIQGAIGPQGVTGVTGDQGPQGIQGVPGPSGATGPQGVQGIQGPMGEIGPTGPEGPEGLQGPQGIQGVPGPVGATGPEGPQGIQGIQGPVGATGPQGPQGPQGIQGIQGVQGITGATGAQGATGIQGIQGEIGATGPEGPQGVQGAQGAIGPTGPMGPQGVQGIQGVQGATGAQGVQGPQGIQGIQGPTGATGETGATGATGEGTTGPTGTTGPTGVTGPSGGPAGPTGPTGPSGPTGVTGPSGGPPGPTGATGSTGATGDTGATGPVGVTGATGETGATGVTGLQGPQGIQGVQGEIGPTGPQGIQGPQGIQGVTGATGDQGPQGIQGPQGIQGPTGPQGIQGEQGLQGIQGVTGATGAQGPQGIQGIQGIQGPTGPQGPTGIQGVQGEIGPTGPQGVQGLQGPQGPTGDTGATGAQGPQGIQGPTGVTGATGATGATGLQGIQGPQGIQGPTGATGVTGSQGSTGDTGPAGSQGIQGPTGPTGAGATGATGATGVTGVSTTATYAFANNTSGSVISVLLGGTNIPLPNNQNIGPGITVSGGNTVFTVANAGNYYIAYTINLTAGLLVSSRITVNGSPLAGTINSPAVATGSFSATIIANLPAGAAVSLQLFGVVALATLSTATPGATLTIIRLS

SEQ ID NO: 27989 - protein, 431 aa, Bacillus cereus Rock3-29; identical to SEQ ID NO: 26893

SEQ ID NO: 27990 - protein, 725 aa, Bacillus cereus Rock3-29
MGNSTTKSKKLVGFVATATLATSMIAGASNASAQTTDTLKTAEPVQEKAKDKKEERPESLFPSMDINYDTTIYVGDPFDPMAEVSAYDSKDGDITDKINIVGEVNPFEPGGYNLDYTVTNSRGFSVIKQVHVWVKRGEKPILRLPYRVSINVGDKFDPMTGVSAIDEKDGDITSKIKVDGNVDTSKPGTYEVTYTITNSKGLTIVRKQPVKVKETEGTKNEAPVLTVPFTTTLHVGEEFDPMAGVSATDKEDGNLTNKVKYKGNVDTSKPGKYIVEYWVVDSKGVNATATRSVIVKENEEIPDMEPKLTAPTKTTINVGDKFDPMAGVSATDKEDGDITSKVTVDGSVDTSKPGTYELTYTVLDSKGHTVIAKQTVTVKQKVETTNEAPVLTVPFTTTLRVGEKFDPMAGVSASDKEDGNLTNKIKYKGNVDTSKPGKYIVEYWVVDSKGVNATATQSVIVKENEETPDMEPKLTVPTRTTINVGDKFNPLSGVKAIDNEDGDITDKVTVDGSVDASKPGTYELTYTVKDSKGHTVTAKQTVTVKQKVESKDEDPVLTVPTEVTLHVGDKYNPLSGVKAIDKEDGDITDKVIHLGEVDTSRAGNFEVKFLVRDASGNEVTATQKVTVKDTDTENGSDNSNNNTNSGEGPDNTTTTTTTTTTTTGNVSDNNNNNNNTSSNLDSKKDAIKELPKTGANSNNGTAVGILAILAGMLITFGRKFKKAIK

SEQ ID NO: 27991 - protein, 812 aa, Bacillus cereus Rock3-29
MGKATVKSKKLVGIVATATLATSMIAGTSNASAQTTDSLKVGEPVQERAEDKKLTLFVPPQNVVFVGDTFDPMKDVWAKDKNGKDITSRVTYTGDDKVDLTKMGEYELTFTVSDDEGNTVVQKQRVVVRYNHVTNTAPTILILRDKITLNIGDTFDPMEGVTGSDSEEGILTHKITYDNGLDTSKPGTYYITYYLMDSQGKMDLKTRTITVIDQSPVITTPDEFVITEGEQFDPMAGVKATDPEDGDITSKVEYEYYTGSVNKPGTYKVYYKVKDSFGNTANTVATLIVREKIKPVDEAPELKVPTATTITEGDKFNPMSGVSATDKEDGNITSKVTVDGSVDASKPGTYELTYTVSDSKGHTVTAKQTVTVKQKVEIKNEAPELTVPFTSTLRVGEKFDPMAGVSATDKEDGNLTNKVKYKGNVDTSKPGKYIVEYWVVDSKGVNATATQSVIVKENEETPDMEPKLTVPTGATINVGDKFDPMAGVKAIDNEDGDITDKVTVDGSVDASKPGTYELTYTVSDSKGHTVTAKQTVTVKQKVEPTDEAPVLTVPAEATINVGDKFNPLAGVKATDNEDGDITDKVTVDGSVNTSKSGTYELTYTVSDSKGHTVTAKQTVTVKQKVEPTDEVPVLTVPAEVIINVGDNYNPLAGVKAIDNEDGDITDKVIHMGEVDTSKAGNFEVKFLVRDASGNEVTATQKVIVKDKDTEDGSDNDNNNTNSGNGSDNSNNNTNSGNSSDNSNNNTNSGNISDNNNTSSNNNTTSTLDNKKDTIKELPKTGASSNNGTAAGILAILAGMLITFGRKLKKTTK

SEQ ID NO: 27992 - protein, 213 aa, Bacillus cereus Rock3-29; identical to SEQ ID NO: 26884

SEQ ID NO: 27993 - protein, 190 aa, Bacillus cereus Rock3-29
MLNEERWKGLIPDEYLSASALDPNLIGPTLPPIPPFTFPTGPTGSTGPFATNTNAFIVNFTTTALIPQGTGIPLDTNLILTPGISHTPGSSVINLDAGTYLVEYNTVSQAPTGNFVSTRALLNGSTITGAIVVSPQVASGTFQSLSSGFLVIAPNPVNTLEIAADSLGGNIYNSQFASIPNVSVRIVRLS

SEQ ID NO: 27994 - protein, 55 aa, Bacillus cereus Rock3-29
METEKYLQVVEDEELEQLVGGAGPGWVETLTKDCPWKQPAACVIIMGQKICKKCY

SEQ ID NO: 27995 - protein, 124 aa, Bacillus cereus Rock3-42
MKEPVKEVEETKEEVKEPVKEVEGTKEEVKEPTKEVEEAKEPKKEVKESATGVDQEPKGNNQVVENEGRKADTLNKQHTNKPEEGKKSLPSTGGEASTLTLLSGITLVLYALSMFVFRKRLFKK

SEQ ID NO: 27996 - protein, 949 aa, Bacillus cereus Rock3-42
MALSLGALQAPVLAEEKVPYNVLKTKPVGIEKPVDEIGHVSKAEETLSFQERLKVGDFSQRPASITNKAAVKQVKESYSMADLKKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHASKSLTAVEKEITETLPMRDAKMTKHSSQFFNTFTLEGTYTGSVTKGESEDWNAMSKKVNEALEQLAQKEWSGYKTVTAYFVNYRINSSNQFEYDVVFHGIAKDDGENKAPTVNINGPYNGFVKEGIQFKSDGSKDEDGKVVSYLWDFGDGSTSAEVNPVHVYEREGSYKVALIVKDDKGKESKSETTVTVKDGSLTESEPNNRPEEANRIGLNNTIKGSLIGGDQTDVYTFNVASTKNIDISVLNEYGIGMTWVLHHESDMQNYAAYGQANGNHIEANFNAKPGKYYLYVYKYDNGDGTYELSVK

SEQ ID NO: 27997 - protein, 338 aa, Bacillus cereus Rock3-42
MEVWNVKGKLLKGVLSFGIGLGVLYGGSSAQADTSTDQNNTLKVMTHNVYMLSNNLYPNWGQNERADLIGAADYIKNQDVVILNEVFDNSASDRLLGNLKKEYPNQTAVLGRSNGNEWDKTLGSYSSATPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFIENKVLQPKSPQWTVTSWLKKYTYNDYSDHYPVEATISMK

SEQ ID NO: 27998 - protein, 368 aa, Bacillus cereus Rock3-42
MQLCITIPSVLFSCYDINEIRHISTKIKGSDCMKRSKTYLKCLALSAVFASSALALSTPAAYAQTTSQVVTDIGQNAKTHTSYNTFNNDQTDNMTMSLKVTFIDDPSADKQIAVINTTGSFLKANPTISSAPIDNYPIPGASATLRYPSQYDIAFNLQDNSARFFNVAPTNAVEETTVTSSVSYQLGGSVKASATPNGPSAEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKSFTLDWKNKKLVEKK

SEQ ID NO: 27999 - protein, 503 aa, Bacillus cereus Rock3-42; identical to SEQ ID NO: 26407

SEQ ID NO: 28000 - protein, 412 aa, Bacillus cereus Rock3-42; identical to SEQ ID NO: 27691

SEQ ID NO: 28001 - protein, 455 aa, Bacillus cereus Rock3-42
MNNRLLKQLQNMKMNKKSLGAVALTAGIISTTLIPQNAYAHGFVEKPGSRSALCSSTYGALNVNCGSVMYEPQSLEAPKGFPQGGPVDGQIASAGGKFGGILDQQTADRWFKNTITGGENTFTWKYTAPHLTSKWHYYITKKGWDPNKALTRADFEPIGTVQHDGSAASNQLTHKINVPTDRSGYHVILAVWDVADTANAFYNVIDVNLINDVKPDTEAPSIPNGIQAQKITANSIELAWNASTDNIGVKGYQIFRNGEMVDTVTGPHFIDKKLQPSTEYSYTVKAIDVAGNVSKESATLKIKTTVEAPDTEAPTQPKGLHSMGTTASSVDLMWSPSDDNIGVDHYDIYREIEGSMKKIATSNTTSYMDKYLLSNTTYKYVVKAIDVAGNESIQSDIFTITTKTESATYEEWDAKKAYEKGDRVLHEGKVYEAVQSYKGNGDPNWIYALSLWKTV

SEQ ID NO: 28002 - protein, 372 aa, Bacillus cereus Rock3-42; identical to SEQ ID NO: 26664

SEQ ID NO: 28003 - protein, 971 aa, Bacillus cereus Rock3-42
MKGYSKKVLVGVSFASLMLGSFQGSALAEGTKGEQASYRNVLKMEPVGLQLPVQELAHSSKVLENKSFEKRLQFADLSQRPPELKKESKQLATAKTYTIAELNQLSNQQLVDLLVTIDWEQITGLFQFNKDSLAFYQNDSRIQAIIDKLKQQGQDYTKDDSKGIETLVEVLRSGFYLGFYHTELSKLNERSYHDKCLPALKTIANNANFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKAPVAVINGPYSGNVNEAISFKSDGSKDEDGKIASYKWEFGDGAVSNEQNPNHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 28004 - protein, 291 aa, Bacillus cereus Rock3-42; identical to SEQ ID NO: 27260

SEQ ID NO: 28005 - protein, 774 aa, Bacillus cereus Rock3-42
MLAGATLAIGVMAPQVLPATAHADEKTGESTVNLRILETSDIHVNLMNYDYYQTKTDNKVGLVQTATLVNKAREEAKNSVLFDDGDALQGTPLGDYVANKINDPKKPVDTSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADIIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTTPPTGEGDNGENPTTPPTGEGNNGENPTTPPTGEGNNGGNPTTPSTDEGNNAGSGQTTTDNQNSKETTTVSENKEERDLPKTGTNVASTIGAGLAFIGAGFLLLFRRKKANR

SEQ ID NO: 28006 - protein, 117 aa, Bacillus cereus Rock3-42
MLGGTNISLPNNQNIGPGITVSGGSTVFTVANAGNYYIAYTINLTAGLLVSSRITVNSSPLAGTINSPTVATGSFSATIIASLPAGAAVSLQLFGVVALATLSTVTPGATLTIIRLS

SEQ ID NO: 28007 - protein, 79 aa, Bacillus cereus Rock3-42
MKPEDPKEPEVKPEDPKKPEVKLEKPEVRLEKLIKEPQVKVERELPKTGTASPWMVSVGAGISFLVGGVLFVLGRRRKQ

SEQ ID NO: 28008 - protein, 431 aa, Bacillus cereus Rock3-42; identical to SEQ ID NO: 26106

SEQ ID NO: 28009 - protein, 564 aa, Bacillus cereus Rock3-42
MKKLFSMVLAFILMFSTLPSAFAANEAPTKGSLTIHKYAHEKDGQEGEAGTGEPGQKIPEGATPIEGVEYEVIQIASFEVITKDGEIVKEGEKEVKNATPIKDKTGKDGTVKFDNLPIGRYLVKEISGPTNVNLNTDPYTIEIPMTDKEGKKLNYDVHIYPKNEIKRGAVELTKTDDAGKPLENVEFTLYHKGTDKVVVDKAGKELKDLKTDKDGKIRVDGLLHGEYYFKESKALPGYVLDPKHREFKIEKSGAFPKDGQAGYGEIVKLDTIINYKKPTIDKKINGNLNGLPINVDEEFTYDIKTTLPGDIHKYKKYVITDNVDPKLTIIGTPVVTIDGEKVSSDVVKVTLGEKTAAGQLVTVTVENFKALEGKKELHLQIKAKVNGDINGGTEIKNIAKIDYETGDEVTPPDDETTTPPVTVIVTDGKISLKKIDGATKDALEGAKFELQKDGKVVKVKGVDVVGVSDKDGMINWENIPYGEYEIIEIEAPKYTDKGEVKSYQKLREPIKVKIDKDNQTVKLTVENNKSGWILPATGGIGTILFTVVGLVLMGAAFMFLRRKA

SEQ ID NO: 28010 - protein, 3330 aa, Bacillus cereus Rock3-42
MKKLFNICLIVFVLFSQFISFPYNQAKAETLKETSLFDTVEMKDATDHIIDEAKNPNNLIKIGSTIQVEYAWSIKDQQVVHANDTAVIQIPLALKVSKDLQGDLVTDQKNIGQYFITAKDNKLKLIFNDQVENSKDAKGKIKIDTVFNPTLKAEEKSVQIAFPLGTLVQPITVPIQVEDSKEDGTKQDTNKQVPDQVAKPATDNPEQNPATKPATDNPEQNPATKPVTDNPEQNSATKPATDNPEQNPATKPVTDNPEQNPATKPAADNPEQNLASDPAESTNSGPKQITTNILTGVKLTDKDGKPFTEDNRPSTDSPANIEFTWELLKSMNVKSGDYYIFDLPKHFKIYNTINSPLYDSENNPIGNFTVTKDGKVTMTFNDYVEEHPDVVGNLQLKTEFNKAEIKGTTTQEIPFPIKDKDVSITVDFKPNIQTTTNKKGLPDRPINTNEINWTVEMNKTKDTLKNAVFKDNIPQGTSLNKDSIKVYYLEVDVNGNATRGKEADPADYKIISSDGSKLEIAFKDSIKEAYQIEYVTKITDENVKNFQNNVTITSDNQGQQKASSTVTVSRGTHLNKTSKYDPKTQTIEWTITYNGDQRNIKKTDALLKDIFDDTHELDVNSIVVKNASYDDKGRLVTGDAVNNYTVSNKKNGFDLQFNEDINSAYVITYKTKPTNNVIKDGKIKNIVTADNGSSKENEAGFQQQNIIKSNNKAETNYKDKTTTWTITVNNNNYPLNNAIITDTFDHGGLQLKDKKLEIKDGDYTLQAGTDYVLDVTDKGFKITLIGTYQSNMTKTLVVKYTTDFDYTKLESGKTSFKNTGNLSWIDTDSNPQSNKVEANFDPDNFTKANGYKYGSYNAQTKEITWVIGFNYNNVEIKDPYVIDVIQDKQKLVPGSIEVRDMILNGSPDNAQPGNAVPAEKYELEEPTEKNKNTLKVHFKQSINSPYYIIFKTSLDGELIQGTYKNEAELKDGSKIVNTLKGDAQVNKGGSFVTKKAVQDDNYINWSIAINESQSTIADAVVTDDPTDNQVLVEDSFHLYPTTVDYYGNVTKDTANELKQGTDYKLKITTDNNTGKQHFEIAFLKKIDRAYILEYRSLINADDKEKVSNKAKIAGNQLTVKNTETTETIEVRMSSGSGGGSATKGRGNLEIIKVDNDNKNTLLTGAEFTLYDRTGKTVIRKITTDKDGIAKFNNLKRDKYLLKETKAPEGYVISWDLKQGKIVELGTQETTTYKLANKKFVGKVVLTKSDDLNKNVTLQGAVFTLLDKDKKIISEHEKLTTNNKGQITVDHLKPGIYYLKETKAPEHYKLDDRLIEVKIAEDQTTVINRTATNSLIPGSAILTKVDKDGKTLAGAEFSVRDRKNKIIPGYGKLTTNDQGQIEAKDLRPGDYQFVEEKAPKDYDIDKTPIEFTIVKSQKKAVTVTATNHLIKGGVTLTKTDDIDGTALAGAIFKIVDANDEKKVIRENVKTGADGKVTVKDLEPGTYKFIETEAPKDYVLNTKPIEFTIDKSQQSFATVTATNSLKTGEVELLKVDEFGDKKPLAGAVFKIVDVNNNDVRTDLTTDADGKTKADKLRPGTYKFIETAAPEHYVLRAEPIEFTIDRSQKETLLVKAENALKPGDVELTKVDDIDGTALAGAVFKIVDANDEKKVIRENVKTGADGKAIATGLRPGDYKFIEVTAPKYYDKNTKPIEFTIKESQGISPITVTAKNSLTKGGIELTKVNAADEKETLEGAVFKIVNRDTNEDARTNLVTNSEGKLVVDDLRPGNYKLIETKAPTYYDVNVEPIEFTIEKGQQTLLPLTFKNSLTKGKVKLIKEDDVESSIALAGAVFTLQDANGTEIAKDLKTDEHGALVIPDLAPGDYQFIETAAPEHYKLDQTPIKFTIKKGSKDDLPVPVTVKNSLLTGGVTLTKVDDVDGTTLEGAEFIIVDAHDTKKVVRKGLTTDEHGKVSASDLRPGDYQFIEVKAPKDYTLGNDPIPFTIGKSQKENITVTATNSLKKGAVTLTKIDDIDRTMLKGAIFKIVDMDGNEVRTNLVTDKNGKIHIPDLRPGDYQFIETKAPEHYVLDETPIPFTIERSQTKEINVTGKNTLKKGSVELTKIDDIDTDTKLANAVFNLLDADGEIVEEGLKTNAEGKIVVENLRPGTYQFVETIAPEHYDLNKTPIEFTIKKSQTETLHVTAKNALTKGAVELSKVDDIDGTKLEGTVFNIVDMKGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKKPIVVTVEKSQKNIATVTMKNSLTKGGVELSKVDDVDGTTLEGAVFNIVDMNGTVIRKSLTTNSQGKISVPDLRPGDYQFIETMAPKHYDLNKEPIPFTIEKGQAEPISVTAKNSLTKGAVELSKADDIDGTALEGAIFKIVDMNGHDVRTGITTDAKGKVSISDLHPGDYQFIETTAPKHYKLDATPIKFTIEKSQAEKLQVTAKNSLIEGAVELIKVDDINPDTKLSDAVFNIIDAKGKVVRTNLTTDKDGKISASNLRPGDYQFVETKAPKHYDLNETPIPFTIEKSQSTHVSVTAKNGLTKGGVELTKIDSLDTKETLEGAVFKITDLNGNDIRTNLVTNKDGKIIAKDLQPGDYQFIETKAPKHYDLNETPIKFTIERSQTKHVFVTAINSLTKGSVELIKVDDVEENTTLEGAVFKIVNKDGHDVRTDLTTDKNGRLVVDELPPGDYEFIETKAPTHYKLNETPIKFTVKKGQEKIASVTAKNSLTKGAVELSKVDDVDGSALKGAVFKIVDMNGNDVRTDLTTDKDGKISVSDLRPGNYQFIETKAPKHYDLNQTPINFTVEKSQTATASVTATNSLTKGAVELTKVDDIESVTLEGAVFKIVDMNGNDVRTDLTTDKDGKISVSDLRPGDYQFIETKAPTHYDLNQTPINFTVEKSQTATASVTATNSLTKGAVELTKVDDIDGTTLEGAIFKIVDQNGNDVRADLTTDKDGKISVSDLRPGDYQFIEKKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKVESSSGGDNKPITPPNKEEKPGKETSEELENGNPETHGKETSEELENGNPETHGKETSEELENGNPKTQTNKQQDDRNTGKELPNTGHKNDSTQTVGIILLLAGLLSVLATKRKKYY

SEQ ID NO: 28011 - protein, 769 aa, Bacillus cereus Rock3-44
MTMKKLKPTLGVLSSVTMALTLASPTLAETTPEQGGKVETFKEDKNVKEGQKIIYDGSEKKGIMIMEEPQENNDWDNDGIPNDVEEKGFKIVFNKKTGKNEAQLWDPQQDFGEKRFITNPRSANSDGDPFTDSYEVEHYGSDSDVDFNPMIANVPNLQIAVKRIDITPVASITDSNGESRTKTWEKSLSVQHSFNIGLAGEAGAEGSAAGPVPSGKGSLNVGYGYSNTKTETESISNSFDWSTATTVDSAKAANVRFHLEYKNTGTASAGDVSPHFNIRLGNKIINTVKATQDRYKANLLTTEKGGNNKTEILMDSVEGQADVKISLTLDELKAVEQGAPLSIEVLPTSTMNVYTMKDGKFENLGDWAHFASNVNASTTLIETNLGSIPKFRVYTPKKDKAKPASVEHNLSLDEFFKNSGIDSYAWTVNAVVNGQLNKNLVRYGPNRSLLERGVNLGFFDNRALRPTLSYSSYDYSKKKIYASVIPGLFNISDEIFVTVRNKEGEQQKVKLVRNKNSNVYESKENEPVDLAVNKRALGAIPVKFELNDVQNNKTEVSVPLVSNKSYLEAIDKLVVDNSGEPILEGKQYYLKTNVNIREGVQENWHIGLDQTISGRYVHFSPQSNWDRLRLGPIQKAIHGTDIQATPVMIERKGQPKPGQPFKKDEEVFLKFTNSSYSGYQYLNIGNGYDYNWLDTENNRSSIKLDKLPNEKSFYLKSDSTYITFRQNNWLSSVADNGSAPLVAGSEFILKPDHTTSPGNNHKWELESIK

SEQ ID NO: 28012 - protein, 868 aa, Bacillus cereus Rock3-44
MLGVGIVTISCNGMQIQAETKEKNTKNVLQMEPVGIQKSVDELAHSSNVQENASFTKRLKLADLSQRPPAPKENAKQLVEEKKYSMAELNQLSNKQLADLLVTIKWYQIPELFQFNNDSLKFYQDDSRMQALIDKLAEQGQTYTKDDSKGIETLVEVIRSGFYLGFYHQELSKLNERSYHDKCLPALKTIAKNPNFKLGTSEQNKVISSYGMLIGGASSDVEIIQYAAEIFKQYNDNLSTFIEDRTKGDAIYNLMKEIDYDVQSYMYTTGKEPKDTMWYRNIDSFINEINRFALIGTVTDKNGWLINNGIYYAGRLGKFHSTQAKGQQVVTEAMRIYPYLGEQYFVAAEQIATNYGGVDANGKTVNLDQIREDGKKKYLPKTYTFDDGTIVFKAGDKVSEEKIKRLYWAAKEVRSQFYRTVGSDKPLESGHADDVLTMVIYNSPDEYQFNRQLYGYETNNGGIYIEGIGTFFTYERTPEQSIYSLEELFRHEFTHYLQGRYEVPGLWGQGDMYQNERLTWFEEGNAEFFAGSTRLDSVVPRKSIIGGLSNDPAKRYTAEQTLNAKYGTWDFYNYSFALQSYMYNNRPEMFDKVHDLIRANDVTNYDAYRSALSKDSKLNEDYQSYMQMLVDNRDKYTIPQVADDYLAEHKPKALSEVTADITSEAKLKNVNVTKNKSQFFNTFTLQGTYTGSASKGETEDWKTMNQATNDMLKHLSGKEWSGYKTLTAYFVNYHVNAAGQFEYDVVFSGVNTEEDTTVEKEPNNEFNTANPLSLNTLLRGSLSDQDQADRFVIDVKNPKDLQITVTNEQNIGLNWVLYSESDLNNYAAYPTKRDGNKLLGNYNANPGKYYLSVYKSGGGSGNYTVEVK

SEQ ID NO: 28013 - protein, 502 aa, Bacillus cereus Rock3-44
MLKKRVVAIAAAIPLVLGTVSTASAVEGKQVKIDRYSPQEKAAEYLKANAAQYVLKPDLSDLQYISTTDTQVASYVRFQQVVNGSPVFSRQITVTLNGKGQGLLAVSDYQPVQKVKEIKQKISEKDAEQKSKAYVGGESEQNLWAPTMNEFGYVIEDGVAIPVYRVVVHSNQPFGAWETFIDAESGKLIKKVDINRKAEGTGKVFMPNPVVSSGSLTGLKDNNDADSATLNNQLKTVTLKGLNGTGFLVGDYVTISSKAKTKSSTLQFNYTRANDSFEDVMAYYHIDTLQRYIQQIGFNNINNRSIKVNVNGTRDDNSFYSPSTKALTFGTGGVDDAEDAGIIAHEYGHSIQDNQVPGFGNSAEGGAMGEGFGDFLGATYEDATSNTGYGKACIGEWDATSYSSSNPTCLRRLDNNKVYPRDVQNEVHADGEIWAQGEYEMAQAFGRDVATKIILQSHWSLTPNAKFNDGAKAIKQADALLYGGQHAAEIDRIWAARGIRTN

SEQ ID NO: 28014 - protein, 972 aa, Bacillus cereus Rock3-44
MRGYSKKLLTGVSLIAFMLGSFQGEVLAKDDKKENTHSYRNVLRMEPSGERVPLQELAHSSNVLENKSFEKRLQLADLSQRPPEAMKEAKQAVPAKKYTIAELNQLSNQNLVDLLVTINWEQISGLFQFNNDSLAFYQNDSRMQAIIDKLAQQGQTYTKDDSKGIETLVEVLRSGFYLGFYHNELSKLYERSYRDKCLPALKAIAKNPNFKLGTSEQNKVVSLYGKLIGNASSDAEIISLAAPIFKQFNDNLSTYVGSRSAGSAVYDLMQGIDYDIQSYLYDTEKGPKDTMWYRKIDSYINELSRFALIGTVTDQNGWLINNGLYYTGRLGMFHSTPTKGLQVVTEALKVYPYLSEQYFVAAEQITTNYGGKDANGKVIDLDQIREDGKKKYLPKTYTFDDGAIVLKAGDKVTEEKVKRLYWAAKEVKAQFHRTVESDKSLEQGNPDDVLTMVIYNSPEEYQFNRQLYGYETNNGGIYIEGTGTFFTYERTPEESIYSLEELFRHEFTHYLQGRYEVPGLWGQGKFYENERLSWFEEGNAEFFAGATRTDNVVPRKSIIGGLSSNPADRYTAEKTLNAKYGTWDFYNYSFALQSYMYNKRYDMFDKIHDLIRKNDVQGYDAYRSALSKDQGLNKEYQDYMQMLIDNREKYNVPLVSDDYLANHAPKPVSDIASDITAEARLKDVKVTKHKSQFFNTFTLQGTYTGDAAKGEYEDWKTITKTVNDSLKRLSAKEWTGYKTLTAYFVNYRVNASGQMEYDVVFHGINTEGNTENKAPIAVVNGPYTGNVNESISFKSDGSKDEDGQILSYKWEFGDGQTSGEKNPSHVYTKEGTYTAKLTVTDDKGVSTSVTTSVTVQKKDTGSVETEPNNSFKTANKITLNQLLRASLSDADNNDFFEINVETAKNLQISVTKENNIGVNWVLYSAADLNNYITYAQPEGNKLVGSYYTYPGKYYLHVYKYSGGSGNYTVEVK

SEQ ID NO: 28015 - protein, 198 aa, Bacillus cereus Rock3-44
MEEINMKKPFYKKWWFWVIVVIIVVAATGNNDDKKEETKTTSTEPKQEVKQETKQEEQKKEEPKKELSKEGESSKVKIAVGAVESLESVGNEYVNEKAQGIFKVVEVSITNNQKDAITVDANSFKLVDNQDREFTYSTQGQTSFDIANGGKTDFFLKQLNPGLTQTGKIVFDVPKDAQGLILKARGGMTGKEIKLKVD

SEQ ID NO: 28016 - protein, 70 aa, Bacillus cereus Rock3-44
MLVSSRITINGAALAGTINAPALATTSFSATIITTLAAGDAISLQLFGLVALATLSTATPGAVLTIIRLS

SEQ ID NO: 28017 - protein, 430 aa, Bacillus cereus Rock3-44
MSTIIDVYAREVLDSRGNPTVEVEVYTESGAFGRAIVPSGASTGEHEAVELRDGDKSRYLGKGVVNAVNNVNETIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRVLTSAEMVDFYEGLCNDFPIISIEDGLDENDWDGHKLLTERLGKKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGLKSFYNLKK

SEQ ID NO: 28018 - protein, 95 aa, Bacillus cereus Rock3-44
MHVKEKEKNKDENKRKDEERNKTQEEHLKEIMKHIVKIEVKGEEAVKKEAAEKLLEKVPSDVLEMYKAIGGKIYIVDGDITKHISLEALSEDKKK

SEQ ID NO: 28019 - protein, 132 aa, Bacillus cereus Rock3-44
MEQNSNEVQEVFAKAFAYYIEPQHRDVLQLYAPEAFNYMDKFNEQEINLSLEELKDQRMLSRYEKWEKIKQHYQHWSDSLSEEGRGLLKKLQIPIEPKKDDIIHSLSQEEKELLKRIQIDSSDFLSTEEKEF

SEQ ID NO: 28020 - protein, 352 aa, Bacillus cereus Rock4-18
MKKVILPILMSSMFIIPAVSHAEENVFSQKKADTIEQVQEKRGWFQGTGYWLYYNEDGSLAIGWKNINGKWYHFDETGMMATYMKNIQGKTYYFNEDGSMQIGWKKVRVWHYFNEDGSMAKDWKKINGSWYHFDKDGYMSDGRRTIGGKTYTFNADGTMVTGWQEIKSGPYTGKWFYYNADGAMATGWAQVKGKWYYFDASGVMQTGWLKNNNVWYYLNTDGSMKSTENNWNEGWLEENGKRYVFDDTGAMRKGKLAEGGTVWYFNEDGSMLTGWKQLEEGWYYFNDQSGASEQGWFSNKGKWYYFEDGPMKTGWLQENKNWYYLQSSGDMAVGKHLINGKWYTFKHNGIMM

SEQ ID NO: 28021 - protein, 489 aa, Bacillus cereus Rock4-18
MDAGGYIYMGTRQKILMQAMMLVVMVMMSVVFSKEVGAESENKSDWIDSVHVTPSEVSFGNEMKVKVTVKVNNPNGIGSDISIKYILPYLDEEEEEVYEYVNLKYNLETDLYEGVLNTYFDFEQVGTWEIDMIHSGVLGLIAYNSNVHEPRDSSERESMEELSSGNITLLEPVVGWNYFKEYGETQGHWYYFDEKKLEFVTGWFKENGKQYYLNDNGMMVTGWVLVDGKWYYLKENGSMVTGWTLVNGEWYYLSADGAMKTGWTLVDGKWYYLKESGSMMKGWALVNGHWYYLNAEGSMATDWILVNNTWYYLNASGSMVTGWLQKDRNWYYLHSNGAMAVGKHFIDGKWYGFKENGAMMSDWNNGKTGWRIENGKLYYLNHKGVKVTGWLQDSGKWYYFNTKGEAVIGSIFNNGKSYYLQNDASMAIGWISLEGEKYYFDENGVRAAGWKEIDGKWYSFFPPTGKMSKNTWVDSKYWVDANGVWTKTR

SEQ ID NO: 28022 - protein, 502 aa, Bacillus cereus Rock4-18
MLNKKMVAMAMTVPLVMGTISTVSALEKKQVKVEAYSPQKKAVEYLKGNANQYGLKPDLSDLQYISTTETSVASYVRFQQIVNGAPVFSKQITVTLNGEGKGVLAVSDYQPVTGVKEVTTKISEKDAIQKSMAYVGEASEQNLWAPTEKEFGYIVEEGVALPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAMTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNAKFRDGAKAIKQADALLYGGQHAADIDRIWAARGISTN

SEQ ID NO: 28023 - protein, 890 aa, Bacillus cereus Rock4-18
MKNKKEIAIVALTTGLALTAVAPYGIGHAEETDQLQVQMQEESFRSGELTQPSQKTPENVVKDALKEKTEQALSPKQVNGETGVDYKVFQKRGSYDGTTLVRMQQTYEGKEVYGHQLTAHVDNKGVIKSVSGDSAQNLKQEDLKKPIKLSKEEAKQYIYTKYGSDIKFISEPEVKEVIFVDENNGQASNAYQVTFAAATPSYVSGTYLVNADNGEMLKNMVQESGLKVSEEHVEPLKESRKNNFVSLTGTGKDDLGITRTFGISEQSNGKYALADYTRGQGIETYDVNYRDITNEEKYYPGILVTSTSPTFTDPKAVSAHFLATKVYDFYKDKYKRNSFDNKGKKVVSVVHAWDSGGTNNPKNWENAFSANINNISMLIYGDPMVKAFDIVGHEFTHAVTSSESNLEFFGESGAINEALSDIMGTAIEKYINNGEFNWTTGEQTGSVFRNMKNPSSINYSNGVPYPDDYSKYNDLNGEDNGGIHFNSSIINKVAYLIAQGGTHNGVTVNGIGEDKMFDIFYYANTDELNMTSNFSELRLACLKVATNKYGANSIEVQAVQKAFDAAKIKGAVKENEKTAENQVPELTVPSTITLRVGDTFDPMRNVTAADKEDGDLTNRVQHKGDVDTSKPGKYIVDYLVVDSQGSNATATQTVIVEENGEILDIEPKLTAPVGVTINVGDSFVPMTEVLAIDKEDGDLTSKVKVDGKVDTSKAGTYVLTYTVTDSKGHEVTAKQTVTVKVREEVKNDNPILKVPATTTINENDQFDPMVGVSATNKKNDDLTSKVKVDGKVDTSKADTYEIIYSVRDSVGNEVKAIQKVLVKDKDTSKANGLASNSNISNNSNYDKKEYTYKELPKTGASTTNSAIMGMLMVIAATVLTLVRKCRKIQK

SEQ ID NO: 28024 - protein, 553 aa, Bacillus cereus Rock4-18
MKKILSVLLVVFLTFSAWSSVLVKAASPTKGSLTIHKYEQEKEGTTGVEGDGSANQEVPTNAKPLKGVTFEVKKVASFEKISNDGKIVKEDVKPVTGATPSQVVTDDNGQAVLKDLPLGRYEVKEVAGPPHVNLNPNTYTVDIPLTNKEGKVLNYDVHMYPKNEIKRGAVDLIKTGANDKALAGAAFSVFKKDGTEVKKELVTDANGHIRVQGLEYGEYYFQETKAPKGYVIDPTKREFFIKNSGTINEDGTITSGTVVKVELKNYEEPTIDKKINGNLEALPINPLTNYNYDIKTLIPEDIKEYKKYVVTDTLDNRLVMQGKPIVKIDGAEVNASVVDVAVEGQKVTATVKDFTKLDGKKEFHLQIKSQVKEGVPSSSEILNIAKIDFTNKNDVIGEKESKPVVVVPTTGIIELSKIDGDNKKKLKGAEFVLKDKNGKIVVVAGKEVIGVSDENGVIKWSNIPYGDYQIFETKAPTYTKEDGKTASYQLLKDPIDVKVSENNQTVKLTIENNKSGWILPVTGGIGTTLFTVLGLMLMVTAAFVFFRKKFANK

SEQ ID NO: 28025 - protein, 634 aa, Bacillus cereus Rock4-18
MICVSFVIYVPKEVYGSTVDLKGLGDISRYNAVIFGNHKAVGGDVEGAIAVQGDMDASGYTIVGAAAGTSNIVGEKWSDEGYPSLLLSGKFKKSRDESFIIQNGIVVMTKESDPDRTIQSSYDRIVFKEKQEIDAKFNEFRNIVNQVNQNAGQYKTNTSIPNMSFGIGKEINNPNIYVSSELTGKINLEIRDVFLPNAKDKDFIVMYSDAREVTFKNGSILYDTNNIGRATEIIPTSQPYSPDSTFTELYGKVIWVFPNAKKITAEGYGVVGSVFAPNAVLETKGGSINGQAFVGAVQQTGGFEFHNFKFNWKHWNKPSTGKIKIKKVDSNNDDKKLVGAKFYIEDSNGKVVGELMTDEKGEAISKDLPIGNYSLVEIEAPKGYELLKDKVAVKVEKDKVIEMKIGNKKLPDPIGKIKLVKVDTNDKNKKLAGAKFYIEDSNGKVVGELMTDEKGEAISKDLPIGNYSLVEIEAPKGYELLKDKVAVKVEKDKVIEMKIGNKKLPDPGGEIEIEKVDDKDINLKLKGAVFQVLNKEGKEVARLTTDEKGKVISRQLVLGKYTIKEIKAPNGYMLLRDPIEVEITEAVRTQKITVKNAKNNWMIPNTGGSGTTIFYVVGILVMFGVLYFSKKNHV

SEQ ID NO: 28026 - protein, 380 aa, Bacillus cereus Rock4-18
MHMKEKRYKNMKTKQTIAASTLALAMIAGANSAHAEVTDATPQQSTGDRLAEIKQHRQELDAKLQQHKENVDQTLNELNQVKENVDTKVNELHERKQVADEKINEMKQRKQELDAKLQQDKQIAEDKIAEIKEHKKQVDDKVAEIKEHKENIDTKVNEIKEHKQTVDETVNEIKQHKENIDQKVNELKEVKKQVDEKLAELKKAKQTAEDKLAELKENKPNTGNTLEELKKIKGNLDSLSANLELAKQDVKNKLAELQKARQDLLNKINEIKQAKQTVSDDLTKKKQDLDIKINDFKHTEKKIDDKLAELHTTKQNVDNKINEISQSKQTQADNSTKNNNARELPNAGSEQSNNMALGMLSVLGGVLLVTRNKIKTLFSK

SEQ ID NO: 28027 - protein, 447 aa, Bacillus cereus Rock4-18
MLPKASAEIEKIPSVKTTATNKADGGKEMHAKESITIQDKVEYTNLVVGKEYTVKGKLMNKVTNRPLLIDGKEIKAETKFTAKEKNGFVTLDFPFVGAEQQGREVVVFEELYQDGVLVATHADINDVGQTVRFVEPTIKTTATNKADGGKEMHAKDSITIQDKVEYKDLIVGKEYVVKGKLMNKVMNKPLLIDGKEVKAETKFTAKEKNGFVTLDFPFVGAEQQGREVVVFAEVYQDGVLVAIQSDINDVGQTVRFVEPTIKTAATNKADGGKEMYANESVTIQDKVEYKDLIVGKEYVAKGKLMDKATKKPLLVDDKEVAVESKFTAKEKNGSITLDFTFNASKLQGKEVVVFEELYQDDILVAINVDIEDAGHTVKFKEKKLGKPQPEKPQSEKPQSEQPKTGKTSKAGTLPATGGNMYFTWFSVGAGLLLLTLGAILFMKRRNA

SEQ ID NO: 28028 - protein, 110 aa, Bacillus cereus Rock4-18
MVSIVMELSTGVRVVPLTGPGIVKLTFVLTTAANPIPTSEVIVPNTGRIPKPVAPVGPVIPIPVGPVAPVGPVITVGPVGNVNGGMGGRVGPIKFGSRASPCKIIYSSLI

SEQ ID NO: 28029 - protein, 84 aa, Bacillus cereus Rock4-18
MYSVSFSIVFVIQAISSSILNLTINDSIQFAIETRVGGGSGVRATSARTDLLPLNQGDVLRVRIREAIGDIIYSNASLVVLKVD

SEQ ID NO: 28030 - protein, 1072 aa, Bacillus cereus Rock4-18
MFLPRASAEVMTHEKYSMEWSYSNSLGKYIRTEFIKNSSGQIAYCLTLGLKSPNGEDLPEMGKTDNVVYKVLLNGFPQKSTQQLGVANENEAHYATQLAVWNALGQLDVNELKHENKNVEKAAKAIINNANNSEETQDIFMNVIPAEKQKAELKGEFFETNLYTVQTNAKSGSYKVVAKNAPNGVKIVSENGEVRDQLSVGEKFRIQIPKNTKTGEFNLSVAANLTKVQAIAYRGTDTVQNATVLLERNEEKLSSDLAVNWEATGSLKIKKVGENGEVLAGAVFEVFNANNESVGKITTGADGTAELNNLQIGTYTVKEIKAPTGYVSGDKPQTIEVKTGETGAVQVVNNKVKGNIEIKKLSDSGKILPNVEFTVFTEDGKEVKKVVTKENGIAKVEDLTYGKYYFLETKTPNGYLENKTKYPFEIKEHNKTLTFTVENTEVKGSVKLLKVDNEDISKKLEGAVFELKDASGKVIGEYKTDKKGEVNVKNLAYGKYSFVEKASPNGYVLIKELIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDDTKEMHTSKSVTIQDKVEYKDLQIGKEYTVKGKLMDKETNKPLVVNGKEITAETKFTPKEANGSITLDFTFDATGLEEKEVVVFEELLKNGKIVTTHADINDKGQTVKFVKPSVKTTATNKADGGKEIHANDSITIQDKVEYTNLVVGKEYTVKGKLMNKAIKEPLLIDGKEVIAETKFTAKEKNGFVTVEFTFVGAEQQGREVVVFEDLLHEGQVIATHADINDAGQTVRFVEPSIKTTATNKADGSKELDATKSVTIQDKVEYKDLIVGKEYVVKGKLMDKATNKPLLVEGKEVTAESKFTAKEKNGSITLDFTCNASALQGKEVVVFEELYQDSVLVAIHVDIEDKGQTVKFKEVKPEQPKPEQPNPDKNTPTSEQPKEQVKEQPQPKNEIQSKIGWLPQTGTNLTSWISMAAGALLLIVGGVIFLKRKNA

SEQ ID NO: 28031 - protein, 971 aa, Bacillus cereus Rock4-18
MKGYSKKVLVGVSFASLLLGSFQGSISAENTKEEQVSYRNVLKMEPVGVQFPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLKQQGQTYTQDDSKGIETLVEVLRSGFYLGFYNTELSKLNERSYHDKCLPALKTIASNPNFKLGTLEQNRVVSSYGKLIGNASSDVETITSAAKIFKQYNDSFSTLVDNLSAGNAIYDIMQGVDYDIQSYLYDTRKVPKDTVWYQKIDSYINELSRFALMGTITAKNGWLINNGIYYTGRLGTFHSTGTKGLQVVTDAMNIYPYLGEQYFVAAEQIATNYGGKDANGNMVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDIFDKVHDLIRKNDVTAYDAYRSALSKDANLNKEYQDYMQMLVDNRDKYNVPLVSDDYLATHAPKPVSDIAAEITAEANVKNVSVKKNKSQFFNTFTLQGTYTGTAAKGEYEDWKTITQKVNDTLKRLSAKEWTGYKTVTAYFVNYRVNASGQFEYDVVFHGMNTEEGAVNKAPVAVINGPYSGNVNEAISFKSDGSKDEDGKIASYKWEFGDGTVSNEQNSTHIYTKEGTYTAKLTVTDDKGATNTATTSVTVKKKEDNSVEKEPNNSFQTANKLQLNQILRASLGNGDTSDFFEINVETAKNLQINVTKENNIGVNWVLYSEADLNNYVTYAQQQGNQLVGSYYTYPGKYYLHVYQYGGGTGNYTVEVK

SEQ ID NO: 28032 - protein, 1289 aa, Bacillus cereus Rock4-18
MFNVKKRWYVGGESVKERDKQNSLNSNFRISPNLIGPTFPPVPTGFTGIGITGPTGPQGPTGPQGPRGFQGTMGEMGPTGPQGVQGIQGPVGPIGATGPEGQQGPQGLRGPQGETGATGLQGVQGLQGPIGPTGTTGVQGIQGVQGLQGPIGATGPEGSQGIQGVQGIPGATGPQGIQGVQGIQGTEGPSGSTGTTGATGQGITGPTGITGPTGITGPSGGPPGPTGPTGATGPGGGPSGSTGVTGPTGATGNTGATGQGLTGPTGSTGETGAQGLQGIQGIQGPIGPTGPEGPQGIQGIPGPTGVTGEQGIQGVQGIQGIMGATGDQGPQGIQGAIGPQGVTGATGDQGPQGIQGVPGPSGATGPQGVQGIQGPMGEIGPTGPEGPEGLQGPQGIQGVPGPVGATGPEGSQGIQGIQGPVGATGPQGPQGIQGIQGVQGITGVTGVQGETGIQGIQGEIGATGPEGPQGVQGAQGGIGPTGPMGAQGVQGIQGIQGPTGAQGVQGPQGIQGIQGPTGATGDTGATGATGEGTTGPTGVTGPTGVTGPSGGPAGPTGPTGPSGPAGVTGPSGGPPGPTGATGVTGATGDTGATGSTGVTGATGETGATGVTGLQGPQGIQGVQGEIGPTGPQGVQGPQGIQGVTGATGDQGPQGIQGPQGDIGPTGPQGIQGPQGSQGIQGATGGTGAQGPQGIQGPQGDIGPTGPQGPTGIQGIQGEIGPTGPEGPEGLQGPQGIQGVQGPVGATGPEGPQGIQGIQGPVGATGPQGPQGIQGIQGVQGITGATGAQGATGIQGIQGEIGATGPEGPQGVQGVQGAIGPTGPMGTQGVQGIQGIQGATGAQGVQGPQGIQGIQGPTGATGDTGATGATGEGTTGPTGVTGPTGVTGPSGGPAGPTGPTGPSGPAGVTGPSGGPPGPTGATGATGVTGDTGATGSTGVTGATGATGATGVTGLQGPQGIQGVQGEIGPTGPQGIQGPQGIQGVTGATGAQGPQGIQGPQGDIGPTGPQGIQGPQGPQGIQGATGATGAQGPQGIQGPQGDIGPTGPQGPQGIQGPQGIQGPTGATGATGATGPQGIQGPQGIQGPQGIQGPQGIQGPTGATGATGATGPQGIQGPQGIQGPTGATGATGSQGPTGDTGPTGAGATGATGATGVSTTATYAFANNTSGSVISVLLGGTNIPLPNNQNIGPGITVSGGNTVFTVANAGNYYIAYTINLTAGLLVSSRITVNGSPLAGTINSPAVATGSFSATIIANLPAGAAVSLQLFGVVALATLSTATPGATLTIIRLS

SEQ ID NO: 28033 - protein, 792 aa, Bacillus cereus Rock4-18
MLEVFIMKLIKGIFVSTIALTSFTGLDLIKINEDPKVVYADSKDSLQNISQFQGDIKEGDKIILKFKSEVNFPYKDGLENQIKDEDSDSELVKIFSEFPQLTLKRLFTSVNPKEIENIDKHTRETENNSSSNLLDYYIVEVPNKVTAETLMDKFKKSHLVEEVYMQEKPTLLPEVQLPTVSLNPYDDPRFLNQGYLKEAPYGINASYAWSIKGGDGKGTTFVDMEYGWLLDHEDLVNQKVELISGRNIDQHVGHGTSVLGIVSAEDNKVGNIGIVPKAKVKVVSQIRGDGSYNTADAIINAVHNLQPGDILLLEAQASYDGYGDKYLPVEVQPDIFDAIRAGTDKGIIVIEAGANGSNDLDQFRDRNGKQVLNRNSPDFKDSGAIMIGAASSTVPHKRLWFSNYGSRIDVYGWGENVDTTRAEPNRITKNLYTTGFSGTSSASPIIAGAATSIQGVAKEHLGRPYKPAELRNILSNPNTGTKSQNPLTDKIGVLPDLKSILSNLGYSPDISNNVLEGNQFVWSMKGIGDFEFAKLDFNKTIEEMQIQLKAGVPHHYFDSTYASVKVQNSSGKVVYNKDIYGNRQQNAETQKISVKVGDYIEFTHLEGGNRATLINVDKNIQESFGKKIVYQVTVNGLKKVDQIIPNLDTEAPTQPGGLQATNITANSVELKWNSSTDNVGVIEYQVLRDGKFIQTVQGTTFTDSKLTADIEYKYTVKAIDAAENQSIQSSVLSIKTKEQNTSYEKWDPRKAYTKGDRVEYQGKIYEAVQSYQGNGDSNWIFSLSLWKTISIS

SEQ ID NO: 28034 - protein, 251 aa, Bacillus cereus Rock4-18
MKIKKKFLPVVLALSTMVTGSTAFLTSTVHANTESVVQKNIQKPLDFNSLANKPLADAWGEKFYHQWIPNVSSTEIEEFKSYMETGYHHLNTYLLENKGQLTGKDIKMEQKIKHLDRAFSSSSVPDDIVVYRRSKESSFGLTEGTLIKDNKINEQEFSEFKNKLLGKYKTDYTYMSTSILKDPSESFNGRPILIRLTVPKGSHGAYIAPLSAYPWEMEMLLPRNTTYKVNDISYVKNGNSNYVLVDATIQK

SEQ ID NO: 28035 - protein, 54 aa, Bacillus cereus Rock4-18
MKQPQQTPKKIEIYLPTTSRKSENPYIRWISLACVVLVLIGAAFAVRNRKKAQS

SEQ ID NO: 28036 - protein, 227 aa, Bacillus cereus Rock4-2
MTIFELIVCYDKLGNLTFYIIGGNKMKKPFYKKWWFWLIVVIIVLGAYGNSSKDKEETKPASTEPKQEAKQETKKDEPKKEETKPEPKKEEPKKELSKEGESSKVKIAVGSVESKDSVGGEYLNEKAQGVFKVVEITITNNQKDAITVDANSFKLVDNKDREFTYSTQAQTAFDVGNGGKSDFFLKQLNPGLSQTGKIIFDVPADAQGLVLKARGGMMGKEIKLKVE

SEQ ID NO: 28037 - protein, 172 aa, Bacillus cereus Rock4-2; identical to SEQ ID NO: 26900

SEQ ID NO: 28038 - protein, 163 aa, Bacillus cereus Rock4-2; identical to SEQ ID NO: 27105

SEQ ID NO: 28039 - protein, 72 aa, Bacillus cereus Rock4-2; identical to SEQ ID NO: 26628

SEQ ID NO: 28040 - protein, 333 aa, Bacillus cereus Rock4-2
MKGKLLKGVLSLGVGLGALYSGTSAQAEASTNQNDTLKVMTHNVYMLSPNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTDQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPQSPQWTVTSWFQKYTYNDYSDHYPVEATISMK

SEQ ID NO: 28041 - protein, 336 aa, Bacillus cereus Rock4-2; identical to SEQ ID NO: 27010

SEQ ID NO: 28042 - protein, 503 aa, Bacillus cereus Rock4-2; identical to SEQ ID NO: 26634

SEQ ID NO: 28043 - protein, 893 aa, Bacillus cereus Rock4-2
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDIKFISEPEVKAVIFVDKNHGQASNAYQVTFAATTPNYVSGTYLVNAHNGDILKDMVQESSLKISEEYVESVKENKTSNFTSLTGTGKDDLGVTRTFGISKQTSGNYALADYTRGQGIETYDVNYRDITNEESYYPGILATSASTTFNDPKAVSAHFLATKVYDFYKEKYNRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANTDELNMTSNFSELKLACLKVATNKYGTSSIEVQAVQNAFDAAKITGTVKENEKTAENQAPELTVPFTITLRVGDTFDPMRNVKAVDKEAGDLTNKVKHKGDVDTSKPGTYIVEYLVVDSQGRTTTATQTVIVEGNGEILDLEPKLTVPVGATIHVGDSFDPMIKVKAIDKEDGDLTSKVKIAGGVDTSKVGTYVLTYTVTDSKGHEVTAKQTVTVKVREEVTNEKPILKVPATTSITEGDQFDPLVGVSATDKEDGDLTSKIAYEGTIDTTKAGTYEIIYSVKDSMGNDVNTIQKVLVKDKETSKANGLANKANKSNISNNSNSDKKEYTYKELPRTGVSTTNSAAIGILMIITGTVLTFVRKFRKIQK

SEQ ID NO: 28044 - protein, 563 aa, Bacillus cereus Rock4-2
MIEVVKGIREMKKIFSVLLVLFLTFSTWSSVLVKADSPSKGTLTIHKYEQEKDGAQGLEGNGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGAVFSLFKKDGTEVKKELVTDANGHIRVQGLEYGEYYFQETKAPKGYVIDPTKREFFVKNSGTINEDGTITSGTVVKIEVKNNEEPTIDKKINGKLEALPINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDSANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 28045 - protein, 455 aa, Bacillus cereus Rock4-2; identical to SEQ ID NO: 27096

SEQ ID NO: 28046 - protein, 897 aa, Bacillus cereus Rock4-2
MGFWFWNSEFSFKLLGGNGMVKYSKISKWILGVGLVTITCNGLQIQAETKEKNVKNVLQMEPVGIQKSVNELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVIASYGKLIGNASADVETVLYAGEIFKQYNDNLATFIEDRTKGDAIYELMKGIDFDIQTDMYTTGKEPKDTMWYRNIDNFINEINRFALLGTVTNKNGWLINNGIYYAGRLGKLHSTPTKGQQVVTDTMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPTKRYTASQTLNAKYGTWDFYNYSFALQSYMYNKRPEMFDKVHDLIRANDVSSYDEYRATLSKDNKLNEEYQSYMQMLIDNRDKYTIPQVSDEYLTQHDPKSLSDVTSDITNEAKLKDVKVTKNKSQFFNTFTLQGTYTGSAAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 28047 - protein, 974 aa, Bacillus cereus Rock4-2
MLYFWVEYINGGNVMNKNLKFTQMMIGISTMALSFGSIQTQVSAEEKAPYNTLQMKPIGTETLKDEIAHATKADGTLTFEERLKVGDFSQRPTSVMKHDERQLKQSYTLAELNKMSDSEFIDTLSRVSWNQITDLFQFNQDTKAFYQNKERMNVIIDELGQRGTSFTKENSKGIETFVEVLRSAFYVGYFNNEVGYLNERSFHDKCLPALKAIAKNPNFTLGTTEQDRVVVAYGKLISNASSDAETVQYAANILKQFNDNLSMYANDYMKEQAVYEIVKGIDYDIQSYLQETNKKPNATMWYGKIDNFINEVSRIALIRNLTTENSWLINNGIYYAGRLGKFHSNPNKGLEVITQAMNMYPRLSGPYFIAVEQIKTNYGGKDYDGNTVDLQKIREEGKLQYLPKTYTFDDGSIVFKTGDKVTEEKIKRLYWAAKEVKAQYHRVIGNDKALEPGNADDVLTIVIYNNPDDYQLNRQLYGYETNNGGIYIEEKGTFFTYERTPKQSIYSLEELFRHEFTHYLQGRYEVPGLFGSGELYQNERLTWFQEGNAEFFAGSTRTNNVVPRKSIISGLSSDPASRYTAKQTLFAKYGSWDFYNYSFALQSYLYNHHFETFDKIQDLIRANDVKNYDAYREALSKDAQLNTEYQTYMQQLIDNQDKYNVPQVTNDYLIQHAPKPLAEVKKEIVDVTNIKDAKITKHESQFFNTFTVEGKYIGSTSKGESEDWKTMSKQVNQTLEQLSQTGWSGYKTVTAYFVNYRVNAANQFEYDIVFHGVATEEKEKTTTIVNMNGPYSGIVNEGIQFHSDGTESENGKIISYLWNFGDGTTSTEVSPTHVYGEKGAYTVELTVKDSRGKESKEQTKVTVKQDPQTGGSLEEEKVLPFNKLVKGNLIAPDQTDVYTFDVTVPKEVDISVVNEQNIGMTWVLYHESDMQNYVACGEDEGNAIKGKFVAKPGKYYLNVYKFDDNTGEYSLLIK

SEQ ID NO: 28048 - protein, 71 aa, Bacillus cereus Rock4-2
MLLNGTQLTGSFIQNVTTSTVVIEPAISNTLLVNVTSANSTLILQNGPLGVGHVTTIAGAITASLNVVRIL

SEQ ID NO: 28049 - protein, 1062 aa, Bacillus cereus Rock4-2; identical to SEQ ID NO: 27436

SEQ ID NO: 28050 - protein, 971 aa, Bacillus cereus Rock4-2
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRVQAIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITEKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNTSGQFEYDVVFHGINTEEGAENKAPVAVINGPYSGNVNEAISFTSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 28051 - protein, 387 aa, Bacillus cereus Rock4-2
MSSWLNNTNGYCSCNNQNGVHVDSCCFSCDGTVPKLGPTGPTGPMGSTGPTGATGSTGSTGSTGPTGATGSTGPTGATGPTGSTGSTGSTGATGPTGSTGPTGATGATGSTGSTGATGPMGATGITGVTGPTGATGITGVTGITGVTGPTGATGPTGSTGPTGATGATGATGPTGSTGPTGSTGSTGPTGATGSTGATGSTGPTGSTGPTGATGPTGSTGATGPTGSTGSTGPTGATGSTGSTGPTGATGTSITATYAFANNTSGTAISVVLGGTNVPLPNNQNIGPGITVSGGNTVFTVANAGNYYISYTINITASLLVSSRITINGGALAGTINAPAVATTSFSATIITTLAAGDAISLQLFGLLAVATLSTTTPGAVLTIIRLS

SEQ ID NO: 28052 - protein, 68 aa, Bacillus cereus Rock4-2
MVFSIKPTDSGVGQIQVFNPTPAVGSATVTWTSITTGNPVARGDAISLYITPGITASAVYSIFLITDI

SEQ ID NO: 28053 - protein, 85 aa, Bacillus cereus Rock4-2
MKPEDPKEPKEPEVKPEEPKDLKKPEVKPEKPEVRLEKLIKEPQVKVEKELPKTGGAHSWMMSVGAGISFLVGGVLFVLGRRRKQ

SEQ ID NO: 28054 - protein, 431 aa, Bacillus cereus Rock4-2; identical to SEQ ID NO: 26534

SEQ ID NO: 28055 - protein, 458 aa, Bacillus cereus Rock4-2
MNLKLTSKLERLRKSKKGIGACVLAAGVTAITMIPQSAYAHGFVEKPSSRAALCSQNYGALNLNCGNIMYEPQSLEAPKGFPDGGPIDGKIASAGGLFGGILDQQTSNRWFKNTIKGGANTFTWKYTAAHPTSNWHYYITKKGWNPNKPLTRAELEPIGTVKHDGSAASNNLTHTINVPTDRNGYHVILAVWDVADTSNAFYNVIDVNLVNNETPDTVAPSQPTELNASKVTANSVALTWKASTDNIGVKEYQVLRNGEAIDTVPGTTFIDKKLKADTEYTYTIKALDSAGNISKESEKLKVKTTHAIPDIEAPTQPKGLHSMGTTATTVDLMWSPSEDNVGVDHYIVYRESAGVMNKIGTAANTSFMDKDLKANTSYKYVVTAVDLAGNESSRSDILNVTTKSEDSTYEKWDARKAYTKGDRVVHEGKVYEAVQDHQGNGDSNWIFALSLWKPILNK

SEQ ID NO: 28056 - protein, 746 aa, Bacillus cereus Rock4-2
MGNNSKHKTRKILAATATVTMLATGMISSSDVFAEQKEQQKNLSTSPQSEKSVKSENRTFTVPGKGDVEVLKQQERKSMAFSPYEPTGLYAKPNEQITINVEGNQDIQVYIGTYSYDASWREDSKIKSFTLKPGVNTIQSPNGGLIYFYNKQQGGSIRTTITTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYATSYRTAYVGDAIQYVLDINKFITDGWGPWHEAGHLRQQSPWKFYNMTEVQNNIYSLSVEKAFNQPSNLEKSGIYPKAFQYLEQVNKNYDEISDVFVKLVMLWQLQLAYGEDFYPKLHQLYRDMPSSELPQTDENKKQLFMISASKVAKQNLIPFFEKWGLRPNNDTIQKVAALGYPILTAEIWKGTDSNPIKPDMPNVNNILEGNQFAWSLKGISDFEFAKINFNKSTEEMQVDLKAGVPHHYFNETYASIKVQNASGKVVYNKDIYGNKQQNAESRKVSVKVGDYIELTHLEGVHRATLTNVDNSKQESFGKKAMYEVTKEGLKKVNQIVNPKPDTEAPTQPQGLYASNLTSNSVELKWNPSTDNVGVKEYQVLRDGQLIQTVQGTMFTDQNLTVNKEYKYAVKAVDAAGNTSIQSEILLVKTKDQNVSYEKWDPKKAYTKGDKVEHQGTVYEAVQNHQGNGDPNWIFALSLWKAITIN

SEQ ID NO: 28057 - protein, 190 aa, Bacillus cereus Rock4-2
MLLFWKEETMNKKLLAPLLCSTFLFGVSACGSHDAPAKNEQATSKKTENDKLSSKDSQKELPTNVDSSDVYMSMGSAESLDVIGTGEVKAQGVFKVLDIAVYNRKEEPITLDINNFKLIDGFGREYYISNEYQSVLKAANTSTFKFGIVSPDEHSDGNIVFDVPKNTRGLTLKFNNDKLDKELQLKVELE

SEQ ID NO: 28058 - protein, 263 aa, Bacillus cereus Rock4-2
MKKQSLAIATILSLGLTVFGGTTSTFAMTEPNDNVTFQSTSKYIGNIPSKPKDCNNVDKYKLCTNKEEADAWGKKQFSKWSKEEKSAIRDYTKNARPYNEFLRTHAGKLDSDPTMKKKIESLDKALNRKEAKVNDNIKVYRGDDAWIFGKEYDNSIIKNGKVDREKFKEIQKKFQGKTITEFGYISTSILIDAGYAKTRPVMTEFKVGSGTHGAYMNSDDLTAYPGQYELLLPRNTVYKIEKIYIAIDNNTQKEQIKVEATIK

SEQ ID NO: 28059 - protein, 265 aa, Bacillus cereus SJ1
MSEKYIILHGTALEPNLIGPTLPPIPPFTFPTGPTGITGPTGATGFTGIGITGPTGVTGPTGIGITGPTGITGPTGIGITGPTGITGPTGIGITGPTGITGPTGIGITGPTGGTGPTGIGITGPTGATGLGILPVFGTITTDVGIGFSVVVNTNINFTLPGPVSGTTLNPVDNSITINTTGVYSVSFSIVFVIQAISSSILNLTINDSIQFAIESRVGGGPGVRATSARTDLLSLNQGDVLRVRIREATGDIIYSNASLVVSKVD

SEQ ID NO: 28060 - protein, 971 aa, Bacillus cereus SJ1
MKGYSKKVLVGVSFASLMLGSFQGGALAEGTKGEQVSYRNVLKMEPVGVQLPVQELAHSSKVLENKSFEKRLQFADLSQRPPEVKKESKQLAVAKTYTIAELNQLSNQQLVDLLVTIDWEQITGLFQFNKDSLAFYQNDSRIQAIIDKLNQQGQDYTKDDSKGIETLVEVLRSGFYLGFYHTELSKLNERSYHDKCLPALKAIANNPNFKLGTLEQNRVVSSYGKLIGNASSDVETITSAAKVFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIAAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKAPVAIINGPYSGNVNEAISFKSDGSKDEDGKITSYKWEFGNGAVSNEQNPTHVYTKEGTYTAKLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYMVEVK

SEQ ID NO: 28061 - protein, 3298 aa, Bacillus cereus SJ1
MKKLFNICLIVFVLFSQFISFPYNQAKAETLKETSLFDTVEMKDATDHIIDEAKNPNNLIKIGSTIQVEYAWSIKDQQVVHANDTAVIQIPLALKVSKDLQGDLVTDQKNIGQYFITAKDNKLKLIFNDQVENSKDAKGKIKIDTVFNPTLKTEEKSVQIAFPLGTLVQPITVPIQVEDSKEDGTKQDTNKQVPGQVAKPATDNPEQNPATKPATDNPEQNPATKPATDNPEQNSATKPATDNPEQNPATKPATDNPEQNPATKPAADNPEQNLASDPAESTNSGPKQITTNILTGVKLTDKDGKPFTEDNRPSTDSPANIEFTWELLKSMNVKSGDYYIFDLPKHFKIYNTINSPLYDSENNPIGNFTVTKDGKVTMTFNDYVEEHPDVVGNLQLKTEFNKAEIKGTTTQEIPFPIKDKDVSITVDFKPNIQTTTNKKGLPDRPINTNEINWSVEMNKTKDTLKNTVFKDNIPQGTSLNKDSIKVYYLEVDVNGNATRGKEADPADYKIISSDGSKLEIAFKDSIKEAYQIEYVTKITDENVKNFQNNVTITSDNQGQQKASSTVTVSRGTHLNKTSKYDPKTQTIEWTITYNGDQRNIKKTDALLKDIFDDTHELDVNSIVVKNASYDDKGRLVTGDAVNNYTVSNKKNGFDLQFNEDINSAYVITYKTKPTNNVIKDGKIKNIVTADNGSSKENEAGFQQQNIIKSNNKAETNYKDKTTTWTITVNNNNYSLNNAIITDTFDHGGLQLKDKKLEIKDGDYTLQAGTDYVLDVTDKGFKITLIGTYQSNMTKTLVVKYTTDFDYTKLESGKTSFKNTGNLSWIDTDSNPQSNKVEANFDPDNFTKANGYKYGSYNAQTKEITWIIGFNYNNVEIKDPYVIDVIQDKQKLVPGSIEVRDMILNGSPDNAQPGNAVPTEKYELEEPTEKNKNTLKVHFKQSINSPYYIIFKTSLDGELIQGTYKNEAELKDGSKIVNTLKGDAQVKKGGSFVTKKAVQDDNYINWGIAINESQSTIADAVVTDDPTDNQVLVEDSFHLYPTTVDYYGNVTKDTANELKQGTDYKLKITTDNNTGKQHFEIAFLKKIDRAYILEYRSLINADDKEKVSNKAKIAGNQLTVKNTETTETIEVRMSSGSGGGSATKGRGNLEIIKVDNDNKNTLLTGAEFTLYDRTGKTVIRKITTDKDGIAKFNNLKRDKYLLKETKAPEGYVISWDLKQGKIVELGTQETTTYKLANKKFVGKVVLTKSDDLNKNVTLQGAVFTLLDKDKKIISEHEKLTTNNKGQITVEHLKPGTYYLKETTAPEHYKLDDRLIEVKIAEDQTTVINRTATNSLIPGSAILTKVDKDGKTLAGAEFSVRDRKNKIIPGYGKLTTNDQGQIEAKDLRPGDYQFVEEKAPKDYDIDKTPIEFTIVKSQKKAVTVTATNHLIKGGVTLTKTDDIDGTALAGAIFKIVDANDEKKVIRENVKTGADGKVTVKDLEPGTYKFIETEAPKDYVLNTKPIEFTIDKSQQSFATVTATNSLKTGEVELLKVDEFGDKKPLKGAVFKIVDVNNNDVRTDLTTDADGKTKADKLRPGTYKFIETAAPEHYVLRAEPIEFTIDRSQKETLLVKAENALKPGDVELTKVDDIDGTALAGAVFKIVDANDEKKVIRENVKTGADGKAIATGLRPGDYKFIEVTAPKYYDKNTKPIEFTIKESQGISPITVTAKNSLTKGGIELTKVNAADEKETLEGAVFKIVNRDTNEDARTNLVTNSEGKLVVDDLRPGNYKLIETKAPTYYDVNVEPIEFTIEKGQQTLLPLTFKNSLTKGKVKLIKEDDVESSIALAGAVFTLQDANGTEIAKDLKTDEHGVLVIPDLAPGDYQFIETAAPEHYKLDQTPIKFTIKKGSKDDLPVPVTVKNSLLTGGVTLTKVDDVDGTTLEGAEFIIVDAHDTKKVVRKGLTTDEHGKVSASDLRPGDYQFIEVKAPKDYTLGNNPIPFTIGKSQKENITVTATNSLKKGAVTLTKIDDIDRTMLKGAVFKIVDMKGTEVRTNLVTDKNGKIYVPDLRPGDYQFIETKTPEHYVLDETPIPFTIERSQTKEINVTGKNTLKKGSVELTKIDDIDTDTKLANAVFNLLDADGEIVEEGLKTNAEGKIVVENLRPGTYQFVETIAPEHYDLNKTPIEFTIKKSQTETLHVTAKNALTKGAVELSKVDDIDGTKLEGAVFNIVDMNGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKKPIVVTVEKSQKDIATVTMKNSLTKGGVELSKVDDVDGTTLEGAVFNIVDMNGTVIRKSLTTNSQGKISVPDLRPGDYKFIETKAPKHYDLNKEPIPFTIEKGQAEPISVTAKNSLTKGAVELSKVDDIDGTALEGAIFKIVDMNGHDVRTGITTDAKGKVSISDLHPGDYQFIETTAPKHYKLDATPIKFTIEKSQAEKLQVTAKNSLIEGAVELIKVDDITPDTKLSDAVFNIIDAKGKVVRTNLTTDKDGKISASNLRPGDYQFVETKAPKDYDLNETPIPFTIEKSQSTHVSVTAKNGLTKGGVELTKIDSLDTKETLEGAVFKITDLNGNDIRTNLVTNKDGKIIAKDLQPGDYQFIETKAPKHYDLNEIPIKFTIERSQTKHVFVTATNSLTKGSVELIKVDDVEENTTLEGAVFKIVNKDGHDVRTDLTTDKNGRLVVDELPPGDYEFIETKAPTHYDLNETPIKFTVKKGQEKIASVTATNSLTKGAVELSKVDDIDGSALKDAVFKIVDMNGNDVRTDLTTDKDGKISVSDLRPGDYQFIETKAPKHYDLNQTPINFTIEKSQTATASVTATNSLTKGAVELTKVDDIDGATLEGAVFKIVDMNGNDVRADLTTDKGGKISVSDLRPGDYQFVETKAPTHYDLNQNPINFTVEKSQTATASVTATNSLTKGAVELTKVDDIDGTTLEGAIFKIVDSNGHDVRTDLTTDKDGKISVSNLRPGDYQFIETKAPTGYDLNAKPIPFTIPKGQSQVTSVTALNSLTTGSMELTKVDIDHNGTLEGAIFNILDQDGKVVREGLKTDGHGKLIVNDLKPGNYQLVETKAPEGYQLDASPISFTIEKAQVSPLQITVSNKKVESSSGGDNKPITPPNKEEKPGKETSEELENGNPKTQTNKQQDDRNTGKELPNTGHKNDSTQTVGIILLLAGLLSVLATKRKKYY

SEQ ID NO: 28062 - protein, 503 aa, Bacillus cereus SJ1
MFNKKMVAMAMTVPLVMGTLSTVSAVETKKQVKVEAYSPQKKAIEYLKGNANQYGLKPDLSDLQYISTTETPVASYVRFQQVVNGAPVFLNQITVTLNGEGKGVLAVSDYQPIKAVKQVTEKISEKDAIQKSMAYVGEASEQNLWAPTEKEFGYIIEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAAAYSSSDPTCLRRLDTNKVYPKDMKNQVHADGEIWSQGQYEMAQAFGRDVATKIILQSHWSLTPNSKFSDGAKAIKQADALLYGGQHAADIDRIWAARGISTN

SEQ ID NO: 28063 - protein, 1093 aa, Bacillus cereus SJ1
MGKRVVVRVLAVLSVLALFLNVFLPRVSAEVMTHEKYSMNWSYSNSLGKYIRTEMIKNSSGQIAYCLTLGLKSPNGEDLPEMGKTDNVVYRVLLNGFPQKSVQQLGVANQNEAHYATQLAVWNALGQLDVNELKHENKNVEKAAKAIINAANNSGDTQDIYMNVIPAEKQKAELKGEFFETNLYTVQTNAKSGSYKVVAKNAPNGVKIVSENGEVKDQLSVGEKFRIQIPKNTKTGEFNLSVAANLTKVQAIAYRGTDTVQNATVLLERNEEKLSSDLAVNWEAAGSLKIKKVGESGEVLAGAVFEVFNANNESVGKITTGADGTAELNNLPIGTYTVKEIKAPTGYVLGDKPQTIEVKTGETGAVQIVNNKAKGNIEIKKFSDSGKVLPNVEFTVFTEDGKEVKKAVTNENGIAKVEGLTFGKYYFLETKTPNGYIGNKTKYPFEIKEHNKILTFTVENTEVKGSVKLLKVDNEDISKKLEGAVFELKDASGKVIGEYKTDKNGEINVKDLAYGKYSFVEKTSPNGYVLVTEPIVFEIKEHGKIIELLAVNHLIKGDLEITKVDVADGNNKLPNAEFTIYNEEGKEVVKGKTDDKGIAKFEKLPFGKYTYKETIAPNGYFLNEEMFSFEIKENGQIIKHIVKDEKIPSIKTTASDKKDGTKEMHTSKSVTIQDKVEYKDLQVGKEYTLKGKLMDKKTNKPLVVNGKEITAETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINEPLLIDGKEVTAETKFIAKEKNGFVTLDFTFVGAEQQGREVVVFEDLLHEGQVIATHADINDVGQTVRFVEPSIKTTATNKADGSKELDASKTVTIQDKVEYKDLIVGKEYVVKGKLMDKATKKPLLVDGKEVTVESKFTAKEKNGSITLDFTFDASALQGKEVVVFEELYQDNVLVAIHVDIEDKGQTVKFKEVKPEQPKPEQPHQDKNTPTSEQPKEQVKEQPQPKKEAQSKIGWLPQTGADLTSWISMAAGALLLIVGGVIFLKRKNA

SEQ ID NO: 28064 - protein, 372 aa, Bacillus cereus SJ1
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEIKQHKENIDQKVNELKEVKKQVDEKLAELKKAKQTAEDKLAELKENKPNTGNTLEELKKIKGNLDSLSANLELAKQDVKNKLAALQEARQDLINKINEIKQSKQTVSDDLSKKKQDLDIKINDFKHTEKKIDDKLAEIHTTKQNVDNKINEVSQSKQTETKTGTTNANNNARELPNAGSEQSNNMALGMLSVLGGILLVTRNKIKTLFSK

SEQ ID NO: 28065 - protein, 88 aa, Bacillus cereus SJ1
MDKYLLSNTTYKYVVKAIDVAGNESIQSDIFTITTKTESASYGEWDAKKAYEKGDRVLHEGKVYEAVQSYKGNGDPNWIYALSLWKTV

SEQ ID NO: 28066 - protein, 967 aa, Bacillus cereus
  subsp. cytotoxis
  strain NVH 391-98
MNKKSKITQMMLGISTVALSFGSIQTQVSAEEKIPYNVMQMKPIGVETQTDQIAHVSQENKTLSFEERLRTGDFSQRPAFGMKRTESKQFQESYSMADFNKMNNEELIDTLANIRWNQITDLFQFNQDTKTFYQNKERMQVLIDELGRRGSTFTKDDAKGIDTFVEVLRSAFYLGFYHKELNYLNERSFHDKCLPALKAIAKNPNFKLGTEQQDTVVSAYGKLISNASSDVETVQYAANILKQYNDNLATYVSDFMKGQAVYSLIQGIDYDIDSYVYASYKEANQTMWYGKMDAFVNEVSRIALLQHVTTENSWLINNGIYFAGRLGKFHSDPNKGLAVVTQAMHMYPHLSDAYFVAVEQIKTNYGGKDYNGNKIDAEKIREEGKQRYLPKTYTFDDGSIVFKTGDKVTEEKVKRLYWAAKEVKAQYHRVIGNDKALEPGNPDDVLTVVIYNSPDEYKLNRQLYGYETNNGGIYIEQDGTFFTYERTPEQSIYSLEELFRHEFTHYLQGRYEVPGLFGEGDMYQNERLTWFQEGNAEFFAGSTRMNNVIPRKSIISGLSSDPANRYTAERTLFAKYGSWDFYNYSFALQSYLYNHRFEIFDQIQDLIRANDVKNYDAYREALSKDANLNTEYQAYMQKLIDNQERYNVPEVSDDYLAEHAPKALTEVKKDIEDTTNLKGATIKKHKSQFFDTFTVEGTYTGSTTKGEAEDWKEMSKHINQSLEKLTQKEWSGYKTVTAYFVNYRVNAENQFEYDVVFHGIATDSGENQAPVVNINGPYNGNVNQAIQFNSDGSKDEDGKITSYLWDFGDGTTTTEANPKHVYKQEGTYKVTLTVKDDKGKEAKTETTVTVRKGHETTVESEPNNRLEEANPIAFHTLIKGSLMNEDRTDIYTFDVTSSKNIDISVVNEHNIGMTWVLHHESDMQNYVAYGQANGNDIKGKFEAKPGKYYLYVYKFDNGNGTYTLSVK

SEQ ID NO: 28067 - protein, 330 aa, Bacillus cereus
  subsp. cytotoxis
  strain NVH 391-98
MMKSKLLKGILSFGIGLTALYSSSAQAETSSDSDTFKIMTHNVYMLSTNLYPNWGQKERADLIGEANYIKNQDVVILNEVFDNKASDSLLQNLKKEYPNQTAVLGRVNGDMWDQTLGNYSSVAPEDGGVAIVSKWPIVEKVQYVFQKGCGPDNLSNKGFVYTKIKKDDRFIHVIGTHLQAEDNQCGNISPSSVRTNQLKEIQEFIQKKNIPSDEYVVIGGDMNVNKINSNHTSEYESMFKTLHASVPSYTGHTATWDATTNSIAKYNFPEAPAEYLDYIVTSKDHATPTYLENKVLQPKSPEWSVTSWFKTYTYNDYSDHYPVEATIIMK

SEQ ID NO: 28068 - protein, 91 aa, Bacillus cereus
  subsp. cytotoxis
  strain NVH 391-98
MSACKSLESTKEVKQESASKGQKEEKNQKSKSYEMTLESAEYTLPERDSTPLNGRVLKGKVGIKNIGKEALRFSPDDFALYVKNENVFEIW

SEQ ID NO: 28069 - protein, 336 aa, Bacillus cereus; identical to SEQ ID NO: 26396
  subsp. cytotoxis
  strain NVH 391-98

SEQ ID NO: 28070 - protein, 502 aa, Bacillus cereus
  subsp. cytotoxis
  strain NVH 391-98
MNKKVIALAAVIPLVLGTVSTASAVEKEQVSLEKYSPKEKAIEYLKENAAHYALKEDLSDLRYISTTETPVASYVRFQQVVNDAPVFSRQITVTINRAGQSVLVVSDYQPVQRVKEIKKKMSEQEAEQKSKSYVSGAENESNLWAPTTKEFGYIIEEGVAIPVYKVVVHSNKPFGAWETLIDAGSGKLLKKVDINRKVEGTGKVFLPNPVVSNGSLTGLKDNNDKDSVELNNQLKTVILKGLDGTGFLIGDYVTISSKAKTKSTNFQFNYTRSHDSFEDVMAYYHIDTLQRYIQGLGFQNINNRSIKVNVNGTTADNSFYSPSTKALTFGTGGVDDAEDAGIIAHEYGHSIQDNQVPGFGSSLEGGAMGEGFGDFLGATYEDAVSTTEYGKACVGEWDATAYSSSDPTCLRRLDNNKVYPKDIQNEVHADGEIWAQGEYEMAQAFGRDVATKIILQSHWSLTPNATFHDGARAIKQADALLYGGQHAAEIDRIWIARGIRTN

SEQ ID NO: 28071 - protein, 459 aa, Bacillus cereus
  subsp. cytotoxis
  strain NVH 391-98
MNTKLSSKFKKLSKGKKGISATILVAGIMGMLTIPENVYAHGFVEKPSSRAALCSQKYDALNLNCGNVMYEPQSLEAPKGFPQGGPIDGKIASAGGLFGGILDQQTVDRWFKNTITGGPNTFTWKYTAPHATSKWHYYITKKGWNPNKPLTRADFEPIGTVEHNGSAASNNISHTINVPTDRNGYHVILAVWDVADTSNAFYNVIDVNLINNDNSDKQPPTKPQGLHVLKVTPHSIGLKWDAASDNIGVKEYQVFRNGKSIGSVFGTTFTDTKLQTNTEYVYTIKAIDVAGNMSEESQPITVKTMEEVPDTEAPTQPTTLHAMEVTNSSVNLMWSASEDNVEVDHYVIYREVAGGKPIKIGTTNTTSFIDKNLQANTTYTYTVTAIDTAENESMESNKLTVTTKEQSSSFAKWDPYKAYTKGDKVEYQGKLYEAVQSYQGNGDPNWIFALSLWKPLETK

SEQ ID NO: 28072 - protein, 842 aa, Bacillus cereus
  subsp. cytotoxis
  strain NVH 391-98
MSYFDSHDKLPKPCFPNNSGRIPILSSIPISKSQLRTFRAIISHLTKTIPNLFLNPSPSTIEDFIDTLCLLKKFIKCLETSSSQKAIGLAIIKNLITILENPTFVPGAVFIELQNLVNYLLYITKLFRLDDCILECIIDQIEELQLILIEFAPFGTIGPTGATGPTGPQGPQGVQGPTGATGPQGPQGVQGPTGATGPQGPQGVQGPTGATGPQGPQGIQGPTGATGPQGPQGIQGPTGATGPQGPQGIQGPTGATGPQGPQGVQGPTGATGPQGPQGVQGPTGATGPQGPQGIQGPTGATGPQGPQGIQGPTGATGPQGPQGVQGPTGATGPQGPQGVQGPTGATGPQGPQGIQGPTGATGPTGPQGIQGPQGIQGPTGATGPQGPQGIQGPTGATGPQGPQGVQGPTGATGPQGPQGVQGPTGATGPQGPQGVQGPTGATGPQGPQGVQGPTGATGPQGPQGVQGPTGATGPQGPQGIQGPTGATGPQGPQGIQGPTGATGPQGPQGIQGPTGATGPQGPQGIQGPTGATGPQGPQGIQGPTGATGPQGPQGIQGPTGATGPQGPQGIQGPTGATGPQGPQGIQGPTGATGPQGPQGIQGPTGATGPQGPTGATGPQGPQGIQGPTGATGPQGIQGPTGATGPQGPQGVQGPTGATGPQGPQGIQGPTGATGPQGPQGIQGPTGATGPQGIQGPTGATGPQGPTGATGASFPVATAVLQNSNSQTVDLGENFVFSTSSNLRNINFNGTDTLTILEDGVYVISFSISITAPACAPFGVGISQNGAVPSDNFSGNVIGSSLSFTTIETLTAGTNITVQSTLGEISIPATGDTNIRLTIFRIA

SEQ ID NO: 28073 - protein, 190 aa, Bacillus cereus
  subsp. cytotoxis
  strain NVH 391-98
MEKKKKAFYKKWWFWVIVVIIIAAAAGGSGDKEESKATSNESKQEVKKNNSKNDKPKELSKEGESSNVKISVGSVETLESVGNQYVNEKAQGIFKVVELSITNNQKDAITIDANSFKLVDDQDREFKYSTQAQTSFDVANGGKSDFFLKQLNPGLTQTGKIVFDVPKDAKGLVLKARGGMTGKEIKLKVE

SEQ ID NO: 28074 - protein, 563 aa, Bacillus cereus
  subsp. cytotoxis
  strain NVH 391-98
MIEVAKGKREMKKLLSMILVFVLMFSTLPSLFANAASKTKGSLTIHKYEQEKDKIAGAEGDGSAKQDVPKDAKPLKGVTFEVKQVASFEKISSDGKIVKEAVKPVETATPVKVTTNEKGEAVLKELPLGRYEVKEVAGPPHVNLNPNTYTVDIPLTNKDGNVLNYDVHMYPKNEIKRGAVELTKTGADNKALAQAEFSLFKEDGTEFKKGLVTDENGYIRVQGLEYGKYYFQETKAPEGYMNDPTKYKFLIANSGTINEDGTITSGEVVKVAVKNYEEPTIDKKINGNLEALPINPLTDYNYDIKTLIPEDIKEYKQYVVTDVLDNRLVIQGKPVVKIDGKEVDSNVVEVVVEGQKVIATVKDFVKLHKKKEFHLQIKSQIKEGVKAGTEILNKATIGFTNKNDVTGDKESKPVIVVPTTGTIELTKIDGANSKKLQGAEFELRDNDGKVVIVEGREVKGVSDKNGIIIWSNLPYGDYQIVETKAPTYTKEDGTTGSYQLLKEPIDVTVNENKQSIKLTVENNKSGWILPATGGMGTAIFTVLGLMLMAVAAFAFFRKKSANN

SEQ ID NO: 28075 - protein, 274 aa, Bacillus cereus
  subsp. cytotoxis
  strain NVH 391-98
MSQWYNHFHTNCGCNKTTYIHSCCFSCDGTVPKIGPTGPTGITGATGPTGITGATGPTGITGATGPTGITGATGPTGITGATGPTGITGATGPTGITGATGPMGITGATGPTGITGATGPTGSTGATGATGPTGPTGVSVTATYAFANNTSGGAISVLLGGTNVPLPNNQNIGPGITVSGGNTVFTVASAGNYYISYTINITASLLVSSRITVNGSPLAGTINSPLVATTSFSATIITTLAAGDAISLQLFGILAVATLSTTTPGAVLTIIRLS

SEQ ID NO: 28076 - protein, 430 aa, Bacillus cereus
  subsp. cytotoxis
  strain NVH 391-98
MSTIIDVYAREVLDSRGNPTVEVEVYTEGGAFGRALVPSGASTGEYEAVELRDGDKSRYLGKGVLNAVKNVNEIIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGEDVFLGMDVASSEFYNKETGKYDLSGEGRSMTSAEMVDFYEELCKDFPIISIEDGLDENDWDGHKLLTERLGKKVQLVGDDLFVTNTKKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGLKSFYNLKK

SEQ ID NO: 28077 - protein, 503 aa, Bacillus cereus; identical to SEQ ID NO: 26407
  var. anthracis
  strain CI

SEQ ID NO: 28078 - protein, 234 aa, Bacillus cereus
  var. anthracis
  strain CI
MSSWRNNINGYCSCNNQNGVHVDSCCFSCDGTVPKLGPTGPTGATGVTGATGITGSTGATGPTGATGITGATGPTGVTGITGATGPTGEIGPTGVTGTSITATYAFANNTSGTAISVLLGGTNVPLPNNQNIGPGITVSGGNTVFTVANAGNYYISYTINITASLLVSSRITINGAPLAGTINSPALATTSFSATIITTLAAGSAISLQLFGLLAVATLSTTTPGAVLTIIRLS

SEQ ID NO: 28079 - protein, 147 aa, Bacillus cereus
  var. anthracis
  strain CI
MNSDEKLSLNKGMVRPENIGPTFPVLPPIYIPTGATGATGATGATGVTGTTGSTGPTGVIGPITTTNLLFYTFSDGEKLTYTDSDGLAQYGTTHILSPDEVSYINLFINGILQPQPLYQVSTGQLTLLDNQPPSQGSSIILQFIIIN

SEQ ID NO: 28080 - protein, 412 aa, Bacillus cereus
  var. anthracis
  strain CI
MKKAKGVAKSVAVASVIMSGSIGLQATSAFADSKGTVENLQNGGKVYNSFKTTYDMKQNIKNSIKVSFIEDPYEDKKIAIVTTDGSNIDAKYTINGGYYNAGLKWPSAYHTEAEITSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKKESTSDLKITNRRISDQYNIEWVSSKWWGTNNKDTYNEFFTNNYKLDWKNHQVTLDNQKAPEEQMIGINNVNNQLNKGKGKLSFSMNGNQLKATSSNAGYGISYEDKNWGIFVNGEKVYTFNEKTTVGNISNDINKLNIKGPYIEIKKI

SEQ ID NO: 28081 - protein, 853 aa, Bacillus cereus
  var. anthracis
  strain CI
MEGNGGKSKIKSLLNSNFKILSDLVGPTFPPVPTGMTGITGSTGAMGATGSAGITGNTGATGNTGPTGSTGATGSTGPTGSTGATGSTGVIGNTGPTGSTGATGPTGETGGTGSTGVTGSTGATGSTGVTGDTGPTGSTGVTGSTGPTGNTGGTGSTGPTGNTGATGSTGVTGSTGVTGSTGVTGSTGPTGETGGTGSTGVTGSTGATGSTGVTGDTGPTGSTGATGNTGPIGETGVTGSTGATGNTGATGSMGVTGNTGPTGSTGVTGNTGSTGSTGVTGSTGPTGSTGPTGETGSTGTTGATGETGSTGTTGATGETGPTGSTGPTGSTGVTGSTGPTGETGGTGSTGVTGNTGATGETGPTGSTGATGNTGPTGATGGTGSTGATGSTGVTGNTGPTGSTGATGNTGPIGETGGTGSTGVTGSTGPPGETGGTGSTGVTGNTGATGETGPTGSTGATGNTGPTGSTGVTGNTGPIGSTGPTGETGGTGSTGVTGNTGATGSTGATGSTGVTGATGETGPTGNTGATGETGPTGNTGATGNTGPTGETGVTGSTGPTGETGVTGSTGPTGNTGATGSTGPTGETGATGSTGVTGNTGSTGETGPTGSTGATGETGPTGSTGVTGNTGATGSTGVTGNTGATGSIGATGNTGATGETGPTGSTGPTGSTGATGNTGNTGNTGPTGSTGATGATGSTGPTGSTGTTGNTGVTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 28082 - protein, 2724 aa, Bacillus cereus
  var. anthracis
  strain CI
MKKSLKCFNVVTIIALLLSITLPSPSAFAEMHKKSWDELQGNDVRIKAEQVNAEIYRGEVAEREHVFQYTIENTGDTPIQELVLKQSNENEITFLSQSVKVNEEKLPENKVADFYVEEKDKGGKLLSSNLKIRDLKSHEKMTVLIKASRTQHFNKEYKQKISVQKDQVQIGSMSFDVEGIPSEDKVEATADDEADSSKKSVVPSGNNTTKKVDEKLKVSVEDTNKPTSNKELPKQPVTEAEKQPEKEVAKQSNAEVQAASENASKVQIQVGDKQGFGDPLYSTIAAGNLVQTGNVTLGLTTDHYGRQSMGYKTNKMTVDVDNDDSTFNSSTGAFPNIPAGSKVKKAYLFWTAAMGTPSDARTDYRVSDEDVRQPIKMKMGNKQYAEVSADSIRKADYLPYIANHYSSGAGYVAYADVTNVIEKQGISQTVTIANVPQIKFEKGSGYYWGNWNLILVYENYKETVKDMKIWEGLVSQKSTAWADISVNKINTPKEGAFKAKFSYFSSQGDPAENDIYAYDYGEYDFGLGYQKLKNINGKENDVNDSSMTEVQVDGTNEFVTKKYPGYNPDWTNFFSTDIHTYHLEGPNQVKNDLKEAKMRFRANGATGDIYVLNNATFVTEHNAPNLQVDKKALDSAGKEIKEVKAGEEITYKIEVKNDTKNNQAPVSNVKGFDKLDDRLEYVPGSIQYVTGSNTGQKTDDASDDEAEFVNNQIDFRIGEGADAKDGGVLKPGESAVLTFKVKVKESIKSNTTVKNVVAVKGQDSAEIKYESEDDANVTVTIPKEVPGEIEARKIASNKSPKLGDEVEYRIIFKNKVKDGRLDVLMIEDELPGSLEYVKDSLKAEGEKPEPVELKFENGKIIAKYPAITDMEERSIVFKTKVKENAEIGKEIVNKAIVSDKTNPPKNIEEKITPQHKAGKIDAKKKATNKKPKLGEEIEYQISFNNTVENGKLDAVTIEDEIPANLEFVQGSERAEGAEPNPVELKVENGKVIAKYPEITDTKERSISFKVKVKEEAKAGETIVNKAVVSDPNGQSEHPEEKVTPDYKDGKVDVDKSVTNQTPKLGEEVEYRITFHNTVENGKLEKVMIEDTLPAGVEYVKDSLKAEGIKPEPVELKMENGKIIAKYPEITDTEKRSIVFKVKVKDSAKVGEAIVNKAIAKDPKHDPVDAKVVITPQSKKGEIAATKVVNNKKPKLGEEIEYRISFHNMVENGKLAEVRVEDTIPKGLEYVENSIKAEGEAPGPVELAVEAGVVKAKYIDITDTKERSIVFKVKVKEEAEVGKEIVNRAIVDDTKHQPIEPEERITPQHKDGIIDATKIVDNPTPKLGEEVEYRISFKNTVENGKLEKVTIEDTIPNGLEYVKGSEKAEGDKPAPVKLHVKDGKVIAEYENITDTKERSIVFKVKVKEEAEIGKEIVNQAIVDDTKDSKKPEAKITPLHKDGKIKAKKSVNNETPKLGEEVEYRISFKNTVENGKLAEVKIEDTLPEGLEYVENSLKAEGAGPNPVELKMENGKVLAKYPEITDIEERSITFKVKVKEEVKVGEKIVNKAIVDDTKHDPINPKAEITPQYKDGKIEAKKVVNNPSPKLEEEVEYRISFKNTVEHGKLAEVIIEDDLPNGLEYVKGSLQAEGSKPNPVELKFENGKVLAKYPEITDTKERSITFKVKVKGNVSDTIINQAIVSDTKHPPETPKAEIIPQHKDGKLEAKKVVNNLLPKLGEEVEYRISFKNTVENGKLAEVKIEDTLPEGVEYVENSVKAEGSKPDPVELKVENGKVLAKYPEITDTEERSITFKVKVKDEVKVGKKIVNKAIIDDTKNEPETPTAEITPQHKDGKVEAKKTVNNPSPKLGEEIEYRISFKNTVENGKLAEVKIEDNLPNGLEYVKDSLQAEGSKPNPVELKVKDGKVIAKYPEITDIEERSIVFKAKVKEDFKVGEGIVNKVVVDDTKDPKTREVTVTPEYKDGKLKAEKFVNNKKPKLGEEVEYRINFKNTVENGKLVEVKVEDEIPAGLEYVENSLQAEGSKPIPVELKFENGKVMAKYPVITDTKERSIVFKAKVKEEAEIGKEIVNKAIVVDTTHEPEKPYVEITPQYKDGKIIAEKVANNHKPKLGEEVEYRISFKNTVENGKLAEVNIKDTLPKGLEYVEGSITAEGSKPKPVELQVKNNKVMAKYPAITDTEERSIVFKAKVKESVKAGEEIVNEAIVDDTKNVPEEPYVPITPQYKDGKIEARKEVSNYEPKLGEEIEYRIIFNNTVKDGKLAEVKIEDEIPAGLEFVQGSEKAEGAEPKPMELKVENGKVIATYAEIMDTEERSIVFKVKVKESVTIGKAITNKAIIHVDDPNHPIIEPTAKITPQYKDGKIIAHKKVNNDKPKLEEEIEYRISFSNTVKDGKLAEVKIEDEIPSGLEYVKDSLKAEGDKPAPVELKEEAGKVTAKYENITDTKERSIIFKVKVKDTAEVDKAIVNRAIVDDTKNPPERPEVEITPQYKEGKVKADKNVSKKDPKLGEEVEYRISFKNTVENGKVAEVKVEDEIPAGLEYVQDSLRFEGAEPNPVELKVEFGKVIAKYLDIADMKERSIIFKAKVKEAPSKGITNRAVVDDGINPPLEPTVTIVTKTKEDFKIPEEPEVKPEDPKEPEVKPEDPKEPEVKPEDPKELEVKPEDPKKPEVKLEKPEVRLEKLIKEPQVKVERELPKTGAASPWMMSVGAGISFLVGGVLFVLGRRRKQ

SEQ ID NO: 28083 - protein, 965 aa, Bacillus cereus
  var. anthracis
  strain CI
MNKKSKINKVMLSISTMALSLGALQAPVSAEEKVPYNVLKTKPVGIEKPVDEIGHVSKAEETLSFQERLKVGDFSQRPASITNKATVKQVKESYSMADLNKMNDQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHASKSLTAVEKEITETLPMRDAKMTKHSSQFFNTFTLEGTYTGSVTKGESEDWNAMSKKVNEALEQLAQKEWSGYKTVTAYFVNYRINSSNQFEYDVVFHGIAKDDGENKAPTVNINGPYNGLVKEGIQFKSDGSKDEDGKIVSYLWDFGDGSTSAEVNPVHVYEREGSYKVALIVKDDKGKESKSETTVTVKDGSLTELEPNNRPEEANRIGLNNTIKGSLIGGDHTDVYTFNVATTKNIDISVLNEYGIGMTWVLQHESDMQNYAAYGQANGNHIEANFNAKPGKYYLYVYKYDNGDGTYELSVK

SEQ ID NO: 28084 - protein, 455 aa, Bacillus cereus; identical to SEQ ID NO: 27690
  var. anthracis
  strain CI

SEQ ID NO: 28085 - protein, 333 aa, Bacillus cereus; identical to SEQ ID NO: 26112
  var. anthracis
  strain CI

SEQ ID NO: 28086 - protein, 431 aa, Bacillus cereus; identical to SEQ ID NO: 26106
  var. anthracis
  strain CI

SEQ ID NO: 28087 - protein, 3407 aa, Bacillus cereus
  var. anthracis
  strain CI
MKKLFNICLIVFVLFSQFISFPYNQAKAETLKETSLFDTVEMKDATDQIIDEAKNPNNLIKIGSTIQVEYAWSIKDQQVVHANDTAVLQIPLALKVSKDLQGDLVTDQKNIGQYFITAKDNKLKLIFNDQVENSKDAKGKIKIDTVFNPTLKTEEKSVQIAFPLGTLVQPITVPIQVEDSKEDGTKQDTNKQVQDQVAKPTTDNPEQNPATKPATDNPEQNSATKPATDNPEQNPATKPATDNPEQNPATKPVTDNPEQNPATKPAADNPEQNLASDPAEITNSGPKQITTNILTGVKLTDKDGKPFTEDNRPSTDSPANIEFTWELLKSMNVKSGDYYIFDLPKHFKIYNTINSPLYDSENNPIGNFTVTKDGKVTMTFNDYVEEHPDVVGNLQLKTEFNKAEIKGTTTQEIPFPIKDKDVSITVDFKPNVQTATNKKGLPDRPINTNEINWTVEMNKTKDTLKNAVFKDNIPQGTSLNKDSIKVYYLEVDVNGNATRGQEADPADYKVISSDGSKLEIAFKDSIKKAYQIEYVTKITDENVKSFQNNVTITSDNQGQQKASSTVTVSRGTHLNKTSKYDPKTQTIEWTITYNGDQRNIKKTDALLKDIFDDTHELDVNSIVVKNASYDDNGRLVTGDTVNNYTVTNKKNGFDLQFNEDINSAYVITYKTKPTDNVIKDGKIKNTVTADNDSSKENEAGFQQQNIIKSNNKAETNYKDKTTTWTITVNNNNYPLNNAIITDTFDHGGLQLKDKKLEIKDGDYTLQAETDYVLDVTDKGFKITLIGTYQSNMTKTLIVKYTTDFDYTKLESGKTSFKNTGNLSWIDAESNPQSNKVEADFDPDTFTKANGYKYGSYNAQTKEITWIIGFNYNNVEIKDPYVIDVIQDKQKLVPGSIEVRHMILNGSPNNARPGDAVPIEQYELEEPTDKNKNTLQVHFKQSINSPYYIIFKTSLDGELIQNTYKNEAELKDGSKIVNTLKGDAQVNKGGSFVTKKAVQDDNYINWSIAINESQSTIADAVVTDDPTDNQVLVEDSFHLYPTTVDYYGNVTKDTANELKQGTDYKLTITTDNNTGKQHFEIAFLKKIDRAYILEYRSLINADDKEKVSNKAKIAGNQLTVKNTETVETIEVRMSSGSGGGSATKGRGNLEIIKVDNDNKKVPLSGAEFTLYDRTGKTVIRKITTDKDGIAKFNNLKRDKYLLKETKAPEGYVISWDLKQGKIVELGSQETTTYKLANKKFVGKVVLTKSDDLNKNVTLQGAVFTLLDKDKKIILEHEKLTTNDQGQITVDNLKPGTYYLQETTAPEHYKLDSTPIQFTIKEDQTTVINRTATNSLIPGSAILTKVDKDGKTLAGAEFSVRDRHNNVIRGYEKLTTNDQGQIEATNLRPGDYQFVEEKAPKDYDIDKTPIEFTIVKSQKKAVTVTATNHLIKGGVTLTKTDDIDSTALAGAVFKIVDANDEKKVIRENVKTDADGKVTVKDLEPGTYKFIETEAPKDYVLNANPIEFTIDKSQQSFATVTATNSLKTGEVELLKVDEFGDKKPLKGAVFKIVDVNNNDVRTDLTTDADGKTKADKLRPGTYKFIETAAPEHYVLRAEPIEFTIDRSQKETLLVKAENALKPGDVELTKVDDIDGTALEGAVFKIVDANDEKKVIRENIKTGADGKAIATGLRPGDYKFIEVTAPKYYDKNTKPIEFTIKESQGTSPITVTAKNSLTKGGIELTKVNAADEKETLEGAVFKIVNRDTNEDARTNLVTNSEGKLVVDDLRPGNYKLIETKAPTYYDVNVEPIEFTIEKGQQTLLPLTFKNSLTKGKVKLIKEDDVESSIALAGAVFTLQDASGTEIAKDLKTDEHGALVIPDLAPGDYQFIETAAPEHYKLDQTPIKFTIKKGSKDDLPVPVTVKNSLLTGGVTLTKVDDVDGTTLEGAEFIIVDAHDTEKVVRKGLTTDEHGKISASDLRPGDYQFIEVKAPKDYTLGNDPIPFTIGKSQKENITVTATNSLKKGAVTLTKIDDIDRTMLKGAIFKIVDMDGNEVRTNLGTDKNGKIHVPDLRPGDYQFIETKAPEHYVLDETPIPFTIERSQTKEINVTGKNTLKKGSVELTKIDDIDTDTKLANAVFNLLDADGEIVEEGLTTNAEGKIVVENLRPGTYQFVETIAPEHYDLNKTPIEFTIKKSQTETLHVTAKNALTKGAVELSKVDDIDGTKLEGAVFNIVDMNGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKKPIVVTVEKSQKNIATVTMKNSLTKGGVELSKVDDVDGTTLEGAVFNIVDMNGTVIRKSLTTNSQGKISVPDLRPGDYQFIETKAPKHYDLNKEPIPFTIEKGQAEPISVTAKNSLTKGAVELSKVDDIDGTALEGAIFKIVDMNGHDVRTGITTDAKGKVSISDLHPGDYQFIETTAPKHYKLDATPIKFTIEKSQAEKLQVTAKNSLIEGAVELIKVDDITPDTKLSDAVFNIIDAKGKVVRTNLTTDKDGKISASNLRPGDYQFVEMKAPKDYDLNETPIPFTIEKSQSTHVSVTAKNGLTKGGVELTKIDSLDTKETLEGAVFKITDLNGNDIRTNLVTNKDGKIIAKDLPPGDYQFIETKAPKHYDLNETPIKFTIERSQTKHVFVTAINSLTKGSVELIKVDDVEENTTLEGAVFKIVNKDGHNVRTDLTTDKNGRLVVDELPPGDYEFIETKAPTHYKLNETPIKFTVKKGQEKIASVTATNSLTKGAVELSKVDDIDGSALKGAVFKIVDMNGNDVRTDLTTDKDGKISVSDLRPGDYQFIETKAPTHYDLNQTPINFTVEKSQTATASVTAKNSLTKGAVELTKVDDIDGTTLEGAIFKIVDMNGNDVRTDLTTDKDGKISVSDLRPGDYQFVETKAPTHYDLNQTPINFTVEKSQTATASVTAKNSLTKGAVELTKVDDIDGTTLEGAIFKIVDMNGNDVRTDLTTDKDGKISVSDLRPGDYQFIETKAPTHYDLNQTPINFTVEKSQTATASVTAKNSLTKGAVELTKVDDIDGTTLEGAIFKIVDSNGHDVRTDLTTNKDGKISVSDLRPGDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKIDSSSGGEEKPVTPPNKEEETGKETSEELEKGNPEAHGKGTSEELEKGNPETQINKQQDDRNTGKELPNTGHKNDSTQTVGIILLLAGLLSVLATKRKKYY

SEQ ID NO: 28088 - protein, 372 aa, Bacillus cereus; identical to SEQ ID NO: 27683
  var. anthracis
  strain CI

SEQ ID NO: 28089 - protein, 971 aa, Bacillus cereus
  var. anthracis
  strain CI
MKGYSKKVLVGVSFASLMLGSFQGGALAEGTKGEQASYRNVLKMEPVGLQLPVQELAHSSKVLENKSFEKRLQFADLSQRPPELKKESKQLATAKIYTIAELNQLSNQQLVDLLVTIDWEQITGLFQFNKDSLAFYQNDSRIQAIIDKLNQQGQAYTKDDSKGIETLVEVLRSGFYLGFYHTELSKLNERSYHDKCLPALKAIANNPNFKLGTLEQNRVVSSYGKLIGNASSDVETITSAAKVFKQYNDNFSIWVDNLSAGNAIYDIMQGVDYDIQSYLYDTRKAPKDTVWYQKIDSYINELSRFALIGTVTEKNGWLINNGIYYTGRLGTFHSTGMKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDEPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIAAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKAPVAVINGPYSGNVNEAISFKSDGSKDEDGKITSYKWEFGDGAVSNEQNPTHVYTKEGTYTAKLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 28090 - protein, 403 aa, Bacillus cereus
  var. anthracis
  strain CI
MNNKNKGKVFYGNDCCEVRACSHINISKSELTEFVRLLQALGQAIQAVFQNPSQTNIDNLIAALNNLQKFLNCLDLSPAQKQIGNSIIANLLTILRTTPFSCGALYVELQSLLNYLLYIAKLFKVDCCTIDKLVRLITEIQTILVQYGSGCLGGGGATGATGATGPQGPAGATGATGATGPQGPAGAQGATGPQGPQGAQGPAGVQGATGPQGPQGIQGPAGATGATGPQGPQGVQGPAGATGATGAQGPAGATGATGAQGATGATGPAGTPIPVTIAAIGNSNPQTISPGTNLQFNQVFELTNISFNDTSDTLTILETGVYDISFSASTTFPGSSPFGFGISFNGQPPTRNFSTNVIGSAVSFSTIVTLQAGTTISIQPTANTISIPNTGDTTATLSVFRIY

SEQ ID NO: 28091 - protein, 568 aa, Bacillus cereus
  var. anthracis
  strain CI
MSRYDDSQNKFSKPCFPSSAGRIPNTPSIPVTKAQLRTFRAIIIDLTKIIPKLFANPSPQNIEDLIDTLNLLSKFICSLDAASSLKAQGLAIIKNLITILKNPTFVASAVFIELQNLINYLLSITKLFRIDPCTLQELLKLIAALQTALVNSASFIQGPTGPTGPAGATGATGPQGAQGNTGATGATGPQGVQGPAGATGATGPQGVQGNTGATGATGPQGAQGNTGATGATGPQGAQGNTGATGATGPQGAQGPAGATGATGPQGIQGPAGATGATGPQGVQGPAGATGATGPQGAQGNTGATGATGPQGAQGPAGATGATGPQGIQGPAGATGATGPQGAQGPAGATGATGPQGVQGPAGATGATGPQGVQGPAGATGATGPQGVQGNTGATGPQGAQGPAGATGATGPQGVQGPTGATGIGVTGPTGPTGPSGPSFPVATIVVTNNIQQTVLQFNNFIFNTAINVNNIIFNGTDTVTVINAGVYVISVSISTTAPGCAPLGVGISINGAVATDNFSSNLIGDSLSFTTIETLTAGANISVQSTLNEITIPATGNTNIRLTVFRIA

SEQ ID NO: 28092 - protein, 808 aa, Bacillus cereus
  var. anthracis
  strain CI
MKKSKKMLAGATLAIGVIAPQVLPTTAHADEKAGESTVNLRILETSDIHVNLMNYDYYQTKTDNKVGLVQTATLVNKAREEGKNSVLFDDGDALQGTPLGDYVANKINDPKKPVDPSYTHPLYRLMNLMKYDVISLGNHEFNYGLDYLNKVISKTEFPVINSNVYKDDKDNNEENDQNYFKPYHVFEKEVEDESGQKQKVKIGVMGFVPPQVMNWDKANLEGKVKAKDIVETAKKMVPKMKAEGADVIVALAHSGVDKSGYNVGMENASYYLTEVPGVDAVLMGHSHTEVKDVFNGVPVVMPGVFGSNLGIIDMQLKKVNGKWEVQKEQSKPQLRPIADSKGNPLVQSDQNLVNEIKDDHQATIDYVNTAVGKTTAPINSYFSLVQDDPSVQLVTNAQKWYVEKLFAENGQYSKYKGIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIINMTYEGKPVADNQEFIVATNNYRGSSQTFPGVSKGEVVYQSQDETRQIIVKYMQETPVIDPAADKNWAFKPIVADKLNTTFDSSPNAQKYIKKDGNISYVGPSENEFAKYAIDITKKNDDDKETGGENPTTPPTGEGDNGENPTTPPTGEGDNGENPTTPPTGEGNNGENPTTPPTGEGNNGENPTTPPTGEGNNGGNPTTPSTDEGNNAGSGQTTTDNQNSKETTTVSENKEERDLPKTGTSVASTIGAGLAFIGAGFLLLFRRKKANR

SEQ ID NO: 28093 - protein, 800 aa, Bacillus cereus; identical to SEQ ID NO: 27473
  var. anthracis
  strain CI

SEQ ID NO: 28094 - protein, 764 aa, Bacillus cereus
  var. anthracis
  strain CI
MKKRKVLIPLMALSTILVSSTGNLEVIQAEVKQENRLLNESESSSQGLLGYYFSDLNFQAPMVVTPSTTGDLSIPSSELENIPSENQYFQSAIWSGFIKVKKSDEYTFATSADNHVTMWVDDQEVINKASNSNKIRLEKGRLYQIKIQYQRENPTEKGLDFKLYWTDSQNKKEVISSDNLQLPELKQKSSNSRKKRSTSAGPTVPDRDNDGIPDSLEVEGYTVDVKNKRTFLSPWISNIHEKKGLTKYKSSPEKWSTASDPYSDFEKVTGRIDKNVSPEARHPLVAAYPSVHVDMENIILSKNEDQSTQNTDSQTRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNEPNGNLQYQGKDITEFDFNFDQQTSQNIKNQLAELNVTNIYTVLDKIKLNAKMNILIRDKRFHYDRNNIAVGADESVVKEAHREVINSSTEGLLLNIDKDIRKILSGYIVEIEDTEGLKEVINDRYDMLNISSLRQDGKTFIDFKKYNDKLPLYISNPNYKVNVYAVTKENTIINPSENGDTSTNGIKKILIFSKKGYEIG

SEQ ID NO: 28095 - protein, 809 aa, Bacillus cereus
  var. anthracis
  strain CI
MNIKKEFIKVISMSCLVTAITLSGPVFIPLVQGAGGHGDVGMHVKEKEKNKDENKRKDEERNKTQKEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEIQEVFAKAFAYYIEPQHRDVLQLYAPEAFNYMDKFNEQEINLSLEELKDQRMMARYEKWEKIKQHYQHWSDSLSEEGRGLLKKLQIPIEPKKDDIIHSLSQEETELLKRIQIDSSDFLSTEEKEFLKKLQIDIRDSLSEEEKELLNKIQVDSSNPLSEKEEEFLKKLKLDIQPYDINQRLQDTGGLIDSPSINLDVRKQYKRDIQNIDALLHQSIGSTLYNKIYLYENMNINNLTATLGADLVDSTDNTKINRGIFNEFKKNFKYSISSNYMIVDINERPALDNERLKWRIQLSPDTQAGYLENGKLILQRNIGLEIKDVQIIKQSEKEYIRIDAKVVPKSKIDTKIQEAQLNINQEWNKALGLPKYTKLITFNVHNRYASNIVESAYLILNEWKNNIQSDLIKKVTNYLVDGNGRFVFTDITLPNIAEQYTHQDKIYEQVHSKGLYVPESRSILLHGPSKGVELRNDSEGFIHEFGHAVDDYAGYLLDKNQSDLVTNSKKFIDIFKEEGSNLTSYGRTNEAEFFAEAFRLMHSTDHAERLKVQKNAPKTFQFINDQIKFIINS

SEQ ID NO: 28096 - protein, 172 aa, Bacillus cereus VD014
MGKIFKFGCLGIIALFVIGIIAMVAGGGDSTEKTSTDTKAVSKEGVSSDVKIAVGSMETVDSVGNEYTKEQAQGVFKILEVTLTNNQKDAITVDANSFKLVDNKGREFTYSTQGQTSFDLTNGGKTDFFLKQLNPGLTQTGKIVFDIPKDAEGLFLKASGGMTGKEIKLKVE

SEQ ID NO: 28097 - protein, 503 aa, Bacillus cereus VD014
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKVEGTGKVFLPNPVVSSGSLVGLKDNNDADSTALTNQLKTVTLKGLDGTGFLIGEYVTISSKARTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSTEGGAMGEGFGDFLGATYEDAVSTTGYGKACVGEWDAAAYSSSDPTCLRRLDTNKVYPKDIKNQVHADGEIWSQGQYEMAQAFGRDVATKIILQSHWSLTPNSKFSDGAKAIKQADALLYGGQHAADIDRIWAARGISTN

SEQ ID NO: 28098 - protein, 179 aa, Bacillus cereus VD014; identical to SEQ ID NO: 26847

SEQ ID NO: 28099 - protein, 965 aa, Bacillus cereus VD014
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIANNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFGTFDKIQDLIRANDVKNYDAYRENLSKDPKLNKEYQEYMQQLIDNQDKYNVPEVADDYLAEHAPKSLTEVKKEISDTLPMKDAKMTKHSSQFFNTFTLEGTFTGNVTKGESEDWKAMSKRVNESLEQLAQKEWSGYKTVTAYFVNYRVNSSNEFEYDVVFHGIAKDDGENKAPTVNINGPYSGLVKEGIQFKSDDSNDEDGKIVSYLWEFGDGSTSAEVNPVHVYEREGSYKVSLRVKDDKGKESRSETTVTIKDGSLTESEPNNRPEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYSLSVK

SEQ ID NO: 28100 - protein, 163 aa, Bacillus cereus VD014
MLKKVSQIVLIFGIAFSLSACTETKDSNESKQEDVQDKVYKIGETVDVDGLQVTIDSVKLGYPDYDEDKKKEEILGIIFKVENNSKKEIPFAFYEFEITDKKGTRFKEYNNPDSFISKKLAPDEKIQDIMLFDVAKENTYIATYRPEFTRENRTIKFELKPNK

SEQ ID NO: 28101 - protein, 960 aa, Bacillus cereus VD014
MNKNLKFTQMMIGISTMALSFGSIQTQVSAEETASYNILQMKPMGTETSKDEIVHATKADETLTFEERLKIGDFSQRPTLVMKRDEIQLKQSYTLAELNKMPNSELIDTLSKISWNQITDLFQFNQDTKAFYQNKERMNVIINELGQRGKTFTKENSKGIETFVEVLRSAFYVGYYNNELSYLKERSFHDKCLPALKAIAKNPNFTLGTAEQDRVVAAYGKLIGNASSDTETVQYAVNVLKQYNDNLTTYVSDYAKGQAVYEIVKGIDYDIQSYLQDTNKQPNETMWYGKIDNFINEVNRIALVGNITNENSWLINNGIYYAGRLGKFHSNPSKGVEVITQAMSLYPRLSGPYFVAVEQIKTNYGGKDYSGNAVDLQKIREEGKQQYLPKTYTFDDGSIVFKTGDKVTEEKIKRLYWAAKEVKAQYHRVIGNDKALEPGNADDVLTIVIYNDPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFETFDKLQDLIRANDVKNYDLYRESLSNNTQLNAEYQAYMQQLIDNQDKYNVPQVTNDYLIQHAPKPLDEVKNEIVDVANIKDAKITKYESQFFNTFTVEGKYTGGTSKGESEDWKTMSKQVNRTLEQLSQKGWSGYKTVTTYFVNYRVNAANQFEYDIVFHGVATEEKEKTNTIVNMNGPYSGIVNEEIQFHSDGTTSENGKVTSYLWNFGDGTTSTEANPTHVYGEKGTYTVELTVKDSRGKESKEQTKVTVKQDPQTGESYEEEKVLPFNTLVKGNLITPDQTDVYTFNVTDPKEVEISVVNEQNIGMTWVLYHESDMQNYVACGEDEGNTIKGKFVAKPGKYYLNVYKFDDKNGEYSLLVK

SEQ ID NO: 28102 - protein, 457 aa, Bacillus cereus VD014
MNKKFFKQLKKMATNKKGLSAAAVAVGIMGTTLIPQNAYAHGFVEKPGSRAALCSQNYGALNSNCGNIMYEPQSLEAPKGFPQGGPADGKIASAGGLFGGILDQQTADRWFKNTIKGGENTFTWKYTAPHSTSQWHYYITKKGWNPNKPLTRMDFEPIGTVKHDGSAASNNLSHKINVPTDRSGYHVILAVWDVADTVNAFYNVIDVNLINNEKTDTEAPTQPSGVQVVKATSNSVELSWKPAIDNVGVKEYQVLRNGQLINTIVGTSVVDKKLSPNTGYTYTVKAVDAAGNISRESEALVVKTTVEKPDTEAPTQPKGLHSMGTTTNSIDLMWSPSEDNIDVNHYIVYREVGGVMKELGTANTTSFMDKDLQANTIYKYVVSAVDSAGNESMKSDALTIATKGQENTYEQWGAYKAYKKGDKVVHEGKVYEAVQSYQGNGDPNWIFALSLWNEVNK

SEQ ID NO: 28103 - protein, 1093 aa, Bacillus cereus VD014
MGKRVIIRVFTLLSVLVLFLNVFLPRASAEVMTHEKYSMDWSYSNSLAKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNTNNESVGKITTGADGMAELNNLPIGTYTLKEIKAPTGYVSDDKPQTIEVKTGETGAVQIVNNKVKGNIEIKKLSDSGKILPNVEFTVFTEDGREVKKVVTKENGIANVEGLTYGKYYFLETKTPNGYVGNKTKYPFEIKEHNKTLTFTVENTEVKGSVKLLKVDNEDISKKLEGAVFELKDESGKVVGKYKTDKNGEINVKDLAYGKYSFVEKASPNGYVLVKEQIVFEIKEHGKIIELLAVNHLIKGDLEITKVDVADGNNKLPNAEFTIYNEVGKEVVKGKTDDKGIAKFEKLPFGKYTYNETIAPKGYVLNEETFSFEIKENGQIIKHIVKDEKIPSIKTTATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSIKTTATNKADGGKEIHSKDSITIQDKVEYTNLVVGKEYTVKGKLMNKAINKPLLIDGKEVTAETKFTAKEKNGFVTLDFTFAGAEQQGREVVVFEDLLHEGQVIATHADINDVGQTVRFVEPSIKTTATNKADGSKELDVSKSVTIQDKVEYKDLIVGKEYVVKGKLMDKATKKPLLVDGKEVTVESKFTAKEKNGSITLDFILNASELQGKEVVVFEELYQDNILVAIHAEIEDKGQTVKFKEGKSEQPKPEQPNSGKNTPTPEQPNEQVKEQPQLKKEIQSKIGWLPQTGTNLTSWISMAAGALLLIVGGVIFLKRKNA

SEQ ID NO: 28104 - protein, 137 aa, Bacillus cereus VD014
EPKEPEVKPEEPKEPKEPEMKPEEPKEPEVKPEEPKEPKEPEVKPEEPKEPKEPEVKPEEPKEPKEPEMKPKDLEKPEVKPEKPEVRLEKLIKEPQVKVEKELPKTGAAHSWMMSVSAGISFLVGGVLFVLGRRRKQ

SEQ ID NO: 28105 - protein, 458 aa, Bacillus cereus VD014
MNLKLTSKLERLRKSKKGIGACVLAAGVTAITMIPQSAYAHGFVEKPSSRAALCSQNYGALNLNCGNIMYEPQSLEAPKGFPDGGPIDGKIASAGGLFGGILDQQTSNRWFKNTIKGGANTFTWKYTAAHPTSKWHYYITKKGWDPNKPLTRAELEPIGTVKHDGSAASNNLTHTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDIEAPTQPKGLHSMGTTATTVDLMWSPSEDNVSVDHYIVYRESAGVMNKIGTAANTSFMDKDLKANTSYKYVVTAVDLAGNESSRSDVLNVTTKSEDSTYEKWDARKAYTKGDRVVHEGKVYGAVQDHQGNGDSNWIFALSLWKPFLNK

SEQ ID NO: 28106 - protein, 431 aa, Bacillus cereus VD014; identical to SEQ ID NO: 26534

SEQ ID NO: 28107 - protein, 336 aa, Bacillus cereus VD014
MKRSKTSLKCLALSAVFASGALTLSTPATYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGYTFGTANWVGNNVKDVDQKTFNKSFTLDWKNKKLVEKK

SEQ ID NO: 28108 - protein, 553 aa, Bacillus cereus VD014
MKKIFSVLLVLFLTFSTWSSVLVKADSPSKGTLTIHKYEQEKDGAQGLEGNGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLVKTGVNEKVLAGAVFSLFKKDGTEVKKELVTDANGHIRVQGLEYGEYYFQETKAPKGYVIDPTKREFFVKNSGTINEDGTITSGTVVKLEVKNYEEATIDKKINAKLEALPINPLTNYNYDIKTLIPEDIKEYKKYVVTDTLDNRLVIQGKPIVKIDGAEVNANFVELDIEGQKVTATVKDFTKLDGKKEFHLQIKSQVKEGVPSGSEILNTAKIDFTNKNDVMGEKESKPVVVVPTTGIIELTKIDGANKNKLKGAEFVLKDHNGKIVVVAGKEVTGVSDEHGVIKWSNIPYGDYQIFETKAPTYTKEDGTKASYQLLKDPIDVKISENNQTVKLTIENNKSGWILPVTGGIGTTLFTVIGLTLMLTAALVFFRKKFARN

SEQ ID NO: 28109 - protein, 971 aa, Bacillus cereus VD014
MKGYSKKMLVGVSFASLMLGSFQGGSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERGYHDKCLPALKAIANNSNFKLGTLEQNRVVSSYGKLIGNASSDVETITSAAKIFKQYNDNFSTLVDNLSAGNAIYDIMQGIDYDIQSYLYDTRKEPKDTVWYQKIDSYINELSRFALMGTITEKNGWLINNGIYYTGRLGMFHNTGTKGLQVVTDAMKIYPYLGEQYFVAAEQIATNYGGKDANGNVVNLDQIREEGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTLEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKRVSDIAAEITAEAKLKNVSVKKNKSQFFNTFTLQGTYTGTTAKGEYEDWKTITQNVNDTLKRLSAKEWTGYKTVTAYFVNYRVNASGQFEYDVVFHGINTEEGAENKAPVAVINGPYSGNVNEAISFKSDGSKDEDGKITSYKWEFGDGAVSNEQNPIHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 28110 - protein, 370 aa, Bacillus cereus VD014
MKTKKTIAASTLALAMIAGANSAHAEVNDATPQQSTGDRLAEIKQHKQELDAKLQQHKENVDQTLNELNKVKENVDTKVNELHERKQVADEKINEVKQHKQELDAKLQQDKQIAEDKIAEIKEHKKQVEDKVAEVKEHKQNIDNKVDEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAVLQEARQDLINKINEIKQSKQTVSDDLSKKKQDLDIKINDFKHTEKKIDDKLAELHTTKQNVDNKINEVSQSKQTQADNGTKNNNAKELPNAGSEQSNNMALGMLSVLGGVLLLTRNKIKTLFSK

SEQ ID NO: 28111 - protein, 455 aa, Bacillus cereus VD014
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSSPNGLQTKKVTANSVELTWNSSTDNVGVKGYQIFRNGEMIDTILGTHFIDKKLQPSTEYSYTVKAIDAAGNVSKESTALTVKTTVATPDTEAPTQPKGLHSMGTTASSVDLMWSPSDDNIGVDHYDIYREIEGLMKKIATSNTTSYMDKNLLANTTYKYVVKAVDVAGNESVQSDIFTITTKAESASYEAWDAKKAYKKGDRVLHEGKVYEAVQSYQGNGDPNWIYALSLWKTV

SEQ ID NO: 28112 - protein, 110 aa, Bacillus cereus VD014
MKKYVLLSIFLLVPIFFFYEEVSARSMNSKAGITFSNSYNPSEMVDPLIPDGSNLVTNTSDDLIKKKVLPKTGGHSSMILQYVGIGLLIAAFVVLFNVKNRVIETKVSIK

SEQ ID NO: 28113 - protein, 893 aa, Bacillus cereus VD014
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDIKFISEPEVKAVIFVDENHGQASNAYQVTFAATTPNYVSGTYLVNAHNGDILKDMVQESSLKISEEYVESVKENKTSNFTSLTGTGKDDLGVNRTFGIAKQTSGNYALADYTRGQGIETYDVNYRDITNEESYYPGILATSASTTFNDSKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNVNGIGEDKMFDIFYYANTDELNMTSNFSELKLACLKVATNKYGTNSIEVQAVQNAFDAAKIPGTVKENEKTAENQAPELTVPFTITLRVGDTFDPMRNVKAVDKEDGDLTNKVKHKGDVDTSKPGTYIVEYLVVDSQGRTTTARQTVIVEGNGEILDLEPKLTVPVGATMHVGDSFDPMIKVKAIDKEDGDLTSKVKVDGGVDTSKVGTYVLTYTVTDSKGHEVTAKQTVTVKVREEVTNEKPILKVPATTSITEGDQFDPLVGVSATDKEDGDLTSKVAYEGTIDTTKAGTYEIIYSVKDSMGNDVNTKQKVLVKDKETSKANGLANKANKSNISNNSNSDKKEYTYKELPKTGVSTNNSAAIGILMIITGTVLTFVRKFRKIQK

SEQ ID NO: 28114 - protein, 471 aa, Bacillus cereus VD014
GKAKISDLSVGKYKLVEKESLPGYKQLTEPVSFEIKKGMTEVLSLKIENEMVDTGNVEITKIDKDNKAPLAGVVFEVQDDKGKVVTKVTTDKAGKAIVADLSVGKYKLVEVESLPGYKKLEKPVLFEITKGMTKSLAFTVENEMVDTGNVEITKIDKDSKAPLENVVFEVRDSKGKVVAKVTTDKEGKADVSDLSIGKYELVEVETPAGYKPLEKPVSFEIKKGMTKVLSLKVENEQLDKGSVEITKMAAESKEVLSGAVFEVHDEKGKVVVKVTTDKDGKAKIADLSVGNYTLVEVEAPKGYEKLTNPIPFEITNGMINAVQLEVLNKLNHLAPPGPETPDPENPGTPDPENPGIPDPENPGTPDPENPGTPDPENPETPDPENPGTPDPENPGTTNPENPGTPNSEKPGTPNSENPGTPDPEKPGTQNPEKPEKELPKTGQKMPVEPYMGALLVMMSFGLLVLGRKQQR

SEQ ID NO: 28115 - protein, 333 aa, Bacillus cereus VD014
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFIHVIGTHLQAEDSMCGKTSPASVRTDQLKEIQDFIKNKNIPKNEYVLIGGDMNVNKINIENKNDSEYASMFKTLNASVPSYTGHTATWDATTNSIAKYNFPDSPAEYLDYIIASKDHANPSYIENKVLQPKSPQWTVTSWFQKYTYNDYSDHYPVEATLSMK

SEQ ID NO: 28116 - protein, 888 aa, Bacillus cereus VD022
MKKKLATIVTCTFLTSLIPNGSIHSVYAENSEKTVSTTQTQKEEVSRGGLIGYYFKGKDFNNLTMFAPTINNTLIYDQQTADTLLNKQQQEFNSIRWIGLIQSKETGDFTFQLSDDKNAIIEIDGKVVSRRGEDKQTIHLEKGKMVPIKIEYQSNEPLTVDSKVFNDLKLFKIDGHNQSHQIQQDELKNPEFNKKETKELLSKTAKRNLFSSNEVRSDEDDDLDTDGDSIPDNWEMNGYTIQRKMAVKWDDSFAEKGYTKFVSNPYEAHTVGDPYTDYEKAAKDIPLSNAKEAFNPLVAAFPSVNVGLEKVVISKNEDMSQGVSSSTSNSASNTNSIGVTVDAGWEGLFPKFGISTNYQHTWTTAQEWGSSKEDSTHINGAQSAFLNANVRYQNVGTGAIYDVKPTTSFVLDGTTIGTIKAKENTTALSLSPGDSYPKRGQNGIAINTMDDFNSHPIPLNKEQLNSYMSNKAPILMETNQTEGKYAIKDVNGQTVVAGDWNGIQQQIENKTTSIIVDNGDNVTEKRIAGKDYSDPEDLTPGLTFREALKLAYPDEVTEKDGLLFYNNKPIYEEAVQSYLDEYTAKQVKKQLEDTTGKFKDVKKLYDVKLEPKMNFTIKTSTIYDGAESGNSTTNEVGTWTDTYAFDNNPVNTGKYAYYSNNKAKVTLSNEARKKLQPNTNYYLSFYMKRYGASEGVNIPVKIYDVNGNEIKSEVIKVPDKKAYQRYNILIPNVKGHEIGSVTFESSGKTINFDDVAFTEVGAAEVENNGLSDLEIQKIYKDTTELWGEDSGSTYLNGVLFKNIEPFMGDQVKAYRVVYQGARIPSGIDESFDVTKPAYAYNKDGSVKVNFLEYNKGMGIDFIPTIDSIRIYAVLTDNRQVLVYRKADR

SEQ ID NO: 28117 - protein, 209 aa, Bacillus cereus VD022
EPTKEVEESKEEVKEPTKEVEESKEEVKEPTKEVEESKEEVKEPTKEVEESKEEVKEPTKEVEESKEEVKEPTKEVEESKEEVKEPTKEVEESKEEVKEPTKEVEEAKEEVKEPTKEVEESKEEVKEPTKEVEEAKEEVKEPKGNNQVVENEGRTADTLNTQHVNKTEEGKKSLPSTGGEASTSTLLSGITLVLSALSMFVFRKRLFKK

SEQ ID NO: 28118 - protein, 163 aa, Bacillus cereus VD022; identical to SEQ ID NO: 26541

SEQ ID NO: 28119 - protein, 266 aa, Bacillus cereus VD022
MLSKKVASFGLVTIVLMSGTANAASAMEQSSTLDYPISSIESTKKADKFLDKLIDFKDKEKEAKNYGKNLPNHRDKIVVTPKAKEAFNNYEQNGTRINQALREGKVDGYPKEYVKVAKEYAAEMDKVFKQNAASVPDTIMVYRYTDEQQFGIAPGTFFPKDPKNPKETIVNKESIEKFKKKYEGKTVKDKGFTSTSLAILDKYLGEKAKTIRMDIEVPKGTHAVYMGNEYAELILPRNASLKIKKVSGIVEKGKLIVKVDASVINK

SEQ ID NO: 28120 - protein, 971 aa, Bacillus cereus VD022
MKGYSKKMLVGVSFASLMLGSFQGVSLAEDTKGEQVSYRNVLKMEPVGVQLPVQELAHSSKLLESKSFEQRIQFADLSQRPPEVKKESKQLAVAKTYTIAELNQLSNQQLVDLLITIDWEKITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGSFHSTGTKGLQVVTDAMKIYPYLGEQYFVAAEQIATNYDGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHAPKPVSDIAAEITAEAKLKNVSVKKNKSQFFNTFTLQGTYTGTAAKGEYEDWKIITRNVNDTLKRLSAKEWTGYKTVTAYFVNYRVNASGQFEYDVVFHGINTEEGAENKAPVAVINGPYSGNVNEAISFKSDASKDEDGKITSYKWEFGDGTVSNEQNPTHVYTKEGAYTAKLTVTDDKGATNTATATVTVQKKEDNSLEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 28121 - protein, 458 aa, Bacillus cereus VD022
MKLKLTSKLERLRTSKKGIGACVLAAGMTAITMAPQSAYAHGFVEKPSSRAALCSQNYGVLNLNCGNVMYEPQSLEAPKGFPDSGPIDGKIASAGGLFGGILDQQTSNRWFKNTIKGGVNTFTWKYTAAHSTSKWHYYITKKGWDPNKPLTRAELEPIGTVKHDGSAASNNLTHTINVPTDRNGYHVILAVWDVADTSNAFYNVVDVNLVNNETPDTVAPSQPTELNASKVSANSVEITWKASTDNIGVKEYQVLRNGEVIDTVPGTTFIDKKLKADTEYTYTIKALDSAGNISKDSEKLKVKTTHTIPDMEAPTQPKGLHSMGTTSTTVDLMWSPSEDNVGVDHYIVYRESAGVMNKIGTAANTSFMDKDLKANTSYNYVVTAVDLAGNESSRSDVLNVTTKSENSAYEKWDARKAYTKGDRVVHEGKVYEAVQNHQGNGDSNWIFALSLWKPVLNK

SEQ ID NO: 28122 - protein, 965 aa, Bacillus cereus VD022
MNKKSKINKVMLSISTMALSLGALQTHAVAEEKVPYNVLKTKPVGIEKPVDEVGHVSKVDETLSFQERLKVGDFSQRPASITKKTAVKQVKESYSMADLNKMNDQELVETLGSIKWHQITDLFQFNEDTKAFYKDKGKMQVIIDELAHRGSTFTKDDSKGIQTFTEVLRSAFYLAFYNNELSELNERSFQDKCLPALKAIAKNPNFKLGTDEQDTVVSAYGKLISNASSDVETVQYASNILKQYNDNFTTYVNDRMKGQAIYDIMQGIDYDIQSYLVEARKEANETMWYGKVDGFINEINRIALLNEVTSENKWLVNNGIYFASRLGKFHSNPNKGLEVVTQAMHMYPHLSEPYFVAIEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHATKSLTAVKKEISDTLPMKDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNVNGPYNGVVKEGIQFKSDGSNDEDGKIVSYLWEFGDGSTSAEVNPVHVYEREGSYKVSLRVKDDKGKESRSETTVTIKDGSLTESEPNNRPEEANRIGLNSTIKGNLIGGDHTDVYTFNVASAKDIDISVLNEYGIGMTWVLHHESDMQNYAAYGQANGNHIEAKFNAKPGKYYLYVYKYDNGDGTYELSVK

SEQ ID NO: 28123 - protein, 431 aa, Bacillus cereus VD022; identical to SEQ ID NO: 26534

SEQ ID NO: 28124 - protein, 904 aa, Bacillus cereus VD022
MKLKSIFKCLTITAILSQIAVSPVTSFAENSNGKKADNKTNVEEKSNIQGLLGYYFKDAQFQDLTSIKVGEQSDKLIDKARVIKSNQTIHSVRWMGRVNPSQTGEYTFSTSSDQHIILQINGENIIDQSEMKKTIKLEKDKVYELKIEYRNTKNTLPDLQLFWSIDGKAKEPIPPKNILLPNFSEKENLPNNKKDMLLLPNFNLFDNKSYSSKLIDTDTDKDGISDEWEEQGYTFKDQQIVKWEDSYLAQGYKKYVSNPYKARTVADPYTDFEKVSGHMPEATKDEAKDPLVAAYPAIGVGMENLLFSKNENVTEGASGTKSKSVTDTNTNTNSVEVGGEVGGALNPFAFASFKVSTKYSHSWTNSTAIQNSESGSWSRQIGINTAESAFLNANVRYYNAGTAPIYELRPTSNFVFQNSGTSIATITAGSNQIGNSLGPSDTYPKREQAPISLDKANEAGTVKIVINGEQLNAIQSHSEKLNLETTQNKGQYGILDDTGKLITDASKQWDPIRTNIDAVSGSLILDTGTSKENLERRVAAKNENDPEDKTPEITIGEAIKKAFNAKEKDGRLYYTDRTEKNMYIDESSVNLIGDEKTQKEIEKQLEQMQDKKVYKTKWKRGMNITLRLPVAYYDFEANGNTNWYYTNQENGGYTGKKHGMIGQNGNGYAQKNLELQPYTSYTARAYVKTASPTGKNNVVFYADSTINGDGNGARQNVTIEGDKWQVIEFSFNTGGHPEYFQKLGLKNTGNTNLQFDDVSVTEWRRALGENLIQNGNFDKGKEYWESLMGLPSFEVKDGYLIGNSTNIVMNKSLGVKPNTKYKIEYDLRINPGSISKPKILILGYASGSLNEMIEDEVNVSNDWQTYILDFTTASDTQNIIFGIYDAQSGGYYNLDNVKCREVLL

SEQ ID NO: 28125 - protein, 519 aa, Bacillus cereus VD022
MKKKMRDFLVPAENIRNSRKRNKWRKIAPIAMCGIMGTMFFGGNSAFAHGYIAEGRAHIGSTYENLQLNWEQANNKYGAAVGNPQGVEAPKGFPVDGPIDGGIASGGHIEYAPLDIQKPFYWKTIDMNSGPNTFVWIYTASHKTTKWHYYITKQGWDSSKPLTRDELELIETVPWDGTNAIPNKPAGASGTGLPHSVNIPSDRSGYHVILGVWDVADTSNAFYQVMDVNIKSNNQGEISVDKEAPSTPINLKGNSTSSSIVLEWTASTDNVGVSYYNVYRNGEKLAPVTETEFKDVTVAPDTKYTYEVSAVDKSGNESAKTMPLTIKTEKASDEDTEIPTAPGDLHSMGETATTVDLMWVNSTDNVAVDHYEIYRNAKRLPTNVYDTKFMDTNLQPNTEYNYIVKAVDTSGNVSAASNLLKVKTKESSAEETTWNAEKVYDVGDHVLFNGNEYVAKWWTQGERPDTADVWNLISDIAVVWNAEKAYNSGDKVECQGEIYQAKWWTQGEIPGKSPVWEKQ

SEQ ID NO: 28126 - protein, 871 aa, Bacillus cereus VD022
MKKKLASVVTCMLLAPMFLNGNVNAVNADSKINQISTTQENQQKEMDRKGLLGYYFKGKDFNNLTMFAPTRDNTLMYDQQTANALLDKKQQEYQSIRWIGLIQSKETGDFTFNLSKDEQAIIEIDGKIISNKGKEKQVVHLEKEKLVPIKIEYQSDTKFNIDSKTFKELKLFKIDSQNQSQQVQLRNPEFNKKESQEFLAKASKTNLFKQKMKRDIDEDTDTDGDSIPDLWEENGYTIQNKVAVKWDDSLASKGYTKFVSNPLDSHTVGDPYTDYEKAARDLDLSNAKETFNPLVAAFPSVNVSMEKVILSPNENLSNSVESHSSTNWSYTNTEGASIEAGGGPLGLSFGVSVNYQHSETVAQEWGTSTGNTSQFNTASAGYLNANVRYNNVGTGAIYDVKPTTSFVLNNNTIATITAKSNSTALSISPGDSYPEIGKNAIAITSMDDFNSHPITLNKQQVNQLLNNKPIMLETDQTDGVYKIRDTHGNIVTGGEWNGVTQQIKAKTASIIVDDGKQVAEKRVAAKDYGHPEDKTPPLTLKDTLKLSYPDEIKETNGLLYYDDKPIYESSVMTYLDENTAKEVKKQINDTTGKFKDVNHLYDVKLTPKMNFTIKMASLYDGAENRSYTGPLGTWYLTYNVVGGNTGKRQYRSAHSSAHVALSSEAKKKLNQNANYYLSMYMKADSTTEPTIEVAGEKSAITSKKVKLNNQNYQRVDILVKNSERNPMDKIYIRGNGTTNVYWDDVTISEVSAINPASLSDEEIQEIFKDSTIEYGNPSFVADAVTFKNIKPLQNYVKEYEIYHKLFSHDSSGNEHITENNFNKEGDLKEDGSVKVDLKDNGLGLWMSVGSNLKVWAITNDGRKIEVLNKNA

SEQ ID NO: 28127 - protein, 412 aa, Bacillus cereus VD022; identical to SEQ ID NO: 26538

SEQ ID NO: 28128 - protein, 333 aa, Bacillus cereus VD022
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFIHVIGTHLQAEDSMCGKTSPASVRTNQLKEIQDFIKNKNIPNNEYVLIGGDMNVNKINAENKNDSEYTSMFKTLNASVPSYTGHTETWDATTNSIAKYNFPDSPAEYLDYIIASKDHANPSYIENKVLQPKSPQWTVTSWFQKYTYNDYSDHYPVEATISMK

SEQ ID NO: 28129 - protein, 453 aa, Bacillus cereus VD022
MVSKKLQAVTKTVLLSTVLSISLLNNEEVKAEQLNINSQNKYTNFQNLKITDNAEDFKEDKEKAKEWGEEKEKEWKLTATEKGKMNNFLDNKNDIKTNYKEITFSMAGSFEDEIKDLKEIDKIFDKANLSSSIITYKNVEPATIGFNKSLTEGNTINSDAMAQFKEQFLGKDMKFDSYLDTHLTAQQVSSKKRVILKVTVPSGKGSTTPTKAGVILNNNEYKMLIDNGYVLHVDKVSKVVKKGMECLQVEGTLKKSLDFKNDINAEAHSWGMKIYEDWAKNLTASQREALDGYARQDYKEINNYLRNQGGSGNEKLDAQIKNISDALGKKPIPENITVYRWCGMPEFGYQISDPLPSLKDFEEQFLNTIKEDKGYMSTSLSSERLAAFGSRKIILRLQVPKGSTGAYLSAIGGFASEKEILLDKDSKYHIDKATEVIIKGVKRYVVDATLLTN

SEQ ID NO: 28130 - protein, 74 aa, Bacillus cereus VD022
NPEKPGTPDPEKPGTPNPEKPGTPGPEKPGTPGPEKPEKELPKTGQKMPVEPYMGALLVMMSFGLLVLGRKQQR

SEQ ID NO: 28131 - protein, 446 aa, Bacillus cereus VD022
MKKKFRKSLVCASLLLLSVPLSNESVSAAYSDLVPDAQNYMTKINSDKLVDFKQDKEKAEKWGKEKEKEWKLTATEKTEINKFLDDKDGLKTKHKEITFSKNFEYEKELKELEKINAGLDRANLTNSIVTYKNMDPTIIGFNTPLTNGNQINSEASQKFKEQFLGKDIKFDSYLDTHLTEQNVSSKERVILKITVPSGKGSTPTKAGVILNNSEYKLLIDNGYVLHVDNVSKVVKKGKECLQVEASLKKSLDFKNDSEGKGDSWGKKNYKEWSESLTADQRKDLNDYGARGYSEINKYLREEGTGNIELEKKINNISEALQKNPIPENITVYRYCGMKEFGYEISDPLPSVKDFEKQFLNTIKEEKGYMSTSLSSDATSFGARKIILRLQVPKGSSGAYVAGLDGFKPAEKEVLLDKGSKYLINKVTEVVVKGTKKLVVDATLQTK

SEQ ID NO: 28132 - protein, 893 aa, Bacillus cereus VD022
MGNKKEIAIVALTTGFVLTSVTPYGLGHAEETGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGDSAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVQSVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGNKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSIFRNMKNPTAINFSDGLPYPDDYSKYNDLNGEDYGGVHFNSSIINKVAYLIAQGGTHNGVNVNGIGEDKMFDIFYYANTDELNMTSNFSELKLACLKVATNKYGTNSIEVQAVQNAFDAAKIIEKVKENEKTAENQAPELTVPFTITLRVGDTFDPMRNVKAVDKEDGDLTNKVKHKGDVNTSKPGTYIVEYLVVDSKGGNATAIQTVIVEGNGEISDLEPKLTVPVGAILHVGDSSVPMAEVLAIDKEDGDLTSKIKVDGEVDTSKAGTYVLTYTVTDSKGHEVTAKQTVTVKVREEIKNEKPILKVPATTSITEGDQFDPLIGVSATDKEDGDLTSKVAYKGTIDTTKAGIYEIIYSVRDSVGNEVNTIQKVLVKDKETSKPNGLANKTNSNSISNNSNTDKKEYTYKELPKTGVSTTNSAAIGILMIITGTVLTLIRKFRKIQK

SEQ ID NO: 28133 - protein, 165 aa, Bacillus cereus VD022
EEPKEPKEPEVKPEDPKEPKEPEVKPEDPKEPKEPEVKPEDPKEPKEPKEPKEPEVKPEDPKEPKEPEVKPKEPKEPKEPEVKPEDPKEPKDPEVKPEDPKEPKDPEVKPEKPEVKLEKLIKEPQVKVEKELPKTGAAHSWIMSVGAGISFLVGGVLFVLGRRRK

SEQ ID NO: 28134 - protein, 370 aa, Bacillus cereus VD022
MKTKQTIAASTLALAMIAGANPAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNALEELKKIKGNLDSLSANLELAKQDVKNKLAALQEARQDLINKINEIKQSKQTVSDDLSKKKQDLDIKINDFKHTEKKIDDKLAEIHTTKQNVDNKINEVSQSKQTQADNGTKNNNAKELPNAGSEQSNNMALGMLSVLGGVLLLTRNKIKTLFSK

SEQ ID NO: 28135 - protein, 1093 aa, Bacillus cereus VD022
MGKRVIIRVFTLLSVLALFLNVFLPRASAEVMTHEKYSMNWSYSNSLGKHIRTEMIKNSSGQIAYCLTLGLKSPNGEDLPEMGKTDNVVYRVLLNGFPQKSVQQLGVANQNEAHYATQLAVWNALGQLDVNELKHENKNVEKAAKAIINAANNSGDTQDIYMNVIPVEKQKAELKGEFFETNLYTVQTNAKGGSYKVVAKNAPNGVKIVSENGEVKDQLSVGEKFRIQIPKNTKTGEFNLSVAANLTKVQAITYRGTDTVQNATVLLERNEEKLSSDLAVNWEAAGSLKIKKVGENGEVLADAVFEVFNANNESVGKSTTGADGIAELNNLPIGTYTLKEIKAPTGYVSDDKPQTIEVKTGETGAVQIVNNKVKGNIEIKKLSDSGKVLPNVEFTVFTEDGKEVKKVVTKENGIANVEGLTYGKYYFLETQTPNGYIGNKTKYPFEIKEHNKTLTFTVENTEVKGSVKLLKVDNEDVSKKLEGAEFELKVASGKVIGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTVKGKLMNKETNKPLVVNGKEVTAETKFTPTEANGFITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTAETKFTAKEKNGFVTLDFTFVGAEQQGREVVVFEDLLHEGQVIATHADINDVGQTVRFVEPSIKTTATNKADGSKELDASKSVTIQDKVEYKDLIVGKEYVVKGKLMDKATNKPLLVDGKEVTVESKFTAKEKNGSIILDFTCNASALQGKEVVVFEELYQDNILIAIHAEIEDKGQTVKFKEVKPEQPKPEQPNSDENTPTPEQPNEQVKEQPQPKKEIQSKIGWLPQTGTNLTSWISMAAGALLLIVGGVIFLKRKNA

SEQ ID NO: 28136 - protein, 563 aa, Bacillus cereus VD022
MIEVVKGIREMKKIFSVLLVLFLTFSTWSSVLVKADSPSKGTLTIHKYEQEKDGAQGLEGDGSANQEVPKDAKPLKGVTFEVKKVASFEKISNDGKIVKEDVKPVMGATPTQVVTDDNGQAVLKDIPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPIIDKKINGKLEALPINPLTNYNYDIKTLIPEDIKEYKKYVVTDTLDNRLVIQGKPIVKIDGAEVNASIVEVAIEGQKVTATVKDFTKLDGKKEFHLQIKSQVKEGVPSGSEILNTAKIDFTNKNDVIGEKESKPVVVVPTTGIIELTKIDGANKNKLKGAEFVLKDKNGKIVVVAGKEVTGVSDENGVIKWSNIPYGDYQIFETKAPTYTKEDGTKASYQLLKDPIDVKISENNQTVKLTIENNKSGWVLPVTGGIGTTLFTVIGLTLMVTAAFVFFRKKSANN

SEQ ID NO: 28137 - protein, 503 aa, Bacillus cereus VD022
MFNKKMVAMAMTVPLVMGTISTVSALEKQQQVKLEAYSPQKKATEYLKENAAQYGLKADLSDLQYISTTETSVASYVRFQQVVNGAPVFSKQITVTLNGEGKGVLAVSDYQPVTGVKEVTTKISEKDAIQKSMAYVGEASEQNLWAPTEKEFGYIVEEGMARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIGHEYGHSIQDNQVPGFGSSAEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNSKFSDGAKAIKQADALLYGGQYAADIDRIWAARGISTN

SEQ ID NO: 28138 - protein, 455 aa, Bacillus cereus VD022
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQKKKVTANSVELTWNSSTDNVGVKGYQIFRNGEMIDTILGTHFIDKKLQPSTEYSYTVKAIDAAGNVSKESTALTVKTTVATPDTEAPTQPKGLHSMGTTASSVDLMWSPSDDNIGVDHYDIYREIEGLMKKIATSNTTSYMDKNLLANTTYKYVVKAVDVAGNESVQSDIFTITTKAESASYEAWDAKKAYKKGDRVLHEGKVYEAVQSYQGNGDPNWIYALSLWKTV

SEQ ID NO: 28139 - protein, 336 aa, Bacillus cereus VD045; identical to SEQ ID NO: 27010

SEQ ID NO: 28140 - protein, 179 aa, Bacillus cereus VD045
MFKKIATVTLAGTLACSLSACDEKKEVAKTVSNNTKEEQSSAKKENTKNEDTREYNVEKTTQIRNQKLTVHKVQIAQVAEYDKLEKGNEFVIVHVTVENIGNQKVRINPLDFYLERGDGSIVDHTFSTSNKNVFKIKDVDPNGKITGAITFEAKKGDSNLELIYRPDVMSKEEVKVELK

SEQ ID NO: 28141 - protein, 553 aa, Bacillus cereus VD045
MKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGALFSLFKKDGTEVKKELVTDANGHIRVQGLVYGEYYFQETKAPKGYVIDPTKREFFVKNSGTINEDGTITSGTVVKLEVKNYEEPTIDKKINGKLEALPINPLTNYNYDIKTLIPEDIKEYKKYVVTDTLDNRLVIQGKPIVKIDGAEVNASIVEVAIEGQKVTATVKDFTKLDGKKEFHLQIKSQVKEGVPSGSEIFNTAKIHFSNKNDVIGEKESKPVVVIPTTGIIELTKIDGANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 28142 - protein, 878 aa, Bacillus cereus VD045
MVKYSKISKWILGVGLVTITCNGLQIQAETKEQNVKNVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKIIASYGKLIGNASADVETVLYAGEIFKQYNDNLATFIEDRTKGDAIYELMKGIDFDIQTDMYTTGKEPKDTMWFRNIDNFINEINRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQELWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDVTSDITNEAKLKDVKVTKNKSQFFNTFTLQGTYTGSVAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 28143 - protein, 370 aa, Bacillus cereus VD045
MKTKQTIAASTLALAMIAGANSTHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNNNAKELPNAGSEQSNNMALGMLSVLGGILLITRNKIKTLFSK

SEQ ID NO: 28144 - protein, 971 aa, Bacillus cereus VD045
MKSYSKKMLVGVSFASLMLGSFQEVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSVKEWTGYKTVTAYFVNYRVNASGQFEYDVVFHGIDTEEGAENKAPVAVINGPYSGNVNEAISFTSNGSKDEDGKIISYKWEFGDGAVSNEQNPTHVYTKEGAYTAKLTVTDDKGATNTATATVTVQKKEDNSVEKEPNNSFQTTNKLQLNQVLRASLGNGDTSDFFEINVENAKNLQINVTNENNIGMNWVLYSEADLNNYVTYAQQQGNKLVGSYYTYPGKYYLHVYQYGGGTGNYTVEVK

SEQ ID NO: 28145 - protein, 881 aa, Bacillus cereus VD045
MKKKLASVVTCTLLAPMFLNGNVNAVYADSKTNQISTTQKNQQKEMDRKGLLGYYFKGKDFSNLTMFAPTRDSTLIYDQQTANKLLDKKQQEYQSIRWIGLIQSKETGDFTFNLSEDEQAIIEINGKIISNKGKEKQVVHLEKGKLVPIKIEYQSDTKFNIDSKTFKELKLFKIDSQNQPQQVQQDELRNPEFNKKESQEFLAKPSKINLFTQKMKREIDEDTDTDGDSIPDLWEENGYTIQNRIAVKWDDSLASKGYTKFVSNPLESHTVGDPYTDYEKAARDLDLSNAKETFNPLVAAFPSVNVSMEKVILSPNENLSNSVESHSSTNWSYTNTEGASVEAGIGPKGISFGVSVNYQHSETVAQEWGTSTGNTSQFNTASAGYLNANVRYNNVGTGAIYDVKPTTSFVLNNDTIATITAKSNSTALNISPGESYPKKGQNGIAITSMDDFNSHPITLNKKQVDNLLNNKPMMLETNQTDGVYKIKDTHGNIVTGGEWNGVIQQIKAKTASIIVDDGERVAEKRVAAKDYENPEDKTPSLTLKDALKLSYPDEIKEIEGLLYYKNKPIYESSVMTYLDENTAKEVTKQLNDTTGKFKDVSHLYDVKLTPKMNVTIKLSILYDNAESNDNSIGKWTNTNIVSGGNNGKKQYSSNNPDANLTLNTDAQEKLNKNRDYYISLYMKSEKNTQCEITIDGEIYPITTKTVNVNKDNYKRLDIIAHNIKSNPISSIHIKTNDEITLFWDDISITDVASIKPENLTDSEIKQIYSRYGIKLEDGILIDKKGGIHYGEFINEASFNIEPLQNYVTKYKVTYSSELGQNVSDTLESDKIYKDGTIKFDFTKYSKNEQGLFYDSGLNWDFKINAITYDGKEMNVFHRYNK

SEQ ID NO: 28146 - protein, 457 aa, Bacillus cereus VD045
MNKKFFKQLKKIATNKKGLSAAAVAVGIMGTTLIPQNAYAHGFVEKPGSRAALCSQNYGALNSNCGNIMYEPQSLEAPKGFPQGGPVDGKIASAGGLFGGILDQQTADRWFKNTIKGGENTFTWKYTAPHSTSQWHYYITKKGWNPNKPLTRVDFEPIGTVKHDGSAASNNLSHKINVPTDRSGYHVILAVWDVADTVNAFYNVIDVNLINNEKPDTEAPTQPSGVQVVKATSNSVELSWKPAIDNVGVKEYQVLRNGQLINTVVGTSVVDKKLSSNTEYTYTVKAVDAAGNISRESEALVVKTTVEKPDTEAPTQPKGLHSMGTTTNSIDLMWSPSEDNIDVNHYIVYREDGGVMKEIGTANTTSFTDKDLRANTIYKYVVSAVDTAGNESMKSDALTIATKGQENTYEQWDAYKAYKKGDKVVHEGKVYEAVQSYQGNGDPNWIFALSLWNEVNK

SEQ ID NO: 28147 - protein, 453 aa, Bacillus cereus VD045
MVSKKLQVVTKTVLLSTVFSISLLNNEVIKAEQLNINSQSKYTNLQNLKITDKVEDFKEDKEKAKEWGKEKEKEWKLTATEKGKMNNFLDNKNDIKTNYKEITFSMAGSFEDEIKDLKEIDKMFDKTNLSNSIITYKNVEPTTIGFNKSLTEGNTINSDAMAQFKEQFLDRDIKFDSYLDTHLTAQQVSSKERVILKVTVPSGKGSTTPTKAGVILNNSEYKMLIDNGYMVHVDKVSKVVKKGVECLQIEGTLKKSLDFKNDINAEAHSWGMKNYEEWAKDLTDSQREALDGYARQDYKEINNYLRNQGGSGNEKLDAQIKNISDALGKKPIPENITVYRWCGMPEFGYQISDPLPSLKDFEEQFLNTIKEDKGYMSTSLSSERLAAFGSRKIILRLQVPKGSTGAYLSAIGGFASEKEILLDKDSKYHIDKVTEVIIKGVKRYVVDATLLTN

SEQ ID NO: 28148 - protein, 333 aa, Bacillus cereus VD045; identical to SEQ ID NO: 27898

SEQ ID NO: 28149 - protein, 163 aa, Bacillus cereus VD045; identical to SEQ ID NO: 26509

SEQ ID NO: 28150 - protein, 965 aa, Bacillus cereus VD045
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDMQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDTYTVPEVADDYLAEHETTSLAAVKKEISDTLPMKDTKMTKHNSQFFNTFTLEGTYTGSVTKGESEDWKEMSKRVNESLEQLAQKEWSGYKTVTAYFVNYRVNSSNEFEYDVVFHGIAKDDGENKAPTVNINGPYSGLVKEGIQFKSDGSNDEDGKIASYLWEFGDGSTSAEVNPVHVYEREGSYKVSLRVKDDKGKESRSETTVTIKDGSLTESEPNNRPEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYSLSVK

SEQ ID NO: 28151 - protein, 357 aa, Bacillus cereus VD045
MILRKIFMICFLFIFTLTIATGCSSSQSSTTVKNGKASSSSKNVEIEVENAEYVLPLSGSMGGINKDKVLKFKVSLKNKGNEMLEISPYLFTLYQGDEKMKKYDKADSDKLRLIELEPGKKTSGILYYEVNKSSSYELVYSNEETKKRDEKTEKVSFKIDTQEIEKNTKDLNKPAEALKTYINAVYYDKDIDKINELSGEDGKQFTQNIQEEFKKDAMSSTHNGISDQEFESYYKKLKSVLQEKVTFKVKSVGSSPEEDKVEVELKVKPLLLSELQPKLNTENEKFLKENPGIEQSKLFSQSFSYFISILPEAKVSDKEKVIKVEMERYGKEQWRFSKGKISDSEDVMEIMGEFLKQ

SEQ ID NO: 28152 - protein, 522 aa, Bacillus cereus VD045
MKKKTNTLHTSKDNARNSGKRKKWTKVAPLVMCGIAGSMFFETTSASAHGYIENSRAHMGKTSELGTLSYNDVFEKYGAIIYEPQSLEAQKGFPFAGPADGQIASAGHSNFAKLDIQDPLRWKKVDIQSGLNTFVWKYTAEHPVAKWSYYITKQGWDQNKPLNRNELEEIKTIDGGNKYPRDIPNNGGYVHEIDIPADRNGYHVILGVWDVGDTANAFYQVMDVNIKAGGEVDTEAPTIPTKLEATADTTKIKLKWEASTDNVGVSHYNVYRNGEKLAPVTETEFEDVNLTPETEYTYEVSAVDKSGNESAKTMPLRIKTEKTPDLDTEAPTAPTSLHSMGETETTVDLMWTASTDNVGVDHYEVYRDNKRVHTNVSGTRFMDTGLQQNTEYMYTVKAVDAAGNVSKTSNTLIVKTKQGSPEETLPGETSPEGATTWDKNKVYNAGDRITFNGNEYEAKWWTLGNQPDISDEWKLLSDAVLEWNASKAYNGGERVQYQGVAYKAKWWTLGEIPGESQVWEKQ

SEQ ID NO: 28153 - protein, 1016 aa, Bacillus cereus VD045
MKKNIRKPVIAVVAACSMMTTPGLEVLAEEENRLKVSSNIQQEKKSIKSDGQGRIIIGEDDRIQILDTMQQPYQSIVYVRTSNGTYGTGFVVDKDTVITNAHVAQGNHNNPSGLEIYPARNGNNDPLGSFKVDAVHIPDQYNSAAAGTLAMWEYDLAVLKISPRDGVSIGDVSEPLELKNVDTISNLVGKSIHSVGYPGDKPRGTMWSANGNILNEAGPNGYLIRHNFDTAGGQSGSPVFDEENRVIAIHSSGNATLNVNTAVKLNTTHINYINSFIDKGSEENKESLENRIFEVQGKGNVQTLKQKDRRLFSFSPYEPTGLYAKPNEEIIIQVKGNQSINAYIGTYSYNRDSEENELVKSFTLKPGANKISSSGGGMIYFYNEQENGTIQATVEKGGSPVPYFELGKSSKQDLINMLDKYPDAHAVELKGERVLITASPTRVKKYLLDSNTDPAQLLKKMDEATRIQDKISDLSEEQVDKHYIHYVEDNQKSAYMYATEFRTGYVGDAIQNVLDINKFTKDGWGPWHEAGHMRQQQPWNFHNMTEVQVNLYSLAVQTAFGNTSRLETQNDYAKAFQYLDKDANTKDYDQIDDVFVKLVMLWQLQLAYGDDFYPTLHQQYRDMPDSELPTVDEEKKQVFMVEASKAAKQNLLPFFEQWGLKPNQDTINKINQLGYPLLVDPIWKGTDSKPIKPNNESILKGSEFSWSMQGIGDREFATINLNKSEKAIKVDLKEGIPHHYFDETYASIKVKKESGQVVYDKEIYGNAHQNAETKNVPVEVGNYIELTHLEGDIRATLINVTNNKQEKFGNTVIYQVTKEGLKKVEASPAFDTEAPTAPTELRSMGETETTVDLMWKAATDNVGVDHYEVYRNGERVHTNISDVRVMDTGLQANTEYTYEVKAIDAAGNVSKASKALKVKTKQESMEATTTWDKNKVYNAGDRIMFNGYEYEAKWWTQGNQPDSSDAWKLLGDAVVEWNKQKPYQGGEQVQYQGTTYKAKWWTQGEIPGESQVWEKQ

SEQ ID NO: 28154 - protein, 55 aa, Bacillus cereus VD045; identical to SEQ ID NO: 26651

SEQ ID NO: 28155 - protein, 960 aa, Bacillus cereus VD045
MNKNLKFTQMMIGISTMALSFGSIQTQVSAEETASYNILQMKPMGTETSKDEIVHATKADETLTFEERLKVGDFSQRPTPVMKRDESQLKKSYTLAELNKMPDSELIDTLSKISWNQITDLFQFNQDTKAFYQNKERMNVIIDELGQRGRAFTKEDSKGIETFVEVLRSAFYVGYYNNELTYLKERSFHDKCLPALKAIAKNPSFTLGTAEQDRVVAAYGKLIGNASSDTETVQYVVNVLKQYNDNLSTYVTDYAKGQAVYEIVKGIDYDIQSYLQDTNKKLNETMWYGKIDNFINEVSRIALVGNITNENSWLINNGIYYAGRLGKFHSNPNKGLEVITQAMNLYPRLSGAYFVAVEQMKTNYGGKDYSGNAVDLQKIREEGKQQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFETFDKLQDLIRANDVKNYDSYRESLSNNTQLNAEYQAYMQQLIDNQDKYNVPQVTNDYLIQHAPKPLAEVKNEIVNVANIKDAKITKYESQFFNTFTVEGKYTGGTSKGESEDWKTMSKQVNRTLEQLSQKGWSGYKTVTAYFVNYRVNAANQFEYDIVFHGVATEEKEKTNTILNMNGPYSGIVNEEIQFHSDGTKSENGKVISYLWNFGDGTTSTEANPTHVYGEKGTYTVELTVKDSRGKESKEQTKVTVKQDPPTGESHEEEKVLPFNTLVKGNLITPDQTDVYTFNVTDPKEVDISVVNEQNIGMTWVLYHESDMQNYVACGEDEGNVIKGKFTAKPGKYYLNVYKFDDKNGEYSLLVK

SEQ ID NO: 28156 - protein, 172 aa, Bacillus cereus VD045; identical to SEQ ID NO: 28096

SEQ ID NO: 28157 - protein, 181 aa, Bacillus cereus VD045; identical to SEQ ID NO: 26799

SEQ ID NO: 28158 - protein, 431 aa, Bacillus cereus VD045; identical to SEQ ID NO: 27327

SEQ ID NO: 28159 - protein, 87 aa, Bacillus cereus VD045
PEVKPEDPKEPKEPKEPEVKPEDPKEPKEPEVKPEVKLEKLIKEPQVKTERELPKTGAASPWMMSVGAGISFLVGGVLFVLGRRRKQ

SEQ ID NO: 28160 - protein, 503 aa, Bacillus cereus VD045
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKAEGSGKVFLPNPVVSSGSKVGLKDNNDADSTALTNQLKTVTLKGLDGTGFLIGEYVTISSKAKTKSTNLQFNYTRANDSFEDVMSYYHIDTLQRYIQSLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACVGEWDATAYSSSDPTCLRRLDNNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 28161 - protein, 572 aa, Bacillus cereus VD045
MKKIIFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSIISGLSSDPASRYTAKQTLFAKYGSWDFYKYSFVLQSYLYNHQFDTFDKLQDLIRANDVKNYDAYRELLSKNTQLNAEYQAYMQQLTDNQGKYNVPQVTNDYLIQHAPKPLAEVKNEIVDVANIKDAKITKHESQFFNTFSVEGTYVGGISKGESEDWKTMSKQVNQTLEQLSQKGWSGYKTVTAYFVNYRVNAANQFEYDIVFHGVATEEKEKTTTIVNMNGPYSGIVNEEIQFHSNGTTSENGKVISYLWNFGDGITSTKANPTHIYGEKGTYTVELTVKDSRGKESIEQTKVTVKQDPQTGGSLEEEKILPFNTLVKGNLVTPDQTDVYTFNVTDPKEVEISVVNEQNIGMTWVLYHESDMQNYVACGEDEGNTIKGKFVAKPGKYYLNVHKFDDKNGEYSLLVK

SEQ ID NO: 28162 - protein, 455 aa, Bacillus cereus VD045
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVLGTHFIDKKLQPSTEYSYTVKAIDAAGNVSKESAALTVKTTVETPDTEAPTQPKGLHSMGTTASSVDLMWSPSDDNIGVDHYDIYRETEGAMKKIATSNTTSYLDKNLLANTTYKYVVKAVDVAGNESVQSDIFTITTKTENASYEAWDAKKAYKKGDRVLHEGKVYEAVQSYQGNGDPNWIYALSLWKTV

SEQ ID NO: 28163 - protein, 893 aa, Bacillus cereus VD045; identical to SEQ ID NO: 27905

SEQ ID NO: 28164 - protein, 1093 aa, Bacillus cereus VD045
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNVNNESVGKITTGADGMAELNNLPIGTYTLKEIKAPTGYVSDDKPQTIEVKTGETGAVQIVNNKVKGSIEIKKLSDSGKILPNVEFTVFTEDGKEVKKVVTKENGIANVEGLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIETKATDKTDGTKEMHTSKSVTIQDKVEFKDLQVGKEYTLKGKLMDKKTNKPFVVNGKEVTAETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAINKPLLIDGKEVTADTKFTAKEKNGFVTLDFTFVGAEQQGREVVVFEDLLHEGQVIATHADINDVGQTVRFVEPSIKTTATNKADGSKELDASKTVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEQPNSGKNTPTPEQPNEQVKEQPQLKKEIQSKIGWLPQTGTNLTSWISMAAGALLLIVGGVIFLKRKNA

SEQ ID NO: 28165 - protein, 412 aa, Bacillus cereus VD045; identical to SEQ ID NO: 26477

SEQ ID NO: 28166 - protein, 775 aa, Bacillus cereus VD045
MKKSKKMLAGATLAIGVIAPQVMPTTAHADENAGESTVNLRILETSDIHVNLMNYDYYQTKTDNKVGLVQTATLVNKAREEAKNSVLFDDGDALQGTPLGDYVANKIKDPKNPVDPSYTHPLYRVMNLMKYDVISLGNHEFNYGLDYLNKVIEKTDFPVINSNVYKDDHDDKEENDENYFKPYHILKKEVVDEAGQKQIVKIGVMGFVPPQIMNWDKANLEGKVKAKDIVATAKIMVKKMQDEGADIIVALAHSGVDKSEYKEANKMENASYHLATQVPGVDAVLMGHSHTEVQDVFNGVPVVMPGVFGSNLGIIDMQLKKVNGKWEVQKDQSKPQLRPIANSKGTPLVESDQKLVNEIKDEHEKTIEYVNTHVGETKAPINSYFSLVQDDPSVQIVTNAQKWYVEQELKKPEYEEIKDIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIVNMTYEGKPVADKQEFIVATNNYRGSSQTFPGVSKGEVVYQSQDETRQIIVKYMQKIKDIDPAADQNWTFKPIVADKLNTTFDSSPNAQKYIKKDGKISYVGPSENEFAKYAIDITKKNDDKETGEGNPTTPPTGGGENPTTPPKGDGENPTTPPTEEGNNGNEPKQDGNNTGSGQTTTDDQNTKETTTVSENKEAEKDERDLPKTGASIASTIGAGLAFVGAGLLLLFRRKKANR

SEQ ID NO: 28167 - protein, 794 aa, Bacillus cereus VD048
MENEKNYGTGTTQHSDQLSATMTEDKHQIRKQHGLMGYFYGDKDFKNLLLIRGNSLVNEDIHSHSIKTARFKASQQIQSVRWQGFIQPKEDGDYFFSAGKHEQVMIQVDQTIVVDTLGREHEVKLQKGCLYKVIVEYQVNSDVKDAFTLLWGTEEKKMVVPHEVLYAPSLAQKDIPTVTGSLHKLKSVVADFIREETDTDGDNIPDSWEYEGYTVVDGDFGVKDLVKWDDDVHAPPLIKYKTSPSKWSTSDDPYSDYEKVTGIQMDTRVIKEAHHPLVAAYPDVHISMEKYLVIPNTNFQSGEGGSSSKQVTRGTSNTVSNTESWGVTVEASASLLDFGGSVSTSYESSTTTSVTNEYSESDSTTRDWNEVLGINNAEAGKILPNVRYVNTGTAPVFNVKPQFTLHFPKTPNGDAISLISSLVGETHRGLEVLPGSTYPTQSKPPLAFDKPTHFGESLLLDQENVSRLQEGDQLKLDTLGFDAKVVLIDSQGQDYTSSQDWTSVISKIKTNTTEITFTMIGGPAVRRNIAAPGTTPVEQSVPEMTFKEALVIGFGAEQRNNKIYINDREISSDKVDLIVDVATENEMKRQGVSSVFDVKLRAGMHIEMIEKVRTRIFPDKNGEAYFEFLIPSGVPKTANYELYMNGSKKGSIEYATGSNRWNGHAANYGITNNEAINEKNIFELKVEGFTIATFHGLNFYHRVLLWGKYMDGDTLRVSSIIFFQYPSKKVRYQLRINDNTWAPILPDSAITDSNGVRTVIFKPSSGNVADSNKIEVFAVDEFDDDIKVRIAQNR

SEQ ID NO: 28168 - protein, 55 aa, Bacillus cereus VD048
METEKYLQIVEDEEIEQLVGGAGPGWVETLTKDCPWNVPVACVTIMGQRICKKCY

SEQ ID NO: 28169 - protein, 746 aa, Bacillus cereus VD048
MGNNSKNKTRKMLAATATVTMLATGMISSSDVFAEERQQQKKLSTSLQEEKSVKSENRTYTVPGKGDVEVLKQQERKSMAFSPYEPTGLYAKPNEQITINVEGNQDIQAYIGTYSYDASWREDSKIKSFTLKPGINTIQSPNGGMIYFYNKQQGGTIRTTVTTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYAYPYRTAYVGDAIQYVLDINKFVKDGWGPWHEAGHLRQQWPWNFYNMTEVQNNIYSLSVEKAFNQPSNLEKSGIYPKAFQYLEQTNKNYDEISDVFVKLVMLWQLQLAYGEDFYPNLHQLYRDMPSNELPQTDENKKQLFMISASKVAKQNLIPFFEKWGLRPNNDTIQKVTALGYPILTAEIWKGTDSNPIKPDMPNGNNILEGKQFAWSLKGISDFEFAKINFNKSTEEMQIDLKAGIPHHYFNETYASIKVQSASGKVVYNKDIYGNEQQNAESQKVPVKVGDFIELTHLEGVHRATFMNVDNSKQESFGKKAIYEVTKDGLKKVNQIVNPKPDTEAPTQPQELYASNLTSNSVELKWNPSTDNVGVKEYQVLRDGQLIQTVQGTTFTDQNLTANKEYKYAVKAVDAAGNTSIQSNILPVKTKDQNVSYEKWDPKKAYTKGDKVEHQGKVYEAVQNHQGNGDQNWIFALSLWKPITIK

SEQ ID NO: 28170 - protein, 182 aa, Bacillus cereus VD048
MNKKLLTSLLCSTFLFGLSACSSHDTSSSNTKNEQETSKETKNDELSNKDPQKELPTHGDSSDVYISIHSADSLDVIGNGEVKAQGVFKVLDVAVYNRQEEPITLNNNNFKLIDGTGREYHISNESQLVLKAANTATFKFGVLNPNENSEGNIVFDVPKNTQGLTLKINGDMLDEGIELKVE

SEQ ID NO: 28171 - protein, 374 aa, Bacillus cereus VD048
MKTKQTIAASTLALAMIAGANSAHAEVTDATPQQSTGDRLAEIKQHKQELDAKLQQHKENVDQTLNELNQVKENVDTKVNELHERKQVADEKIGEIKQHKQELDAKLQQDKQIAEDKIAEIKEHKKQVDEKVAEIKEHKQTVDEKVNEIKEHKQTVDEKVNEIKQHKENIDAKVNELKEVKKQVDDKLAELKKAKQTAEDKLAEIKENKPNTGNTLEELKKIKGNLDSLSSNLELAKQDVKNKLAELQEARQDLLNKINEMKQAKQTVSDDLTKKKQDLDIKINDFKHTEKKIDDKLAELHTTKQNVDNKINEVSQSKQTQTDNNNTTVPANNNARELPNAGSEQSNNMTLGMLSVLGGILLVTRNKIKTFFSK

SEQ ID NO: 28172 - protein, 164 aa, Bacillus cereus VD048; identical to SEQ ID NO: 26788

SEQ ID NO: 28173 - protein, 333 aa, Bacillus cereus VD048; identical to SEQ ID NO: 26775

SEQ ID NO: 28174 - protein, 553 aa, Bacillus cereus VD048
MKKIFSLFLIGMLAFSTLSNMIVSAESRSTGTLTIHKFEQSKDAKTTSEGNGKEGQIVPEDAKPLEGVTFEIKRIESFEKISNDGTVIKEEENPVKDAAITKITDAKGEAVFKDLPLGRYEVKAIEGPKHIALDKTTFIVDIPMTSADGKDLNYDVHIYPKNETKRGSVELMKKGEGDKVLPDAEFHLFEKNKDGTSTQVKTPKPLVTGTDGKIRVESLEYGDYYFIEEKAPKGYLTSKEEYPFAIKETGKLVKLEKDVKNYKEPTIEKTINDSSKNAGINRETEYTYDIKTLLPEDIQTYKNYVVTDVLDDRLEVVGTPIVMIDGKKVDESIVNVIVAGQKVIASVEDFSKVTGKELHLQITAKMKSDVQSGVEIPNKAVLDFVNKDDISSEKDGKPSNEVLVTPTMGNITIEKIDGKNKNLKLEGARFELRDKKGNVVTVNKKKMDDITDANGIITWNEIPYGEYQIVETVAPKYKDEDGSVEQYQKLRDPIEIKIDEKHQKIELQVENNKSGWIIPQTGGIGTVLFTVVGLLLMVTAAFIFFRKKPVKNS

SEQ ID NO: 28175 - protein, 965 aa, Bacillus cereus VD048
MNKQSKINKVLLSISTMALSLGAIQTNVSAEEKVPYNVLHSKPVGIEKPVDEIGHASKAEETLSFQERLKVGDFSQRPASITKKSAVKQAKESYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNEVTPENKWLVNNGIYFASRLGKFHSNPNKGLEVVTQAMHMYPRLSESYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHTSQFFNTFTLEGTFTGSVTKGESEDWKAMSKRVNEALEQLTQKEWSGYKTVTAYFVNYRVNSSNKFEYDVVFHGIAKDDGENKAPTVNVNGPYNGFVKEGIQFKSDGSKDEDGKIVSYLWDFGDGRTSKEVNPVHAYEREGTYKVALVVKDDKGKESRSETTVTIKDGSVTESEPNNRPEEANRIGLNTTIKGSLIGGDHTDVYTFNVASAKDIDISVLNEYGIGMTWVLHHESDMQNYAAYGQANGNHIEAKFNAKPGKYYLYVYKYDNGDGAYALSVK

SEQ ID NO: 28176 - protein, 458 aa, Bacillus cereus VD048; identical to SEQ ID NO: 26793

SEQ ID NO: 28177 - protein, 254 aa, Bacillus cereus VD048
MLKRSLGLLSTAVVTASMLFGVSGHSAYADSLSEEKDMYQVAAKESTECKKQGQYKVCETPEQAKKWGEKQYNKWKLNKNEQTVLNSYTKYAGKFNTPLRDNKGDITKIKNPNDKNNILALDSVLNRGEIPEDVILFRGDDPIAFMDDPNKLIKNGKIDKEEFNKLKEKYKGKSKTEYGYISTSLLSNTPIVSTKVFQIEFKTLAGTHGGYIEKHSSYPGQYEFLLPRNTTYIISKMELSNDEKHIKIEALVKR

SEQ ID NO: 28178 - protein, 234 aa, Bacillus cereus VD048
METLAVLIFLAAIVLFVLFIIAIFKKKPKAKLIISSIVCLVLAMILIPSKDKEEKSKVKETTQQASTEVKEEPKKEEVKKEEPKKEQPKKKEEPKKEEPKKELSKEGDSSKVKIAVGSVESIDSVGGEYLKENAQGVFKVVEISITNNQKDAITVDANSFKLMDNQDREFTYSTQAQTAYDIGNGGKSDFFLKQLNPGLTQTGKIIFDVPADAQGLVLKARGGMMGKEIKLKVE

SEQ ID NO: 28179 - protein, 100 aa, Bacillus cereus VD048
EVSNKQEVQDKVEVSNKQEVQDKVEVSNKQEVQDKVEVQSKQDVQNKSEVPSSKENNKQSKLLPQTGGASTESTSIIAGMFALILGALLFRRKKINERES

SEQ ID NO: 28180 - protein, 1108 aa, Bacillus cereus VD048
MHNKIKENKKILNVFVVVMSLFLLLSQLQFFKPMDRVRAEVTDEEGFDTPTYQSIHKGDMYSTGNVNLGIKATEAQKQTALYSDITYTYGTTPNSYTRELIDVDDDPTTTNSSKAYIPVPEDAEIEWAGLYWSSTRYELTQQQYVAPVKFTTPAGKSFQVSPSNTYYGSGLLYGFGIDGTYYSNYTDVTGLLKSSSAKGGSYTVANIPYPNTKLAYNSGYYSFAGWYMLVITKDKSKTRKAFTVYDGGLKRATGSGEKEFTMKNFIASKTGDLDPKVSVFAVQGDRYWQGDKLFVHTDNTWKEVTDKLNPTGNIFNSTISEYEEHMRDKYPGTFNPDYKNNLGVDADLIKLPAGYIKPNQKEIRLKAATSGDDYVLNTLAFAVNATAPELVIDKEVIDTKEKYDPGDEVTYRLRVKNIEPNSSSVDTKIEDVLDSRLEFVPDSVKIISGPNAGDQTEQVDYNAKTRKLTIRIGEGANATKGGIYTDKTPETTVEFKAKLRGEKVETEIPNIAVVQGIDELTGSQVEANDSNKVVVKVLPEREEKHGKLIATKLAKDINGGTLKVGDKLEYTIHTKNSVPDSLLKSVKITDKLPEGVEYVPNTLKINGKEQTDVEDEDHAHIKNGTIYAHFGDLKGEEEKAITFEIVVKPEMANKKVKNIAIVETDSSADKEKPEVETPVDPLSGQLESKKEIIDMRQEKVHVNDEFEYQIKVRNKVENGLIKDMRLMDKLPEGVEYVAGSMKVNGNLLTDAVDEDAGAYEDNTIKVNFGDVLDTEERMVTFKVKVTQDALKTKEIENIAVVEGKTPDNEDLPPQKPNVKTHVEAKEPKVSKMVSDADEIEVEKATLQSVGEEFTWHVNYNFGNDVMNLEKVVLQDDLEDILTILQVQLVNSDGEAIEVIPQIDEQLKNVSIELPKRDGNYNYLANQSYTMHIKSMLNANVNADIVTKYNANGGIPNKAELLFDQKKSVSNEVFVVPPTLGGFEIEKVDANDENLKLEGAVFEVISKGGNIVCKLTTDKDGLATSTPLIVGKYTLKEVQAPKGYMLMREPVEIEMKPGMNSQKIRVVNKKSEFVIPETGGTGTIIYYVMGGILMFVTLFLFVRKRNSER

SEQ ID NO: 28181 - protein, 431 aa, Bacillus cereus VD048; identical to SEQ ID NO: 26715

SEQ ID NO: 28182 - protein, 209 aa, Bacillus cereus VD048; identical to SEQ ID NO: 26776

SEQ ID NO: 28183 - protein, 455 aa, Bacillus cereus VD048
MNNRILKHLLNMKMNKKSLGAVALTAGIIGTTLIPQNAYAHGFVEKPGSRSALCSPTYGALNVNCGSIMYEPQSLEAPKGFPQVGPVDGQIASAGGKFGGILDQQTTERWFKNTITGGENTFTWKYTAPHLTSKWHYYITKKGWNPNKALTRANFEPIGTVQHDGSAALNNLNHKINVPTDRSGYHVILAVWDVADTANAFYNVIDVNLVNNEKPDTEVPSNPNGLEATKVTANSVELAWTASTDNVGVKGYQVLRNGEIIDTVPGTHFIDKQLQPSTEYSYTVKAIDAAGNVSKESTAVKVKTSVAILDTKAPTQPKGLHSMGTTASSVDLMWSPSDDNDGVDHYDIYREISGVMKKIGTSNTTSHMDKNLLANTTYKYAVKVVDVAGNESIQSDVFTVTTKTESASYEAWNSKKAYKKGDRVVHEGKVYEAVQNYQGNGDPNWIYALSLWKTV

SEQ ID NO: 28184 - protein, 503 aa, Bacillus cereus VD048; identical to SEQ ID NO: 26780

SEQ ID NO: 28185 - protein, 455 aa, Bacillus cereus VD048; identical to SEQ ID NO: 26782

SEQ ID NO: 28186 - protein, 738 aa, Bacillus cereus VD048
MKQLKPAISVLGSVSMALTLASPALADVKQPNPGGTVEIFKENANVKKEDKNFTLGSDGEIGSLITQNIEMANNDWDKDGISNDLEINGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNTATEQLETDIGNIPKFRVYTPKDKSLADNPVLSYNEVFQQVNIDTKKVNHIVNKAKSTNNVSVVSANNGTDALNDLKAGQGDRGYLHKDSVHGAFAKLQQPTLVEGSYDSVTQKIRATILPGLFGVSKDIPTTYSKKWNAPSQTVTLVKRENGFTYESRENIHPIKSEIAAHRKVTFEINDAHNLTLTQKIDTEIKANKEFEDYVVDNSGEFVTEGVPYTVASYGNTAYLGSHHAGNKWEYLWAEKSSDEKVNVIIERVGQPKPGKPIKKDEEVLIKFQNPIYSDYAYLKLQDSYIHLDQKQNASTFKFNHAYPKNFTGHHKQWNILSNGNKLKVGYLIDYMKYGNGENGTDTIAWNLSRVQ

SEQ ID NO: 28187 - protein, 971 aa, Bacillus cereus VD048
MKGYSKKVLVGVSFASLMLGSFQGSILAEDTKGEQVSYRNVLKMEPVGVQLPVEELAHSSKVLESKSFEKRLQFADLSQRPPEVKKESKQLAVAKTYTIAELNQLSNQQLVDLLVTINWEQITGLFQFNKDSLAFYQNDSRMQAIIDKLKQQGQAYTKDDSKGIETLVEVLRSGFYLGFYNAELSKLNERSYHDKCLPALKSISQNQNFKLGTLEQNKVVSSYGKLIGNASSDAETISSAANIFKQYNDNLSTFIDNRSAGNAVYDIMQGVDYDIQSYLYDTNKAPKDTMWYQKIDSYINELSRFALMGTITAKNGWLINNGIYYTGRLGMFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSDIAAEITAEAKLSNVSVKKNKSQFFNTFTLQGTYTGTAAKGENEDWKTITQNVNDTLKRLSAKEWTGYKTVTAYFVNYRVNASGQFEYDVVFHGINTEEGAVNKAPVAVINGPYSGHTNEAISFKSDGSKDEDGKIISYKWELGDGTVSNEQNPTHVYTKEGTYTAKLTVTDDKGLTNTATTSVTVQKKEENSVEKEPNNSFQTANKLQLNQVLRASLGNGDTSDFFEINVETAKNLQINVTKENNIGVNWVLYSEADLNNYVTYAQQQGNKLVGSYYTYPGKYYLHVYQYGGGTGNYTVEVK

SEQ ID NO: 28188 - protein, 660 aa, Bacillus cereus VD078
MIRQKTKKRFNKVIIITAACSIFSMFGTSISHTKAVTRSAAPSVYVSPQNTASSDIISIDWSPVQTAPYTYWAVHNWNAGGEAGGYAGFQQQSGFDENGKRTLHFALWDPIASKEAIKAEYLSPNSQAGLFGGEGTGLKVQTTYGWKDYNWYRMTMRSWQENGHTKFGQWMKDVRKNKWHLIAIMDFPVANVAFNHGLGMFQEDWAGNGQDVREARLKNGYSRKLVDKQWSSWNNQSISGQHDTSHQYDGGATSEYVWVKAGGNTQSTIGTGKIFTLTQPTQPEIGKIDFDIQSIYYENEKLNVSWKLKENSTPQFKGKIEIYNDENMTGQPIEIIDNIKSYQSQVSQSILLSTNTYAKIILTDLFDQTVEKKVQIKNQSPNIFEGNEFAWSLKGIGDFEFAKVNLNKSTEEVQIDLRAGVPHNYFDSTYASIKVQNTSGKVIYNKEIYGNKQQNAEQAKIPVKVGDFIEFTHLEGANRATITNIEKNIQESFGDKVVYEITKEGLKKVDNIVNPKPDTEAPTQPQGLYASNVTSNSVELQWNASSDNVGVKEYQVLRDGQLIQTVQGTTFINQNLTVNKEYKYAVKAVDAAGNTSIQSNILLIKTKNQNESYEKWDSKKAYTKGDKVEHQGKVYEAVQNHQGNGDSNWIFALALWKPLT

SEQ ID NO: 28189 - protein, 80 aa, Bacillus cereus VD078; identical to SEQ ID NO: 27388

SEQ ID NO: 28190 - protein, 333 aa, Bacillus cereus VD078
MKGKLLKGVLSFGIGLGVLYGGSSAQAETSTNQNNTLKVMTHNVYMLSTNLYPNWGQSQRADLIGVADYIKNQDVVILNEVFDNSASNRLLGNLKKEYPNQTAVLGRSSGSEWDKTLGSYSSSTPEDGGVAIVSKWPIVEKIQYVFAKGCGPDNLSNKGFVYTKIKKDDRFVHVIGTHLQAEDSMCGKTSPASVRTNQLKEIQDFIKNQNIPNDEYVLFGGDMNVNRINAENNSDSEYASMFKTLHASIPSYTGHTATWDATTNSIAKYNFPDSPAEYLDYIITSKDHANPSYIENKVLQSKSPQWTVTSWLKEYTYNDYSDHYPVEATISMK

SEQ ID NO: 28191 - protein, 209 aa, Bacillus cereus VD078; identical to SEQ ID NO: 26769

SEQ ID NO: 28192 - protein, 223 aa, Bacillus cereus VD078
METLAVLIFLASIVLFVLFIIAIFKRKPKAKLFISSIVCLVLAMILIPTKDKEEKPKAKETTQQASTEVKEEPKKEKVKKEQPKKEEPKKELSKEGESSKVKIAVGSVESVDSVGGEYLNEKAQGVFKVVEISITNNQKDAITVDANSFKLMDNQDREFTYSTQAQTAYDIGNGGKSDFFLKQLNPGLTQTGKIIFDVPADAQGLVLKARGGMMGKEIKLKVE

SEQ ID NO: 28193 - protein, 738 aa, Bacillus cereus VD078
MKQLKPAISVLGSVSMALTLASPALADVKQPNPGGTVEIFKENANVKKEDKNFTLGSDGEIGSLITQNIEMANNDWDKDGISNDLEINGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGAEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAATEQLETDIGNIPKFRVYTPKDKSLADKPVLSYNEVFQQVNIDTKKVNHIVNKAKSTNNVSVVSANNGTDALNDLKAGQGDRGYLHKDSVHGAFAKLQQPTLVEGSYDSVTQKIRATILPGLFGVSKDIPTTYSKKWNAPSQTVTLVKRENGFTYESRENIHPIKSEIAAHRKVTFEINDAHNLTPTQKIDTEIKANKEFEDYVVDNSGEFVTEGVPYTVASYGNTAYLGSHHAGNKWEYLWAEKSSDEKVNVIIERVGQPKPGKPIKKDEEVLIKFQNPIYSDYAYLKLQDSYIHLDQKQNASTFKFNHAYPKNFTGHHKQWNILSNGNKLKVGYLIDYMKYGNGENGTDTIAWNLSRVQ

SEQ ID NO: 28194 - protein, 746 aa, Bacillus cereus VD078
MGNNSKNKTRKMLAATATVTMLATGMISSSDVFAEERQQQKKLSTSLQEEKSVKSENRTYTVPGKGDVEVLKQQERKSMAFSPYEPTGLYAKPNEQITINVEGNQDIQAYIGTYSYDASWREDSKIKSFTLKPGINTIQSPNGGMIYFYNKQQGGTIRTTVTTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYAYPYRTAYVGDAIQYVLDIDKFVKDGWGPWHEAGHLRQQWPWNFYNMTEVQNNIYSLSVEKAFNQPSNLEKSGIYPKAFQYLEQTNKNYDEISDVFVKLVMLWQLQLAYGEDFYPNLHQLYRDMPSNELSQTDENKKQLFMISASKVAKQNLIPFFEKWGLRPNNDTIQKVTALGYPILTAEIWKGTDSNPIKPDMPNGNNILEGKQFAWSLKGISDFEFAKINFNKSTEEMQIDLKAGIPHHYFNETYASIKVQSASGKVVYNKDIYGNEQQNAESQKVPVKVGDFIELTHLEGVHRATFMNVDNSKQESFGKKAIYEVTKDGLKKVNQIVNPKPDTEAPTQPQELYASNLTSNSVELKWNPSTDNVGVKEYQVLRDGQLIQTVQGTTFTDQNLTANKEYKYAVKAVDAAGNTSIQSNILPVKTKDQNVSYEKWDPKKAYTKGDKVEHQGKVYEAVQNHQGNGDQNWIFALSLWKPITIK

SEQ ID NO: 28195 - protein, 357 aa, Bacillus cereus VD078
MTSVDNKIAIYKISTNILPINFLVWTDYVSLMLQNPNVTDAEWKELNNSIISVFANEPRPMMDLLTQIKSYVPNTEDILEGNQFAWSLKGIGNFEFAKVNLNKSTQEMQINLKASVPHNYFDNIYASIKVQNTTGKVIYNKEVYGNKQQNAETQKVPVKIGDFIELTHLEGGERATLINLDNNKRESFDKKAMYEVTKDGLKKVNRIVNPKLDTEAPTQPQGLYASKVTSNSIELKWNPSSDNVGVKEYQVLRDGQLIQTVQGTTFIDQNLTVNVEYKYAVKAVDAAGNTSIQSNLIPVKTKNQNEFYEKWDPKKAYTKGDKVEHQGKVYEAVQNHQGNGDLNWIFALSLWKQLTIN

SEQ ID NO: 28196 - protein, 743 aa, Bacillus cereus VD078
MKRGQKQKTKNLVMITATLSMFATGITPSLEVFAEEQAQQQKVSVLKNEESVKVENRVFTVQGKGDVKALSHQDRRAASFSPFEPTGLYAKPNEEITIDVEGNNEITAYIGAFSYNRNPQGEELVKSFTLKPGTNTIRYEGGGMIYFYNKQENGTIRTTIQKGGTPVPYFELGKHTKQDLIDMLNQNPNSFAVELKGERVLITATPERVKKYLLGSNTDPAQLLKKMDEATRIQDRMSGLTEEQVDKHYIHYVEDKDNKSGFMYATEYRTAYVGDAIQYVLDINKFTTDGWGPWHEAGHLRQQVPWRFYNMGEVQNNIYSLAVEKAFGQPSRLEEEGVYPKVSKYLVQENKNYDEISDVFVKLAMLWQLHLAYGEEFYPKLHQLYRDMPSNEIPQTDETKKQLFMITASKAAKQNLIPFFEKWGLRPNNDTIQKVAALGYPNLTAEIWKSTDSNPVKPDTPNFSNILEGNQFAWSLKGIGDFEFAKVNLNKSTEEMQIDLKAGVPHHYFDSTYASIKVQNTSGKVVYNKEIYGNKQQNAEQAKVPVKVGDFIEFTHLEGANRATITNMEKNIQDSFGNNAVYEITKEGLKKVDKIINPKPDTEAPTQPQGLYASNVTSNSVELKWNSSTDNVGVKEYQVLRDGQLIQTVQGTTFTDQNLTANKEYKYAVKAVDAAGNTSIQSNILPIKTKDQNVSYEKWDPKKAYTKGDKVEHQGKVYEAVQNHQGNGDPNWILALALWKPLT

SEQ ID NO: 28197 - protein, 1007 aa, Bacillus cereus VD078
EVTTDKEGKAKISDLSVGKYKLVEKAGLPGYKKLTEPVSFEIKKGMTTVLSMKVENEQLDKGSVEITKVDKDSQKVLAGVVFEVQDEAGKVVTEVTTDKDGKAKIADLSAGKYKLVEKESLPGYKKLAEPVSFEITKGMTEVLSLKIENEMVDTGNVEITKIDKDNKVSLAGVVFEVQDETGKVVTKVTTDKEGKANVSDLSVGKYKLVEVESLPGYKKLEKPVPFEIKKGMTKSLAFTVENEMVDTGNVEITKIDKDSKAPLEGIVFEVRDSKGKVVTKVKTDKDGKANVSDLSIGKYELVEVETPAGYKPLEKPILFEIEKGRVTALQLTVENELVDTGNVEITKVDKENKDALADAVFEIQDEAGQVVAKITTDKKGHAQVTNLSVGTYKLVEVKAPKGYKQLVDPITFQIEKGMTKSLALTVENEMLDKGNVEITKVDKESQKALAGVVFEVQDEQGKVVTEVTTDKEGKATISDLSVGKYKLVEKESLPGYKKLAEPVSFEIKKGMTKVLSLKVENELLDKGSVEITKVDKESGVVLAGVTFEVQDEKGKVVTEVKTDKDGKAKIADLSVGKYKLVEKESLPGYKKLTEPVSFEIKKGMTEVLSMKVENEQLDKGSVEITKVDKDSQKVLEGVVFEVQDEQGKVVTEVKTDKEGKAKVSDLSVGKYKLVEKAGLPGYKKLTEPVSFEIKKGMTEVLSIKVENELLDKGSVEITKVDKESQKALEGVVFEVQDEAGTVVKELTTDKSGKAKVSDLSVGKYKLVEKAGLPGYKKLTEPVSFEIKKGMTKVLSLKVENEQLDKGSVEITKMAAESKNILSGAVFEVHDEKGKVVARVTTDKEGKAKVSDLSVGNYTLVEVEAPKGYEKLTNPIPFEITKGMISSVQLEVLNKLSHLAPPGPEKPETTDPENPGTTDPEKPGTTNPEKPGTTNPEKPGTTNPEKPGTTNPEKPGTTNPEKPGTTDPEKPEKELPKTGQKMPVEPYMGALLVMMSFGLLVLGRKKQG

SEQ ID NO: 28198 - protein, 503 aa, Bacillus cereus VD078
MLNKKMVAMAMTVPLVMGTISTVSALEKQQQVKLEAYSPQKKAIEYLKEHATEYGLKADLSDLQYISTTETSVASYVRFQQVVNGAPVFSKQITVTLNGEGKGLLAVSDYQPVTGVKEVTKKISEKDAEQKSMAYVGGESEQNLWAPTEKEFGYIVEEGVAIPVYKVVVHSNNPFGAWETFIDAENGKLIKKVDINRKAEGTGKVFLPNPVVSSGSLAGLKDNNDADSTALTNQLKTVTLKGLDGTGFLIGEYVTISSKAKTKSTNLQFNYTRANDSFEDVMSYYHIDTLQRYIQGLGFQNINKRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDAAAYSSSDPTCLRRLDTNKVYPKDITNEVHNDGEIWAQGQYEMAQSFGRDVATKIILQSHWSLTPNAKFRDGAKAIKQADALLYGGQHATEIDRIWAARGISTN

SEQ ID NO: 28199 - protein, 458 aa, Bacillus cereus VD078
MNLKLTSKLERLRKSKKGIGACVLAAGVTAITMIPQSAYAHGFVEKPSSRAALCSQNYGALNLNCGNVMYEPQSLEAPKGFPDGGPIDGKIASAGGLFGGILDQQTSNRWFKNTIKGGANTFTWKYTAAHSTSKWHYYITKKGWDPNKPLTRAELEPIGTVKHDGSAASNNLTHTINVPTDRNGYHVILAVWDVADTSNAFYNVIDVNLVNNEAPDTVAPSQPTGLNASKVSANSVELTWKASTDNIGVKEYQVLRNGEVIDTVPGTTFIDKKLKANTEYTYTIKALDSAGNISKESEKLKVKTTNAIPDIEAPTQPKGLHSMGTTATTVDLMWSPSEDNVGVDHYVVYRENAGVMNKIGTTDNTSFVDKNLKANTSYKYVVTAVDLARNESSRSDVLTVATKLDGSTYEKWDARKAYNKGDKVVHEGKVYEAVQSYQGNGDPNWIFALSIWKPVLNK

SEQ ID NO: 28200 - protein, 183 aa, Bacillus cereus VD078
MRKSFILLTLILVLVSVTAACTQDKKDSAVENGPIEEPTAKNENEELINFEEKEDMSRLEQGILLVGESVKGGYYLTAVQNAYLNASNDSVVVNVSVKNVRGQTIGLSELKYNLKDEKDGKAYEGKVLDQNPSDIQVKPNETVELKIAFEVPSTADEYMFYIESSLDPLGAHWKIDKLQSQKN

SEQ ID NO: 28201 - protein, 965 aa, Bacillus cereus VD078
MNKQSKINKVLLSISTMALSLGAIQTNVSAEEKVPYNVLHSKPVGIEKPVDEIGHASKAEETLSFQERLKVGDFSQRPASITKNSAVKQAKESYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNEVTPENKWLVNNGIYFASRLGKFHSNPNKGLEVVTQAMHMYPRLSESYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHTSQFFNTFTLEGTFTGSVTKGESEDWKAMSKRVNEALEQLAQKEWSGYKTVTAYFVNYRVNSSNQFEYDVVFHGIAKDDGENKAPTVNVNGPYNGLVKEGIQFKSDGSNDEDGKIVSYLWDFGDGSTSTEVNPVHAYEREGTYKVALRVKDDKGKESRNETTVTITDGSLTESEPNNRPEEANRIGLNTTIKGSLIGGDHTDVYTFNVASAKDIDISVLNEHGIGMTWVLHHESNMQNYAAYGQANGNHIEAKFNAKPGKYYLYVYKYDNGDGAYALSVK

SEQ ID NO: 28202 - protein, 182 aa, Bacillus cereus VD078
MNKKLLTSLLCSSFLFGLSACSSHDTSSSNTKNEQETSKETKNDELSNKDPQKELPTHGDSSDVYISIHSADSLDVIGNGEVKAQGVFKVLDVAVYNRQEEPITLNNNNFKLIDGTGREYHISNESQLVLKAANTATFKFGVLNPNENSEGNIVFDVPKNTQGLTLKINGDMLDEGIELKVE

SEQ ID NO: 28203 - protein, 455 aa, Bacillus cereus VD078
MNNRFLKQLQNLKMNKKSIGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINNVKPDTEAPSIPNGIQAQKVTANSIELTWNVSTDNVGVKGYQIFRNGEMIDTVPGTYFIDKKLQPSTEYTYTVKAIDAAGNVSKESTALTVKTTVEAPDTEAPTQPKGLHSMGTTASSVDLMWSPSDDNVGVDYYDIYREIEGTMKKIATSNTTSYMDKNLLANTTYKYAVKAVDVVGNESVQSDTFTITTKTESASYEAWDAKKAYKKEDRVLHEGKVYEAVQNYEGHGDPNWIFALSLWKTV

SEQ ID NO: 28204 - protein, 971 aa, Bacillus cereus VD078
MKGYSKKVLVGVSFASLMLGSFQGSILAEDTKGEQVSYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTQDDSKGIETLVEVLRSGFYLGFYNTELSKLNERSYHDKCLPALKTIANNPNFKLGTLEQNKVVSSYGKLIGNASSDVETITSAAKIFKQYNDNFSTLVDNLSAGNAIYDIMQGVDYDIQSYLYDTRKAPKDTVWYQKIDSYINELSRFALMGTITEKNGWLINNGIYYTGRLGTFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVLLVSDDYLATHAPKPVSDIAAEITAEAKLSNVSVKKNKSQFFNTFTLQGTYTGTTAKGEYEDWKTITQNVNDTLKRLSAKEWTGYKTVTAYFVNYRVNASGQFEYDVVFHGINTEEGAVNKAPVAVINGPYSGNVNEAISFKSDGSKDEDGKIASYKWEFGDGTESSEQNPTHVYTKEGTYTAKLTVTDDKGLTNTATASVTVQKKEDNSVEKEPNNSFQTANKLQLNQLLRASLGNGDTSDYFEINVETARNLQINVTKENNIGVNWVLYSAADLNNYVTYAQTQGNKLVGSYNAHPGKYYLHVYQYGGGTGNYTVEVK

SEQ ID NO: 28205 - protein, 164 aa, Bacillus cereus VD078; identical to SEQ ID NO: 27379

SEQ ID NO: 28206 - protein, 431 aa, Bacillus cereus VD078; identical to SEQ ID NO: 26767

SEQ ID NO: 28207 - protein, 372 aa, Bacillus cereus VD102; identical to SEQ ID NO: 27834

SEQ ID NO: 28208 - protein, 965 aa, Bacillus cereus VD102
MNKKSKINKVMLSISTMALSLGAIQTHASAEEKVPYNVLHSKPVGIEKPVDEIGHVSKAEETLSFQERLKVGDFSQRPASITNKATVKQVKESYSMADLNKMNDQELVETLGSIKWHQITDLFQFNEDAKSFYKDKGKMQVVIDELAHRGSTFTKDDSKGIQTFTEVLRSAFYLAFYNNELSELNERSFQDKCLPALKAIAKNPNFKLGTAEQDTVVSAYGKLISNASSDVETVQYASNILKQYNDDFNTYVNDRMKGQAIYDIMQGIDYDIQSYLIEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPAVADDYLAEHAPKSLTAVEKEMTEMLPMRDAKMTKHSSQFFNTFTLEGTYTGSVTKGESEDWNAMSKKVNEALEQLAQKEWSGYKTVTAYFVNYRINSSNQFEYDVVFHGIAKDDGENKAPTVNINGPYNGLVKEGIQFKSDGSKDEDGKIVSYLWDFGDGSTSAEVNPVHVYEREGSYKVALIVKDDKGKESKSETTVTVKDGSLTESEPNNRPEEANRIGLNTTIKGSLIGGDHTDVYTFNVASAKNIDISVLNEYGIGMTWVLHHESDIQNYTAYGQANGNHIEANFNAKPGKYYLYVYKYDNGDGTYELSVK

SEQ ID NO: 28209 - protein, 176 aa, Bacillus cereus VD102
MYKKLGTIALTGALALSLTACGDTSESAKKVSTNEKKTEQTSEKKEEKKEFKVGETIQLGDHKLTVSNIEKSQGGEFDKPKEGHEFIIANLTIENGGKEEISYNPFDFTLQNSEGNIVNETFTTVNQNTQLNAGQLAPNGKVAGSIAFEAKQGDPKLQLIFKPNFLSSKEIRINLQ

SEQ ID NO: 28210 - protein, 553 aa, Bacillus cereus VD102
MKRIFSLFLICMLAFSTLSNMIVSAESKSTGTLTIHKFEQSKDSKTTTEGNGKEGQTVPEDAKPLEGVTFEIKRIESFEKISNDGTVIKEDAKPVKDAAITKVTNAKGEAVFSNLPLGRYEVKAIEGPKHIALDKTTFIVDIPMTSTDGKDLNYDVHIYPKNETKRGSVEFVKIGEAGQVLKDAEFHLFKKNKDGTSTQVKTPSSLVTGEDGKVRVDSLEYGDYYYFIEHKAPTGYLTSKEERPFSIKESGEVVKLDDIKNYKEPTITKSINNGSKVAGINKETDYTYDIKTLLPEDIQSYKKYVVKDILDDRLEIKGLPIVMVDGKKVEDGSVKVVVEGQKVTATIEDFSKINGKELHLQITAKIKSDVESGVKIPNKAVLDFVNKDDVSSEKDGKPSNEVVVTPTAGNIKIEKVDGKDKTLKLEGAKFQLQDKKGNVIKVNGKEMNDITDANGIITWNEIPYGEYQIVETEAPKYKDKDGAVEHYQKLRDPINITLDEKHQKIELQVENNKSGWIIPATGGMGTILFTVVGLILMAVATFIFFRKKPVKNS

SEQ ID NO: 28211 - protein, 187 aa, Bacillus cereus VD102
MEVEKKSKVWEYIGWGSFILVGSFLFFCALILVFGDPKTKYQAQEVTAQGQEVKDAEKDSKKEYSIGETIKLGDHRLTVTEVKKSPGGEFDKPRQGHEYILVAVNIYNGGKEDISYNTLDFEMRNSQGNITRPTLSMINQNTALNSGQLAPKGQVAGTIVFEQPIGEKLKLQFTPNFWSKKKIIINL

SEQ ID NO: 28212 - protein, 431 aa, Bacillus cereus VD102; identical to SEQ ID NO: 26428

SEQ ID NO: 28213 - protein, 564 aa, Bacillus cereus VD102
MKKVFSMVLAFILMLSTLPSAFAANEVPTKGSLTIHKYAHEKDGQKGEEGTGEPGQKVPEGATPIKGVKYEVVKVATFKVIERNGEIVKEAVEKVDNATPISDVTGEDGTVTFKDLPIGRYLVKEVSGPDNVNINTEPYTIDIPMTDKEGKKLNYDVHIYPKNEIKRGAVELTKVDDAGKPLKDVEFTLYHKGTDKVVVDKAGKELKDLKTDKDGKIRVDGLLYGEYYFKESKALEGYVLDPKKYEFKVEKSGAFPKDGQAGYGEIVKLDKIINYKKPTIDKKINGNLNGLPINVDEEFTYDIKTKLPGDIHLYKKYVITDNVDPRLTIIGTPVVTIDGEKVSSDVVKVTLGEKTAAGQLVTVTVENFKALEGKKELHLQIKAKVNGDINGGTEIKNIAKIDYETGDKVTPPDDETTTPPVTVIVTDGKISLKKIDGATKDALEGAKFELRKDGKVVKVKGVDVVGVSDKDGMINWYNIPYGEYEIVEIEAPKYTDKGEVKSYQKLREPIKVKIDKDNQTVKLTVENNKSGWILPATGGIGTILFTVVGLVLMGAAFMFLRRKA

SEQ ID NO: 28214 - protein, 333 aa, Bacillus cereus VD102
MKGKLLKGVLSLGIGLGVLYGGSSAQADTSTDQNNILKVMTHNVYMLSTNLYPNWGQSQRADLIGAADYIKNQDVVILNEVFDNSASDRLLGNLKKEYPNQTAVLGRSNGNEWDKTLGSYSSSTPEDGGVAIVSKWPIVEKVQYVFANGCGPDNLSNKGFVYTKIKKNDRFVHVIGTHLQAEDSMCGKTSPASVRTNQLKEIQDFIKNKNIPNDEYVLFGGDMNVNKINAENNSDSEYASMFKTLHASIPSYTGHTATWDATTNSIAKYNFPDSPAEYLDYIIASKDHANPSFVENKVLQPKSPQWTVTSWLKKYTYDDYSDHYPVAATISMK

SEQ ID NO: 28215 - protein, 147 aa, Bacillus cereus VD102; identical to SEQ ID NO: 26827

SEQ ID NO: 28216 - protein, 336 aa, Bacillus cereus VD102; identical to SEQ ID NO: 27829

SEQ ID NO: 28217 - protein, 503 aa, Bacillus cereus VD102; identical to SEQ ID NO: 26421

SEQ ID NO: 28218 - protein, 971 aa, Bacillus cereus VD102
MKGYSKKVLIGVSFASFMLGSFQGDALAEGTKGEQVSYRNVLKMEPIGLQLPVQELAHSSKVLENKSFEKRLQFADLSQRPPEVKKESKQLAVAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVISSYGKLIGNASSDVETITSAAKIFKQYNDNFSTLVDNLSAGNAIYDIMQGVDYDIQSYLYDTRKAPKDTIWYQKIDSYINELSRFALIGTVTAKNGWLINNGIYYTGRLGTFHSTETKGLQVVTDAIKIYPYLSEQYFVAAEQIATNYGGKDANGKVVDLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLSNVSVKKNKSQFFHTFTLQGTYTGTTAKGEYEDWKTITQNVNDTLKRLSAKEWTGYKTVTAYFVNYRVNAAGQFEYDVVFHGINTEEGAVNKAPVAVINGPYSGNVNAAISFKSDGSKDEDGKIVAYKWEFGDGTVSNEQNPTHVYTKEGTYTAKLTVTDDKGLTNTATTNVTVQKKEDNSVEKEPNNSFQTANKLQFNQVLRASLGNGDTSDYFEINVETAKNLQINVTKENNIGVNWVLYSEADLNNYVTYAQQEGNKLVGSYYTYPGKYYLHVYQYGGGTGNYTVEVK

SEQ ID NO: 28219 - protein, 455 aa, Bacillus cereus VD102
MKNQFLKQLQNMKMNKKSLGAVALTAGIIGTTLIPQNAYAHGFVEKPSSRSALCSPTYGALNVNCGIVMYEPQSLEAPKGFPQTGPVDGQIASAGGKFGGILDQQTADRWFKNTITGGENTFTWKYTAPHLTSKWHYYITKKGWNPNKALTRADFEPIGTVQHDGSAASNHLTHKINVPTDRSGYHVILAVWDVADTANAFYNVIDVNLINDVKPDTEAPSIPNRIQAQKVTANSIELAWTASTDNVGVKGYQIFRNGEMIDTVPGTHFIDKKLQPSTEYSYTIKAIDAAGNVSKESATLTVKTTVEAPDTEAPTQPKGLHSMGTTASSVDLMWSPSDDNIGVDHYDIYRETKGSMEKIATSNTTSYMDKYLLSNTTYKYVVKAVDVAGNESVQSDIFIITTKTESVSYEEWDAKKAYEKGDKVLHEGKVYEAVQSYKGNGDPNWIYALSLWKTV

SEQ ID NO: 28220 - protein, 93 aa, Bacillus cereus VD102; identical to SEQ ID NO: 27827

SEQ ID NO: 28221 - protein, 51 aa, Bacillus cereus VD107
MKQVELEALQAINDLTDEELEEIVGAGSGVIKTISHECHMNSWQAIFTCCS

SEQ ID NO: 28222 - protein, 162 aa, Bacillus cereus VD107
MLKKVSRIILICGIAFSLSACTETKNSNESKQEDVQEKIYKIGETVDVDGLQVTLDSVQLGYPDYTTDKKKDDILGIVFTVKNNSKKEIPFAFYEFELTDKKGTKFKEYKYDSFISKKIAPDEKIQDVMLLDVAKENTYIATYRPEFTHENRTIKFELKPNK

SEQ ID NO: 28223 - protein, 431 aa, Bacillus cereus VD107; identical to SEQ ID NO: 27243

SEQ ID NO: 28224 - protein, 111 aa, Bacillus cereus VD107
PTGDGGNGEKPTTPPTGDGGNGEKPTIPSTEEGNNGNEPKQEGNNTGSGQTTTESQNTKETTTTVSENKEAEKDEHDLPKTGASVASTIGAGLAFVGAGLLMLFRRKKASK

SEQ ID NO: 28225 - protein, 878 aa, Bacillus cereus VD107
MVKYSKISKLILGVGLVTISCNGLQIQAETKEKNVKNVLQMEPVGIQKSVDELAHSSKVQENASFTKRLKLADLSQRPLAPNENEKQLAEEKKYSMAELNQLSNKQLTDLLVTIKWYQIPELFQFNSDSLKFYQDDSRMQAIIDKLAEQGQAYTKDDSKGIETLVETLRAAFYLGFYHDELSKLNERSYHDKCLPALKTIAKNPNFKLGTPAQNQVISSYGMLIGNASADVEVVQYAGEIFKQYNDNVATFIEDHTKGNAVYELMKGIDYDIQAYMYNTGKEEKDTMWYRNIDGFINEISRFALIGTVTDKNGWLINNGIYYAGRLGKLHSTPTKGQQVVTDAMRIYPYLGEQYFVAAEQITTNYGGVDANGKTINLDQIREDGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGSGTFFTYERTPEQSIYSLEELFRHEFTHYLQGRYEVPGLWGQGEMYQNERLTWFEEGNAEFFAGSTRLDSVVPRKSIIGGLSYDPAKRYTAAQTLNAKYGTWDFYNYSFALQSYMYNNRPEMFDKVHDLIRANDVPDYDAYRSTLSKDNKLNEEYQSYMQMLIDNRDKYTIPQVSDEYLAQHAPKPLSDVASDITNEAKLKNVKVTKNKSQFFNTFTLQGTYTGSAAKGEIEDRKVMNQATNDMLKHLSEKEWSGYKTLTAYFVNYRVNDAGQFEYDVVFSGVNTEEGTAVEKEPNNSFDTANPLSLNTLLRGNLSDQDQVDRFVIDVKDPKDLQITVTNEQNLGLNWVLYSESDLDNYVAYATKRDGNKLLGNYNAKPGKYYLSVYKYGGGTGNYTVEVK

SEQ ID NO: 28226 - protein, 965 aa, Bacillus cereus VD107
MNKKSKLNKVMLSISTMALSLGIIQTHVSAEEKVPYNVLKTKPIGIEMQVDEIVHTTKVDETLSFEERLKVGDFSQRPASIMKSSEVKQLKESYSMADLNKMSYQELIETLGSIKWNQITDLFQFNEDAKTFYQDKGKMQVIIDELAHRGSTFTKDDSKGIQTFTEVLRSAFYLAFYNAELSNLNERSFQDKCLPALKAIAKNPNFKLGTNEQDAVVSAYGKLISNASSDVETVQYATSILKQYNDNFATYVSDRMKGQAVYDIMQGIDYDMQSYLFETRKEAKDTTWYGKVDGFINEINRIALLNQVTSENKWLINNGIYFASRLGKFHSNPNKGLEVVTQAMYMYPRLSEAYFVAVEQIKTNYNGKDYSGNTIDLEKIREEGKQQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFEAFDKIQDLIRANDVKNYDKYRETLSKDPKLNKEYQEYMQQLIDNQDKYNVPEVSDDYLAEHAPKALAEVKKEINDTLHMKDAKMTKHTSQFFNTFTLEGTYIGSVTKGESEDWKAMSKRVNEALEQLAQKEWSGYKTVTAYFVNYRVNASNEFEYDVVFHGIAKDEEENKAPTVNINGPYNGLVKEGIQFKSDGSNDEDGKIVSYLWDFGDRSTSTEVNPVHVYEREGTYKATLRVKDDKGKESRSETTVTITDGSLTESEPNNRPEEANRIGLNTTIKGSLIGVDHTDVYTFNVASAKDIDISVLNEHGIGMTWVLHHESDMQNYAAYGQANGNHIEAKFNAKPGKYYLYVYKYDNGDGAYALSVK

SEQ ID NO: 28227 - protein, 960 aa, Bacillus cereus VD107
MNKNLKFTQMMIGISTMALSFGSIQTQVSAEEKAPYNMLQMKPIGTETLKDEIAHATKADETLTFEERLKVGDFSQRPTLVMKRDESQVKQNYTLAELNKMPDSEFIDTLSRISWNQITDLFQFNQDTKAFYQNKGRMNVIINELGQRGRAFTKEDSKGIETFVEILRSAFYVGYYNNEISYLKERSFHDKCLPSLKAIAKNPNFTLGTAEQDRVVVAYGKLISNASSDVETVQYAANILKQYNDNLSTYANDYAKGQAVYEIVKGVDYDIQSYLQETNKKPNATMWYGKIDNFINEVSRIALIQNITTENSWLINNGIYYAGRLGKFHSNPNKGLEVITQAMNMYPRLSGTYFVAVEQIKTNYGGKDYSGNAIDLQKMREEGKQQYLPKTYTFDDGSIVFKTGDKVTEEKIKRLYWAAKQVKAQYHRVIGNDKALEPGNADDVLTIVIYNNPDDYQLNRQLYGYETNNGGIYIEERGTFFTYERTPKQSIYSLEELFRHEFTHYLQGRYEVPGLFGSGELYQNERLTWFQEGNAEFFAGSTRTNNVVPRKSIISGLSSNPASRYTAKQTLFAKYGSWDFYNYSFALQSYLYNHQFETFDKIQDLIRANDVKNYDAYRESLSKDAQLNTEYQTYMQQLIDNQDKYTVPQVTNDYLIQHAPKPLAELKKEIVDVANIKDAKITKHESQFFNTFTVEGTYTGGTSKGESEDWKTMSKQVNQTLEQLSQKGWSGYKTVTAYFVNYRVNAANQFEYDIVFHGVATEEKEKTTTIVNMNGPYSGIVNEEIQFHSDGTESENGKIISYLWNFGDGTTSTEANPTHVYGEKGTYTVELTVKDSRGKESKEQTKVTVKQDPQTGGSLEEEKVLPFNTLVKGNLITPDQTDVYTFDVTVPKEVDISVINEQNIGMTWVLYHESDMQNYVACGEDEGNAIKGKYAAKPGKYYLNVYKFDDKNGEYSLLVK

SEQ ID NO: 28228 - protein, 971 aa, Bacillus cereus VD107
MKGYSKKVLVGVSFASLMLGSFQGNILAEDTKGEQVSYRNVLKMEPVGVQLPAQELAHSSKVLENKSFEKRLQLADLSQRPPEVKKESKQLAVAKTYTIAELNQLSNQQLVDVLVTINWEQITGLFQFNKDSLAFYQNDSRMQAIIDKLKQQGQAYTKDDSKGIETLVEVLRSGFYLGFYNAELSKLNERSYHDKCLPALKTIANNPNFNLGTLEQNRVVSSYGKLIGNASSDVETVTSAAKIFKQYNDNFSTLVDNLSAGNAIYDIMQGVDYDIQSYLYDTNKAPKDTMWYQKIDSYINELSRFTLMGTVTAKNGWLINNGIYYTGRLGTFHSTETKGLQVVTDAMKIYPYLGEQYFVAAEQITTNYDGKDANGNVVNLDQIREDGKKKYLPKTYTFDDGAIVLKAGDKVTEEKVKRLYWAAKEVKAQFHRTVESDQPLEQGNPDDVLTMVIYNSPAEYQFNRQLYGYETNNGGLYIEGTGTFFTYERTPQESIYSLEELFRHEFTHYLQGRYEVPGLWGQGKFYENERLSWFEEGNAEFFAGSTRTDNVVPRKSMIGGLSSNPAERYTAERTLYAKYGTWDFYNYSFALQSYMYNKRYDMFDKIHDLIRENDVTAYDAYRSALSKDANLNKEYQDYMQMLIDNREKYNVPLVSDDYLANHAPKPVSDIAAEITAEAKLNNVSVKKNKSQFFNTFTLQGTYTGGAAKGEYEDWKTMTQNVNDTLKRLSAKEWTGYKTVTAYFVNYRVNASGQFEYDVVFHGINTEEGVANKVPVAVINGPYSGNVSEAISFKSDGSKDEDGKITSYKWEFGDGTVSSEQNPTHVYTKEGTYTAKLTVTDDKGAANTATTSVTVQKKEDNSVEQEPNNSFKAANKLQLNQLLRASLGNGDTSDYFEINIETAKNLQINVTNENNIGINWVLYSEADLNNYVTYAQPQGNKLVGSYYTYPGKYYLHVYQYGGGSGNYTVEVK

SEQ ID NO: 28229 - protein, 333 aa, Bacillus cereus VD107
MKSKLLKGVLSFGIGLGALYSGSSAQAEMSTNQNDTLKVMTHNVYMLSTNLYPNWGQSQRADLIGAADYMKNQDVVILNEVFDNSASDRLLGNLKKEYPNQTAVLGRSNGSEWDKTLGNYSSSTPEDGGVAIVSKWPIVEKIQYVFEKGCGPDNLSNKGFVYTKVKKNDRFVHVIGTHLQAEDSMCGKTSPASVRTKQLQEVQEFIKNKNIPNNEYVLIGGDMNVNKINAENNSNSEYASMFKTLHASVPSYAGHTATWDATTNSIAKYNFPDASAEYLDYIVSSKDHANPVRIENKVLQPKSSEWSVTSWFQKYTYNDYSDHYPVEATISMK

SEQ ID NO: 28230 - protein, 554 aa, Bacillus cereus VD107
MKKFLSMFLICLLTFASLPSILIKAESKSPSKGTLTIHKFEQEPDGSPALKESNSKGVEIPKGAKPLAGVVYQIKQVESFGTITNDGKIVKEDIKPVNGVPIEVETNADGIAFFGDLPLGRYEVKEISGPPHVNIDTKTYKVDIPMTSEDGKVLTYDVQIYPKNETKRGAVELTKVGVENQALKGVQFSLYKEDGTELEKGLETDGKGKIRVGNLAYGKYYFLETKARDGYVLDPKKYEFFIKESGAINEDGTVTAGEVVKVDVKNYQEPTIDKKINGDLNNLPINTKTDYNYDIKTLIPEDIKDYKHYVVTDVLDSRLEIQGKPVVKIDGKVVDASVVEVVVDGQKVTATVKDFSKLDNKKEFHLQIKSQIRDGVETGVEIPNTATITFKNKDDVTGEKATKPVIVTPTTGSITLTKVDGKDGKKLEGAEFALQDTKGNPVEIDGKKVVGTSDKNGVITWNKLPYGEYQVVETKAPTYEKEDGTTGSYQQLREPIHVKIDADHKTVTLTVENNKSGWILPSTGGIGTILFTVVGLVLMMIAAFVFFRKKATNN

SEQ ID NO: 28231 - protein, 769 aa, Bacillus cereus VD107
MKKLKPILGAVSSLTMALTITAPALAETKPEQDGKVETFKEDTNLKEGQNIIYGDSGKKGVMIMEEPQENNDWDEDGIPNDVEEKGFKIVFNEKTGKNEAQLYDLVQDFGKKRFITNPKSANSDGDPFTDSYEVEHYDSDSDIDFNPMIANVPNLQIAVKRIDITPVASITDSNGESRTKTWEKSLSVQHSFNVGLAGEGGAEGSAAGPVPSGKGSINVGYGYSNTKTETESISNSFDWSTATTVDSSKAANVRLHLEYKNTGTASAGDVSPHFNIRLGNKIINTVKATQDRYKANLLTTAKGGNNKTEILMDSIEGQADVKISLTLDELKAVEQGAPLSIEVLPTSTMNVYTMKDGQFVNLGDWSHFASNVNASTTLVETNYGSIPKYRVYTPRTGKEKPANINHNLSLDEFFAHTGIADKGWVANYIVNGRLNEERVRYGPSRTLLERGKNLGFFDNRALRPTLSYSSYDYSKKKIYASVIPGIFNLGEEIFVTVRNKKGESQKVTLVRNQNSNVYESKENEPVDIAVNRASLGEYQAKFELIDAKDNKTEVFTPLVSNKSYLEAIDKLVVDNSGEPIVEGKKYYLKSSVGFYNGVKESWSAGTLSQSINGRYVHFSLKGNNWDGLRLGPIQQAIHGPDIQATPVLIERKGKSKPEEPFKKDEEVFLKFTNSSHSNYQYLNLGNGYDYSWLDTEQNKSAIKLDKIPNQKSFYIKSDSTYITSRENQWTSSVADNGIAPLVGGGERVLKSEHTTSPGNYHQWELESIK

SEQ ID NO: 28232 - protein, 455 aa, Bacillus cereus VD107
MKNRILKHLQNMKMNKKSLGAVALTAGVIGTTLIPQNAYAHGFVEKPGSRSALCSQTYGALNVNCGSVMYEPQSLEAPKGFPQGGPVDGQIASAGGKFDGILDQQTANRWFKNTITGGENAFTWKYTAPHLTSQWQYYITKKNWNPNKPLTRADFELIGTVQHDGSAASNNLTHKINVPTDRSGYHVILAVWDVADTANAFYNVIDVNLVNNLKPDTEAPSNPNGLQATKVTVNSVELTWSASTDNVGVKGYQVLRNGEIIDTVPGTHFIDKQLQPSTEYSYTVKAIDAAGNVSKESTAVKVKTAVVTPDTEAPTQPKGLHSMGTTASSVDLMWSPSDDNVGVDHYNIYREISGVMKKVGTSNSTSHMDKNLLANTTYKYAVIAVDVAGNESAQSDIFTVTTKDESVSYETWDAKKAYKKGDRVVHEGKMYEAVQNYQGNGDPNWIYALSLWKTV

SEQ ID NO: 28233 - protein, 503 aa, Bacillus cereus VD107
MLNKKMVAMAMTVPLVMGTISTVSALEKQQQVKLEAYSPQKKAMEYLKGNADQYGLKPDLSDLQYISTTEMSVASYVRFQQVVNGAPVFSKQITVTLNGEGKGVLAVSDYQSVKGVKEVTNKISEKDAEQKSMAYVGGESEQNLWAPTEKDFGYIIEDGIAIPVYKVVVHSNNPFGAWETFIDAENGKLIKKVDINRKAEGTGKVFLPNPVVSSGSLAGLKDNNDADSTALNNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSAEGGAMGEGFGDFLGATYEDAVSTTGYGKACIGEWDATAYSSSDPTCLRRLDNNKVYPKDITNEVHDDGEIWAQGQYEMAQAFGRDVATKIILQSHWSLTPNAKFRDGAKAIKQADALLYGGQHAAEIDRIWTARGISTN

SEQ ID NO: 28234 - protein, 175 aa, Bacillus cereus VD115
MYKKLGTIALTGALALSLAACSETEETAKKVSNDQKTEQTDTKKEDNKEFKVGETIQLGDHKLTVSNVEKSQGGEFDKPKEGQEFVIANLTIENGGKKEISYNPFDFNLQNSDGNIVDQAFTMVNQDTQLNSGKLAPNGKITGTIAFETKKDDPKLQLIFKPNFLSKKEVRINLQ

SEQ ID NO: 28235 - protein, 172 aa, Bacillus cereus VD115
MGKIFKFGCLGIIALFVIGIIAMVAGGGDSTEKTSTDTKAVSKEGVSSDVKISVGSMETVDSVGNEYSKEQAQGVFKILEVTLTNNQKDAITVDTNSFKLVDNTGREFTSSVQGQTSFDLANGGKTDFFLKQLNPGLTQTGKIVFDIPKDAEGLFLKASGGMTGKEIKLKVE

SEQ ID NO: 28236 - protein, 890 aa, Bacillus cereus VD115
MKNKKEIAMVALTTGLALTAVAPYGIGHAEETDQLQVQMQEESFRSGELTQPSQKAPENVVKDALKEKTEQALSPKQVNGETGVDYKVLQKRGSYDGTTLVRMQQTYEGKEVYGHQLTAHVDNKGVIKSVSGDSAQNLKQEELKKPFKLSKEETKQYIYTKYGKDIKFISEPEVKEVIYVDENNGQASNAYQVTFAAATPNYVSGTYLVNAQNGDMLKNMVQESGLKVSEEHVEPLKESRKNNFVSLTGTGKDDLGISRSFGISEQSNGKYALADYTRGQGIETYDVNYRDITNEETYYPGILVTSASTTFTDPKAVSAHFLATKVYDFYKDKYKRNSFDNKGKKVVSVVHAWDSGGTNNPKNWENAFSANINNISMLIYGDPMVKAFDIVGHEFTHAVTSSESNLEFFGESGAINEALSDIMGTAIEKYINNGEFNWTTGEQTGSVFRNMKNPSSINYSDGVPYPDDYSKYNDLNGEDNGGIHFNSSIINKVAYLIAQGGTHNGVTVNGIGEDKMFDIFYYANTDELNMTSNFSELRLACLKVATNKYGANSIEVQAVQNAFDAAKIKGAVKENEKTAENQVPELTVPSTITLHVGDTFDPMRNVTAADKEDGDLTNRVQHKGDVDTSKPGKYIVDYLVVDSQGGNATATQTVIVEGNGEILDIEPKLTAPVGVTINVGDSFVPMTEVLAIDKEDGDLTSKVKVDGKVDTSKAGTYVLTYTVTDSKGHEVTAKQTVTVKVREEVENEKPILKVPATATINEKDQFNPMVGVSATNKENDDLTSKVTYEGTVDTSKAGTYEIIYSVRDSVGNEVKAIQKVLVKDKDTSKTNGLANNSNISNNSNSDKKEYTYKELPKTGASTTNSAIMGMLMVIAGTVLTLVRKFRKIQK

SEQ ID NO: 28237 - protein, 746 aa, Bacillus cereus VD115
MGNNSKYKTRKILATTATVTMLATGMISSSDVFAEETQQQKKLSTSLQEGKSVKSENRTYTVPGKGDVEVLKQQERKSMAFSPYEPTGLYAKPNEQITINVEGNQNIQAYIGTYSYDASWREDSKIKSFTLKPGINTIQSPNGGMIYFYNKQQGGTIRTTVTTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYATSYRTAYVGDAIQYVLDIDKFVKDGWGPWHEAGHLRQQSPWKFYNMTEVQNNIYSLSVEKAFNQPSNLEKSGIYPKAFQYLEQMNKNYDEISDVFVKLVMLWQLQLAYGEDFYPKLHQLYRDMPSNEIPQTDENKKQLFMISASKVARQNLIPFFEKWGLRPNNDTIQKVTALGYPILTAEIWKGTDSNPIKPDMPNGNNILEGNKFAWSLKGISDFEFAKVNFNKSTEEMQIDLKEGIPHHYFNETYASIKVQNASGKVVYKKDIYGNKQQNAELQKVPVKVGDYIELTHLEGVHRATFMNVDNSKQESFGKKAIYEVTKDGLKTVNQIVNPKPDTEAPTQPQGLYASNVASNSVELKWNPSTDNVGVKEYQVLRDGQLIQTVQGTTFTDQNLTANKEYKYAVKAVDAAGNTSIQSNILPVKTKDQNASYEKWDPKKAYTKGDKVEHQGKVYEAVQNHQGNGDPSWIFAVSLWKPLTIK

SEQ ID NO: 28238 - protein, 878 aa, Bacillus cereus VD115
MVKYSKISKLILGLGLVTIPCNGLQIQAETKEKNVKNVLQMEPVGIQKSVDELAHSSKIQENASFTKRLQLADLSQRPLAPNEDVKPLAEEKKYSMAELNQLSNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKVISSYGKLIGNASADVETVLYAGEIFKQYNDNLATFIEDRTKGDAIYELMKGIDFDIQTDMYTTGKEPKDTMWYRNIDNFINEVSRFALIGTVTDKNGWLINNGIYYAGRLGKLHSTPTKGQQVVTDAMRIYSYLGEQYFVAAEQITTNYGGVDANGKTINLDQIRDDGKKKYLPKTYTFDDGAIVFKAGDKVSEEKIKRLYWAAKEVRSQFYRTVGSDKPLENGHADDVLTMVIYNSPDEYQFNRQLYGYETNNGGMYIEGSGTFFTYERTPEQSIYSLEELFRHEFTHYLQGRYEVQGLWGQGEMYQNERLTWFEEGNAEFFAGSTRLNSVVPRKSIIGGLSNDPAKRYTASQTLNAKYGTWDFYNYSFALQSYMYNKRPEMFDKVHDLIRANDVSSYDAYRSALSKDNKLNEEYQSYMQMLIDNRDKYTIPQVSDEYLAQHDPKSLSDITSDITNEAKLKDVKVTKNKSQFFNTFTLQGTYTGSSAKGEIEDWKVMNEATNEMLKRISGKEWTGYKTLTAYFVNYRVNHAGQFEYDVVFSGVNTEEGTAVEKEPNNSFETANPLSLNTLLRGNLSDQDQGDKFVIDVKDQKDLQISVTNEQNLGLNWVLYSESDLNNYVTYATKRDGNKLLGNYNAKPGKYYLSVYKYGGGTGNYTVEVK

SEQ ID NO: 28239 - protein, 128 aa, Bacillus cereus VD115
MTDPKGEVTDPKGEVTDPKGEVTDPKGEVTDPKGEVTDLKGEVTDPKGEVTDPKGEVTDPKSEVTDPKGEGTDRVNSQITKNNALNKQIVKKEQILPATGHDTNWLSVFGGGLMLIGAYLYRRLKRVN

SEQ ID NO: 28240 - protein, 971 aa, Bacillus cereus VD115
MKGYSKKVLVGVSFASLLLGSFQGSISAENTKGEKVSYRNVLKMEPVGIQLPVQELAHSSKVLENKSFEKRLQFADLSQRPPEAKKESKQLAVAKTYTIAELNQLSNQQLVDLLVTIDWEQITGLSQFNKDSLAFYQNDSRMQAIIDKLKQQGQTYTQDDSKGIETLVEVLRSGFYLGFYNTELSKLNERSYHDKCLPALKTIASNPNFKLGTLEQNRVVSSYGKLIGNASSDVETITSAAKIFKQYNDNFSTLVDNLSAGNAIYDIMQGVDYDIQSYLYDTRKEPKDTVWYQKIDSYINELSRFALMGTITAKNGWLINNGIYYTGRLGTFHSTGTKGLQVVTDAMKIYPYLGEQYFVAAEQITTNYGGKDANGNTVNLDQIREDGKRKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEANLKNVSVKKNKSQFFNTFTLQGTYTGTAAKGEYEDWKTITQKVNDTLKRLSAKEWTGYKTVTAYFVNYRVNASGQFEYDVVFHGMNTEEGAVNKAPVAVINGPYSGNVNEAISFKSDGSKDEDGKIASYKWEFGDGTVSNEQNPTHVYTKEGTYTAKLTVTDDKGATTSATTSVTVKKKEDNSVEKESNNAFQTANKLQLNQVLRASLGNGDTSDFFEINVETAKNLQINVTKENNIGVNWVLYSEADLNNYVTYAQQQGNQLVGSYYTYPGKYYLHVYQYGGGTGNYTVEVK

SEQ ID NO: 28241 - protein, 333 aa, Bacillus cereus VD115
MKSKLLKGVLSFGIGLGALYSGSSAQAETPTNQNNTLKVMTHNVYMLSTNLYPNWGQSERADLIGAADYIKNQDVVILNEVFDNSASDRLLGNLKREYPNQTAVLGRSSGNEWDKTLGNYSSSTPEDGGVAIVSKWPIVEKIQYVFEKGCGPDNLSNKGFVYTKIKKNDSFVHVIGTHLQAEDSMCGQTSPESVRTNQLKEIQDFIKNKNIPNNEYVLIGGDMNVNKINAENNSDSEYASMFKTLHASIPSYTGHTATWDATTNSIAKYNFPDSPAEYLDYIIASKDHANPSHIENKVLQPKSPQWTVTSWFKKYTYNDYSDHYPVEATISMK

SEQ ID NO: 28242 - protein, 965 aa, Bacillus cereus VD115
MNKKSKINKMMLSISTMALSLGAIQTNVSAEEKVPYNVLHSKPVGIEKSVDEIGHVSKAEETLSFQERLKVGDFSQRPASITKNSAVKQAKESYSMADLNKMNDQELVETLGSIKWHQITDLFQFNEDAKAFYKDNGKMQVIIDELAHRGSTFTKDDSKGIQTFTEVLRSAFYLAFYNNELSALNERSFQDKCLSALKAIAKNPNFKLGTNEQDTVVSAYGKLISNASSDVETVQYASNILKQYNDNFNAFVDDRMKGQAVYDMMQGIDYDIQSYLNEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDSKLNKEYQEYMQQLIDNQDKYTVPEVADDYLAEHAPKSLTEVKKEISETLSMKDAKMTKHESQFFNTFTLEGTFTGSVTKGESEDWNAMGKRVNEALEQLAQKEWSGYKTVTAYFVNYRVNSSNEFEYDVVFHGIAKDDGENKAPTVHINGPYNGLVKEGIQFKSDGSNDEDGKIVSYSWEFGDGRTSTEVNPVHAYEKEGTYKVVLRVKDDKGKESRSETTVTIKDGSLTESEPNNRKEEANRIGLNTTIKGSLIGGDHTDVYTFNVASAKDIDISVLNEYGIGMTWVLHHESDMQNYAAYGQANGNHIEAKLNAKPGKYYLYVYKYDNGDGTYSLSLK

SEQ ID NO: 28243 - protein, 102 aa, Bacillus cereus VD115
MQTTDEAKENAKQKNTEQTKEKSKIKEKEYAVNEDFHTPKFDVTVKRVVERDKVGKESIGFQKPEDGHVFIVVEAEGKNITNEPMKLAVLPSVDLVDENDGV

SEQ ID NO: 28244 - protein, 738 aa, Bacillus cereus VD115
MKQLRPAISVLGSVSMALTLASPALADVKQPNPGGTVEIFKENANVKKEDKNFTLGSDGEIGSLITQNIEMANNDWDKDGISNNLEMNGYKIEFNSQTGKYEAKAWDPEKDKGKPKFISNPMNANTDGDPFTDMYEIENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIFLSLDELKAVEQGELLSIEVLPTSTMDLSIEKGEEIMHLGDSGRYESRVNAATEQLETDIGNIPKFRVYTPKDKSLADKPVLSYNEVFQHVNIDTKKVNHIVNKAKSTNNVSVVSANNGTDALKNLKAGQGDRGYLHNDSVHGAFAKLQQPTLVEGSYDSVTQKIRATILPGLFGVSKEIPTTYSKKWNAPSQTVTLVKRENGFTYESRENIHPIKSEIAAHRKVTFEINDAHNLTPIQKIDTEIKANKEFEDYVVDNSGEFVTEGVPYTVASYGNTAYWGSHHAGNKWEYLWAEKSSDEKVNVIIERVGQPKPGKPIKKDEEVLIKFRNPIYSDYAYLKLQDSYIHLDQKQNASTFKFNHAYPKNFTGHHKQWNILSNGNKLKVGYLIDYMKYGNGENGTDTIAWNLSRVQ

SEQ ID NO: 28245 - protein, 553 aa, Bacillus cereus VD115
MKKILSVLLVVFLTFSAWSSVLVKAASPTKGSLTIHKYEQEKDGSTGVEGNGSGNQEVPTNAKPLKGVTFEVKRVASFEKISNDGEIVKEDVKPVTGAIPSQVITEDNGQAVLKDLPLGRYEVKEVAGPPHVNLNPNTYTVDIPLTNKEGKVLNYDVHMYPKNEIKRGAVDLIKTGANDKALAGAAFSVFKKDGTEVKKELVTDANGHIRVQGLEYGEYYFQETKAPKGYVIDPTKREFFIKNSGTINEDGTITSGTVVKVEVKNYEEPTIDKKINGNLEALPINPLTNYNYDIKTLIPEDIIEYKKYVVTDTLDNRLVMQGKPIVKIDGAEVNASVVDVAVEGQKVTATVKDFTKLDGKKEFHLQIKSQVKEGVPSSSEILNIAKIDFTNKNDVIGEKESKPVVVVPTTGIIELSKIDGDDKKKLKGAEFVLKDKNRKIVVVAGKEVIGVSDENGVIKWSNIPYGDYQIFETKAPTYTKEDGTKASYQLLKDPIDVKVSENNQTVKLKIENNKSGWILPVTGGIGTTLFTVLGLTLMVTAAFVFFRKKFANK

SEQ ID NO: 28246 - protein, 458 aa, Bacillus cereus VD115
MNLKLISKLERLRKSKKGIGACVLAAGVTAITMIPQSAYAHGFVEKPSSRAALCSENYGALNLNCGNVMYEPQSLEAPKGFPDGGPIDGKIASAGGLFGGTLDQQTSSRWFKNTIKGGANTFTWKYTAAHSTSKWHYYITKKGWDPNKPLTRAELEPIGTVKHDGSAASNNLTHTINVPTDRNGYHVILAVWDVADTSNAFYNVIDVNLVNNETPDTVAPSQPTGLNASKVSANSVEITWKASTDNIGVKEYQVLRNGEVIDTVPGTTFIDKKLKADTEYTYTIKALDSAGNISKESEKLKVKTTNTTPDIEAPTQPKGLHSMGTTVTTVDLMWSPSEDNVGVDHYIVYRESAGVMNKIGTADNTSFMDKNLKANTSYKYVVTAVDLVGNESSRSDVLNVTTKSEDSIYEKWDARKAYTKGDRVVYEGKVYEAVQDHQGNGDSNWIFALSLWKPVLNK

SEQ ID NO: 28247 - protein, 786 aa, Bacillus cereus VD115
MKLIKGIFVSTIVLTSFTGLELIKMNEDPNVVYADSKDSSQNINQFQGDIKEGDKIILKFKSEVNFPYKDGLENQIKDEGSDSELVKIFSEFPQLTLKRLFTSVNPKEIENIDKHTRETENNSSSNLLDYYIVEVPNKVTAETLMDKFKKSHLVEEVYMQEKPTLLPEVQLPTVSLNPYDDPRFLNQGYLKEAPYGINASYAWSIKGGDGKGTTFVDMEYGWLLDHEDLVNQKVELISGRNIDQHVGHGTSVLGIVSAEDNKVGNIGIAPKAKVKVVSQIRGDGSYNTADAIINAVHNLQAGDILLLEAQASYDGYGDKYLPVEVQPDIFDAIRAGTDKGIIVIEAGANGSNDLDQFRDRNGKQVLNRNSPDFKDSGAIMIGAASSTVPHKRLWFSNYGSRIDVYGWGENVDTTRAEPNRITKNLYTTGFSGTSSASPIIAGAATSIQGVAKEHLGRPYKPAELRNILSNPNTGTQSQNPLTDKIGVLPDLKSILSNLGYSPDISNNVLEGNQFVWSMKGIGDFEFAKLDFNKTKEEIQIQLKAGVPHHYFDSTYASVKVQNSSGKVVYNKDIYGNRQQNAETQKISVKVGDYIEFTHLEGGNRATLINVDKNIQESFGKKIVYQVTVNGLKKVDQIIPNPDTEAPTRPGGLQTTNITSNSVELKWNSSTDNVGVKEYQVLRDGKFIQTVQGTTFTDSKLTANIEYKYTVKAIDAAGNESIQSSVLSIKTKEQNTSYEKWDPRKAYTKGDRVEYQGKIYEAVQSYQGNGDSNWIFSLSLWKPISIS

SEQ ID NO: 28248 - protein, 197 aa, Bacillus cereus VD115
MGKIFKFGCLGFIALIVLGAIAAALGGGDDKEEKASSEPKQETQAPAAKEEPKKQEAKKEEPKKDLSKEGESSKVKIAVGSVKSIDSVGGEYLKEKAQGVFKVVEITITNNQKDAITVDANSFKLVDNKDREFTYSTQAQTAFDVGNGGSSDFFLKQLNPGLSQTGKIIFDVPADAQGLVLKARGGMMGKEIKLKVE

SEQ ID NO: 28249 - protein, 336 aa, Bacillus cereus VD115
MKRSKTYLKCLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDIAFNLQDNSARFFNVAPTNAVEETTVTSSVSYQLGGSVKASATPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDKSNLQVAYTKHADDYQLRPGYTFGTANWVGNNVKDVDQKTFNKSFTLDWKNKKLVEKK

SEQ ID NO: 28250 - protein, 431 aa, Bacillus cereus VD115; identical to SEQ ID NO: 27130

SEQ ID NO: 28251 - protein, 97 aa, Bacillus cereus VD115
PEKPETTDPEKPEITDPEKPETPNPEKPETTDPEKPETPNPEKPETTDPEKSGTPNPEKPEKELPKTGQKMPVEPYMGAFLVMMSFGLLVLGRKQQR

SEQ ID NO: 28252 - protein, 502 aa, Bacillus cereus VD115
MLNKKMVAMAMTVPLVMGTISTVSALEKKQVKVEAYSPQKKAVEYLKGNANQYGLKPDLSDLQYISTTETSVASYVKFQQVVNGASVFSKQTTVTLNGEGKGVLAVSDYQPVTGVKEVTTKISEKDAIQKSMAYVGEASEQNLWAPTEKEFGYIVEEGVALPVYKVVVHSNNPFGAWETFIDAENGKLIKKVDINRKAEGTGKVFLPNPVVSSGSKTGLKDSNDADSTALTNQLKTVTLKGLDGTGFLIGEYVTISSKAKTKSTNLQFNYTRANDSFEDVMSYYHIDTLQRYIQGLGFKNINNRSIKVNVNGTTDDNSFYSPSTKALTFGTGGVDDAEDAGIIAHEYGHSIQDNQVPGFGSSPEGGAMGEGFGDFLGATYEDAVSTTGYGKACVGEWDATAYSSSDPTCLRRLDTNKVYPKDITNEVHDDGEIWAQGQYEMAQAFGRDVATKIILQSHWSLTPNAKFRDGAKAIKQADALLYGGQHAADIDRIWAARGISTN

SEQ ID NO: 28253 - protein, 455 aa, Bacillus cereus VD115
MNSRILKHLQNMKMNKKSLGAVALTAGIIGTTLIPQNAYAHGFVEKPGSRSALCSPTYGALNVNCGSVMYEPQSLEAPKGFPQAGPVDGQIASAGGKFGGILDQRTADRWFKNPITGGENTFTWKFTAPHLTSKWHYYITKIGWNPNKALTRADFEPIGTVQHDGSAASNNVAHKINVPTDRSGYHVILAVWDVADTANAFYNVIDVNLINNVKPDTEAPSIPNGIQTQKVTANSIELTWNTSTDNVGVKGYQIFRNGEMIDTVPGTHFIDKKLQPSTEYSYTVKAIDAAGNVSKESTALTVKTTVEAPDTEAPTQPKGLHSMGTTASSVDLMWSPSDDNVGVDHYDIYREIEGTMKKIATSNTTSYMDKNLLANKTYKYVVKAVDVAGNESVQSDIFTITTKTESVSYGDWDAKKAYKKGDRVLYEGKVYEAVQNYQGNGDPNWIYALSLWKAV

SEQ ID NO: 28254 - protein, 370 aa, Bacillus cereus VD115
MKTKQTIAASTLALAMIAGANSAHAEVNDTTPQQSTGDRLAEIKQHRQELDAKLQQHKENVDQTLNELNQVKENVDTKVNELHERKQVADEKISEIKQHKQELDAKLQQDKQIVDEKINEIKEHKKQVDDKVAEMKEHKENIDTKVNEIKEHKQTVDEKVNEIKQHKENIDQKVNELKEVKKQVDEKLAELKKVKQTAEDKLAELKENKPNTDNTLEELKKIKGNLDSLSANLELAKQDVKNKLAVLQEARQDLLNKINEIKQSKQTVSDDLAKKKQDLDIKINDFKHTEKKIDDKLAELHTTKQNVDNKINEISQSKQTQADNSTKNNNARELPNAGSEQSNNMALGMLSVLGGVLLVTRNKIKTLFSK

SEQ ID NO: 28255 - protein, 51 aa, Bacillus cereus VD142
SYEKWDPKKAYTKGDRVEYQGKIYEAVQSYQGNGDSNWIFSLSLWRPITAS

SEQ ID NO: 28256 - protein, 583 aa, Bacillus cereus VD142
LKGGDGKGTTFVDMEYGWLLDHEDLVNQKIELISGRNIDQHVGHGTSVLGIVSAEDNKVGNIGIAPKAKVKVVSQIRGDGSYNTADAIINAVHNLQAGDILLLEAQASYDGYGDKYLPVEVQPAIFDAIRAGTDKGIIVIEAGANGSIDLDQFRDKNGKQVLNRNSPDFKDSGAIMIGAASSTVPHKRLWFSNYGSRIDVYGWGENVDTTRAEPNRITKNLYTTGFSGTSSASPIIAGAATSIQGVAKEHLGRPYKPAELRNILSNQNTGTKSQNPLIDKIGVLPDLKSILSNLGYSPDISNNVLEGNQFVWSMKGIGDFEFAKLDFNKTKEEMQIQLKSGVPHHYFDSTYASVKVQNSSGKVVYNKDIYGNRQQNAETQKVSVKVGDYIEFTHLEGGNRATLINVDKNVQESFGKKIVYQVTVNGLKKVDQIINPSPDTEAPTQPQGLQATNITANSVELKWNSSTDNVSVKEYQVLRDGKFIQTVQGTTFTDSKLTANIEYKYTVKAIDAAGNQSIQSSVLSIKTKEQNASYEKWDPKKAYTKGDRVEYQGKIYEAVQSYQGNGDSNWIFSLSLWRPITAS

SEQ ID NO: 28257 - protein, 750 aa, Bacillus cereus VD142
MKRISALLLTMPIILGSIATIPHTKVSAETMSFNQETLTLETLNQQTDQAIVNGNFEAHLNNLTAYLNGNIGGMTEENLKKKLVDPVFAAALAQWQFISQTGAATMDAFAKKNADHQQFLSWAMKNTDVMNTYLEGGSPTGKNPVNALEIWNTIWNTDADSHEGLYLKLAISTSLAHAEPIKYWTNNQPINPLKRYQHYKSADQNNELLPCFRTYDVWHLRLVVNTWSPEEDLTWARNMINTEHPELKSQDKVGESAYLIKYTTHNKDGVSIHAGNDAFYGLGWNLSSIYRFGGVCGNISKFGTQVSQAFGVAAMPVGQPGHCALIWNHKPSSWNLGNDISGWGESSRHDATVIPWSDNSPTNQVPYMLLFENAERDPVKLDQSERLRWLAKAMTSADNKIAIYKISTNILPINFLVWKDYVSLMLQNPNVTDAEWKELNNSIISAFANEPRPMMDLLTQIKSYVPNTEDILEGNQFAWSLKGIGDFEFAKVNLNKSTEEMQIDLRAGVPHNYFNSIYASIKVQNTSGKVIYNKEIYGNKQQNAEQAKVPVKVGDFIEFTHLEGANRATITSMEKNIQESFGNKAVYEITKEGLKKVNKIINPKPDTETPTQPQGIYASNVTSNSVELKWNSSTDNVGVKEYQVLRDGQLIQTAQGTTFTDQNLTANKEYKYAVKAVDAAGNTSIQSNILPIKTKDQNVSYEKWDSKKAYTKGDKVEHQGKVYEAVQTHQGNGDPNWIFALSLWKPLTIN

SEQ ID NO: 28258 - protein, 667 aa, Bacillus cereus VD142
MIIKKHPFRTLAKTAVALTMIIPTSQAISHPFAYAQENIAESQQQVAPFWNKNKNYPGESYVTYEGKVYHSLYWVNAGILPTQQFSGWELYTGSEYIPDNSDPNDLFGEGITWPSHVFAPYVDNGMNPQNLLKYAQETNTSFFTLSFIVADKNGNPVWGGSHAPIGDGNLDDQIKQIRKIGGDVKVSFGGANAGNTPGLGADLAAAITDVNKLKDAYKSVINTLHLTHMDFDIEGALVAHPESIERRSKAIALLQKELKAEGKDVKIGYTLPVMPYGLTNDGINVIQSAIKHDVDLNSINIMTMDYGQQNQQMGQAAIDAINSLHGQLTNLYKDTIKDSDIWKMIAVTPMIGKNDTQNETFTLNNAKELFQFAKEKGIGEISMWSVYRDKKPTESWQIGQATGDASGLPDVDDGAFSKLFSAFNSSTEIDVIAPTAPSNLRSVSQTTTTVELQWEVSTDNIAVKEYEVYRDGKKVGTTKATRYEDTGLQANTKYNFTIKAVDAAGNKSKSSNEVSVTTKEENPEPVAPTAPTGLQASETTTNSVHLIWEKSISNVGIKEYEIYRNGTKIATSPSTHYTDENLLASTEYRYMVKAIDTQGKVSVASNEIKITTKDTPSSEYKAWDSYAAYKKGDRVEHQGKIYEAVQSYQGYGDPNWIFSLALWKIIK

SEQ ID NO: 28259 - protein, 746 aa, Bacillus cereus VD142
MGNKSKHKTKRILVATATLTILASGMASSSDVFAEETQQQKKISASLQEEKSVKSENRTYTVPGKGDVEVLKQQERKNMAFSPYEPTGLYAKPNEQITINVEGIQDIQAYIGTYSYDASWREDSKIKSFTLKPGINTIQSPNGGMIYFYNKQQGGTIRTTVTTGGTITPFFELGKHTKQDLINMLDQYPNAHAVELKGERVLITASPARVKKYLLGSNTDPVQLLKKMDEATRIQDKVAGLSEEQVDKHYVHYVEENHSPDYYMYATSYRTAYVGDAIQYVLDINKFVKDGWGPWHEAGHLRQQSPWKFYNMTEVQNNIYSLSVEKAFNQPSNLEKSGIYPKAFQYLEQTNKNYDEISDVFVKLVMLWQLQLAYGEDFYPKLHQLYRDMPSNEIPQTDENKKQLFMISASKVAKQNLIPFFEKWGLRPNNDTIQKVAALGYPILTAEIWKGTDSNPIKPDMPNGNNILEGNKFAWSLKGISDFEFAKVNFNKSTEEMQIDLKEGIPHHYFNETYASIKVQNASGKVVYKKDIYGNKQQNAELQKVPVKVGDYIELTHLEGVHRATFMNVDNSKQESFGKKAIYEVTKDGLKTVNQIVNPKPDTEAPTQPQELYASNLTSNSVELKWNSSTDNVGVKEYQVLRDGQLIQTVQGTTFTDQNLTVNKEYKYAVKAVDAAGNTSIQSNILLVKTKDQNASYEKWDPKKAYTKGDKVEHQGKVYEAVQNHQGNGDPNWIFALSLWKPLTIK

SEQ ID NO: 28260 - protein, 182 aa, Bacillus cereus VD142
MNKKLLTSLLCSTFLFGLSACSSHDTSSSNTKNEQETSKETKNDELSNKDPQKELPTHGDSSDVYISIRSADSLDVIGNGEVKAQGVFKVLDVAVYNRQEEPITLNINNFKLIDGAGREYHISNESQLVLKAANTATFKFGVLNPNENSEGNIVFDVPKNTQGLTLKINGDMLDKGIELKVE

SEQ ID NO: 28261 - protein, 333 aa, Bacillus cereus VD142
MKSKLLKGVLSFGIGLAALYSGSSVQAEMSTNQNDTLKVMTHNVYMLSTNLYPNWGQNERADLIGAADYIKNQDVVILNEVFDNSASNRLLGNLKKEYPNQTAVLGRSSGSEWDKTLGNYSSSTPEDGGVTIVSKWPIVEKIQYVFEKGCGPDNLSNKGFVYTKVKKNDRFVHVIGTHLQAEDSMCGNTSPASVRTKQLQEIQEFIKNKNIPNNEYVLIGGDMNVNKINAENNSNSEYASMFKTLHASVPSYTGHTATWDATTNSIAKYNFPDSPAEYLDYIIASKDHANPSYIENNVLQPKSPEWSVTSWFQKYTYNDYSDHYPVEATISMK

SEQ ID NO: 28262 - protein, 660 aa, Bacillus cereus VD142
MISQKTKKRFNKVIIITAACSMFSMFGTSISHTKAVTRSAAPSVYVSPQNTASSDIISIDWSPVQTAPYTYWAVHNWNAGGEAGGYAGFQQQSGFDEKGKRTLHFALWDPISSKEAIKAEYLSPNSQAGLFGGEGTGLKVQTTYGWKDYNWYRMTMRSWQENGHTKFGQWMKDVTKNKWHLIAIMEFPVANVAFNHGLGMFQEDWAGNGQDVREARLKNGYSRKLVDKQWSSWNNQSISGQHDTSYQYDGGATSEYVWVKAGGNTQSTIGTGKIFTLNQPTQPEIGKLDFDIQSIYYENEKLNVSWKLKENSTPQFKGKIEIYNDENMTGQPIEIIDNIKSYQSEISQSILLSKNVYAKIILTDLFDQTVEKKAQIKNESPNIFEGNEFAWSLKGIGDFEFAKVNLNKSTEEMQIDLRAGVPHNYFNSTYASIKVQNTSGKVIYNKEIYGNKQQNAEQAKIPAKVGDFIEFTHLEGANRATITNIEKNIQKSFGDKAVYEITKEGLKKVDNIVNPKLDTEAPTQPQGLYASNVTSNSIELKWNPSSDNVGVKEYQVLRDGQLIQTVQGTTFTDQNLTVNKEYKYAVKAVDAVGNTSIQSNILPVKTKNQNESYEKWDSKKAYTKGDKVEHQGKVYEAVQNHQGNGDSNWIFALALWKPLT

SEQ ID NO: 28263 - protein, 431 aa, Bacillus cereus VD142; identical to SEQ ID NO: 26767

SEQ ID NO: 28264 - protein, 219 aa, Bacillus cereus VD142
YNKDIYGNRQQNAETQKVSVKVGDYIEFTHLEGGNRATLINVDKNVQESFGKKIVYQVTVNGLKKVDQIINPSPDTEAPTQPQGLQATNITANSVELKWNSSTDNVSVKEYQVLRDGKFIQTVQGTTFTDSKLTANIEYKYTVKAIDAAGNQSIQSSVLSIKTKEQNTSYEKWDPRKAYTKGDRVEYQGKIYEAVQSYQGNGDSNWIFSLSLWKTISIS

SEQ ID NO: 28265 - protein, 743 aa, Bacillus cereus VD142
MKRGQKRKTQNLVMVTATLSMFTIGITPSLEIFAEEQAQQQKVSVLKNEESVKVENRVFTVQGKGDVKVLSHLDRRAASFSPFEPTGLYAKSNEEITIDVEGNNEITAYIGAFSYNRNSQGEELVKSFTLKPGTNTIRYEGGGMIYFYNKQENGTIRTTIQKGGTPVPYFELGKHTKQDLIDMLNQNPDSFAVELKGERVLITATPERVKKYLLGSNTDPAQLLKKMDEATRIQDRMSGLTEEQVDKHYIHYVEDKDNKSGFMYATEYRTAYVGDAIQYVLDINKFTTDGWGPWHEAGHLRQQVPWRFYNMGEVQNNIYSLAVEKAFGQPSRLEEEGVYPKVSRYLVQENKNYDEISDVFVKLAMLWQLHLAYGEEFYPKLHQLYRDMPSNEIPQTDETKKQLFMITASKAAKQNLIPYFEKWGLRPNNDTIQKIASLGYPNLTAEIWESTDSNPIKPDTPNSSNVLEGSQFAWSMKGIGDFEFVKVNLNKSTEEMQINLKAGVPHNYFDSTYASIKVQNTSGKVVYNKEIYGNKQQNAEQAKVPVKVGSFIEFTHLEGANRATITNMEKNIQESFGVKVVYEITKEGLKKVDKIVNPKPDTEAPTQPQGLYASNVASNSVDLKWNPSTDNVGVKEYQVLRDGQLIQTVQGTTFTDQNLTANKEYKYAVKAVDAAGNTSIQSNILPIKTKDQNVSYEKWDPKKAYTKGDKVEHQGKVYEAVQNHQGNGDPNWIFALALWNPLT

SEQ ID NO: 28266 - protein, 64 aa, Bacillus cereus VD142; identical to SEQ ID NO: 27541

SEQ ID NO: 28267 - protein, 965 aa, Bacillus cereus VD142
MNKKSKINKVLLSISTMALSLGAIQTNVSAEEKVPYNVLHSKPVGIEKPVDEIGHASKAEETLSFQERLKVGDFSQRPASITKNSAVKQAKESYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSTYGKLISNASSDVETVQYASNILKQYNDNFNAYVDDRMKGQAVYDMMQGIDYDIQSYLNEARKEANETMWYGKVDGFINEINRIALLNQVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHTSQFFNTFTLEGTFTGSVTKGESEDWKAMSKRVNEALEQLTQKEWSGYKTVTAYFVNYRVNSSNQFEYDVVFHGIAKDDGENKAPTVNVNGPYNGLVKEGIQFKSDGSNDEDGKIVSYLWDFGDGSTSTEVNPVHAYEREGTYKVALVVKDDKGKESRNETTVTIKDGSLTESEPNNRSEEANRIGLNTTIKGSLIGGDHTDVYTFNVASAKDIDISVLNEYGIGMTWVLHHESDMQNYAAYGQANGNHIEAKFNAKPGKYYLYVYKYDNGDGAYALSVK

SEQ ID NO: 28268 - protein, 748 aa, Bacillus cereus VD142
MKRISSLLLTMPIILGSIATIPHTKVSAETISFNQETFTLETLNQQTDQAIANGNFEAHLNNLTAYLNGNVGGMTEENLKKKLADPVFAAALAQWQFISQTGAATMATFAKKDANHQKFLGWAMKNTGVMNTYLEGGSPTGKNPVNALEIWNTIWNADANSHEGLYLKLAIATSLAHAEPIKYWTNNQPINPLTRYQHYKSADQNNELLPCFRTYDVWHLRLVVNTWSPEEDLTWARNMINTEHPELKNQDKVGESAYLINYVTHNKDGVSIHAGNDAFYGLGWNLSSIYRFGGVCGNISKFGTQVSQAFGVAAMPVGQPGHCALIWNNKPSSWNLGNDISGWSESSRHDATVIPWSDNSPTNQVPYILLFENAERDPVKLDQSERLRWLAKAMTSTDNKIAIYKISTNILPINFLVWKDYVSLMLQNPNVTDAEWKELNNSIISVFANEPRPMMDLLTQIKNHVPNTDDILEGEQFSWSLKGIGDFEFAKVNLNKSTEEMQIDLRAGVPHNYFDSTYASIKVQNKSGKVVYNKEVYGNKQQNAETQKVPVKIGDFIELTHLEGRERATLINLDNNKRENFDKKAMYEVKKDGLKKVNQIVNPKPDTEAPTQPQGLYASNLTSNSVEIKWNASTDNVGVKEYQVLRDGQLIQTVQGTTFTDQNLTANKEYKYAVKAVDAAGNTSIQSNILPVKTKDQNVTYEKWDPKKAYTKGDKVEHQGKVYEAVQNHQGNGDPNWIFALALWNPLT

SEQ ID NO: 28269 - protein, 252 aa, Bacillus cereus VD142
MKIKTTFLPVVLALSTMVTGSTVFLNSTVHAATEPVVQKNIPKVLDFNRSADKPLATAWGNKFYNKWITNVSSAEEKEFVSYTDLGYFHLNAYLQDNKGQLTGKDIDMEQKIKHLDRAFIVSSVPDNIVVYRRSNESAFGLEKGTLIKGNKLNKQEFLEFKNKFLGKYQIDYTYMSTSILKDASESFSGRPILIRLTVPKGNHGAYLASLSPSPWEMEMLLPRNTTYKVNGISYVKNGNSNYVLVEASIMKA

SEQ ID NO: 28270 - protein, 971 aa, Bacillus cereus VD142
MKGYSKKVLVGVSFASLMLGSFQGSILAEDTKGEQVSYRNVLKMEPVGVQLPVEELAHSSKVLESKSFEKRLQFADLSQRPPEVKKERKQLAVAKTYTIAELNQLSNQQLVDLLVTIDWEQITGLFQFNKDSLAFYQNDSRMQAIIDKLKQQGQAYTKDDSKGVETLVEVLRSGFYLGFYNAELSKLNERSYHDKCLPALKTIANNPNFKLGTLEQNRVVSSYGKLIGNASSDVETVTSAAKIFKQYNDNFSTLVDNLSAGNAIYDIMQGVDYDIQSYLYDTRKVPKDTVWYQKIDSYINELSRFALMGTITEKNGWLINNGIYYTGRLGTFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPQESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRENDVTAYDAYRSALSKDANLNKEYQDYMQMLVDNREKYNVPLVSDDYLATHAPKPVSDIAAEITAEAKLSNVSVKKNKSQFFNTFTLQGTYTGTSAKGEYEDWKTITQNVNDTLKRLSAKEWTGYKTVTAYFVNYRVNASGQFEYDVVFHGINTEEGAVNKAPVAVINGPYSGHTNEAISFKSDGSKDEDGKIASYNWEFGDGAVSNEQNPTHVYTKEGTYTAKLTVTDDKGLTNTATTSVTVQKKEDNSVEKEPNNSFQTANKLQLNQVLRASLGNGDTSDYFEINIETAKNLQINVTKENNIGVNWVLYSEADLNNYVTYAQQQGNKLVGSYYTYPGKYYLHVYQYGGGTGNYTVEVK

SEQ ID NO: 28271 - protein, 164 aa, Bacillus cereus VD142
MKKKLLPICAMALLTVGYSSVASADTGTLTKEEAAQVQQDAAKKEEAIKVQQKNDVEKKQAAQVQEKIDMAKKEEAIKAGQKNDTAKKEVTPQVQEKEALAKKEEAIKAGQKNDAAKKEVAKPAVQGEKLPNTASNNVAMMALSACLVGIGTLFGLKRRNKVKA

SEQ ID NO: 28272 - protein, 503 aa, Bacillus cereus VD142
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGEGKGLLAVSDYQPVTGVKEVTKKISEKDAEQKSMAYVGGESEQNLWAPTEKEFGYIVEEGVAIPVYKVVVHSNNPFGAWETFIDAENGKLIKKVDINRKAEGTGKVFLPNPVVSSGSLAGLKDNNDADSTALTNQLKTVTLKGLDGTGFLIGEYVTISSKAKTKSTNLQFNYTRANDSFEDVMSYYHIDTLQRYIQGLGFQNINKRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDATAYSSSDPTCLRRLDTNKVYPKDITNEVHNDGEIWAQGQYEMAQSFGRDVATKIILQSHWSLTPNAKFRDGAKAIKQADALLYGGQHATEIDRIWAARGISTN

SEQ ID NO: 28273 - protein, 455 aa, Bacillus cereus VD142
MNNRFLKQLQNLKMNKKSIGAVALTAGIIGTTLIPQNAYAHGFVEKPGSRSALCSPTYGALNLNCGSVMYEPQSLEAPKGFPQGGPVDGQIASAGGKFGGILDQQAAERWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINNVKPDTEAPSIPNGLQAQKVTANSIELTWNTSTDNVGMKGYQVFRNGEMIDTVLGTYFIDKKLQPSTEYTYTVKAIDAAGNVSKESTALTVKTTVEAPDTEVPTQPKGLHSMGTTASSVDLMWSPSDDNVGVDYYDIYREIEGTMKKIATSNTTSYMDKNLLANTTYKYAVKAVDVVGNESVQSDTFTITTKTESASYEAWDAKKAYKKGDRVLHEGKVYEAVQNYEGHGDPNWIFALSLWKTV

SEQ ID NO: 28274 - protein, 458 aa, Bacillus cereus VD142
MNLKLTSKLERLRKSKKGIGACVLAAGVTAITMIPQSAYAHGFVEKPSSRAALCSQNYGALNLNCGNVMYEPQSLEAPKGFPDGGPIDGKIASAGGLFGGILDQQTSNRWFKNTIKGGANTFTWKYTAAHSTSKWHYYITKKGWDPNKPLTRAELEPIGTVKHDGSAASNNLTHTINVPTDRNGYHVILAVWDVADTSNAFYNVIDVNLVNNEAPDTVAPSQPTGLNASKVSANSVELTWKASNDNIGVKEYQVLRNGEVIGTVPGTTFIDKKLKANTEYTYTIKALDAAGNISKESEKIKVKTTNETPDKEAPTQPKGLHSMGTTATTVDLMWSASEDNVGVDHYVVYRESTGVMNKIGTADNTSFMDKDLKTNTSYKYVVTAVDLAGNESSRSDVLTVATKLEDSTYEKWDARKAYNKGDKVVHEGKVYEAIQSYQGNGDPNWIFALSLWKPVLNK

SEQ ID NO: 28275 - protein, 738 aa, Bacillus cereus VD148; identical to SEQ ID NO: 26889

SEQ ID NO: 28276 - protein, 455 aa, Bacillus cereus VD148
MNNRILKHLQNMKMNKKSLGAVALTAGIIGTTLIPQNAYAHGFVEKPGSRSALCSPTYGALNVNCGSVMYEPQSLEVPKGFPQAGPVDGQIASAGGKFGGILDQQTADRWFKNTITGGENTFTWKFTAPHLTSKWHYYITKIGWNPNKALTRADFEPIGTVQHDGSAASNNVAHKINVPTDRSGYHVILAVWDVADTANAFYNVIDVNLINNVKPDTEAPSIPNGIQTQKVTANSIELTWNTSTDNVGVKGYQIFRNGEMIDTVPGTHFIDKKLQPSTEYSYTVKAIDAAGNVSKESTALTAKTTVEAPDTEAPTQPKGLHSMGTTASSVDLMWSPSDDNVGVDHYDIYREIEGTMKKIATSNTTSYMDNNLLANKTYKYVVKAVDVAGNESVQSDIFTITTKTESVSYGEWDAKKAYKKGDRVLYEGKVYEAVQNHQGNGDPNWIYALSLWRAV

SEQ ID NO: 28277 - protein, 878 aa, Bacillus cereus VD148; identical to SEQ ID NO: 26892

SEQ ID NO: 28278 - protein, 723 aa, Bacillus cereus VD148; identical to SEQ ID NO: 27654

SEQ ID NO: 28279 - protein, 162 aa, Bacillus cereus VD148; identical to SEQ ID NO: 26879

SEQ ID NO: 28280 - protein, 333 aa, Bacillus cereus VD148; identical to SEQ ID NO: 26881

SEQ ID NO: 28281 - protein, 1064 aa, Bacillus cereus VD148; identical to SEQ ID NO: 27649

SEQ ID NO: 28282 - protein, 213 aa, Bacillus cereus VD148; identical to SEQ ID NO: 26884

SEQ ID NO: 28283 - protein, 965 aa, Bacillus cereus VD148
MNKKSKINKMMLSISTMALSLGAIQTNVSAEEKVPYNVLHSKPVGIEKPVDEIGHTSKAEETLSFQERLKVGDFSQRPASITKNSAVKQAKESYSMADLNKMNDQELVETLGSIKWHQITDLFQFNEDAKAFYKDNGKMQVIIDELAHRGSTFTKDDSKGIQTFTEVLRSAFYLAFYNNELSALNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEVNETMWYGKVDGFINEINRIALLNEVTSENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDSKLNKEYQEYMQQLIDNQDKYTVPEVADDYLAEHAPKSLTEVKKEISETLSMKDAKMTKHESQFFNTFTLEGTFTGSVTKGESEDWNAMGKRVNEALEQLAQKEWSGYKTVTAYFVNYRVNSSNEFEYDVVFHGIAKDDGENKAPTVHINGPYNGLVKEGIQFKSDGSNDEDGKIVSYSWEFGDGRTSTEVNPVHAYEKEGTYKVVLRVKDDKGKESRSETTVTIKDGSLTESEPNNRKEEANRIGLNTTIKGSLIGGDHTDVYTFNVAAAKDLDISVLNEYGIGMTWVLHHESDMQNYAAYGQANGNHIEAKLNAKPGKYYLYVYKYDNGDGTYSLSLK

SEQ ID NO: 28284 - protein, 502 aa, Bacillus cereus VD148; identical to SEQ ID NO: 26882

SEQ ID NO: 28285 - protein, 890 aa, Bacillus cereus VD148; identical to SEQ ID NO: 26885

SEQ ID NO: 28286 - protein, 458 aa, Bacillus cereus VD148; identical to SEQ ID NO: 26890

SEQ ID NO: 28287 - protein, 971 aa, Bacillus cereus VD148; identical to SEQ ID NO: 27655

SEQ ID NO: 28288 - protein, 553 aa, Bacillus cereus VD148; identical to SEQ ID NO: 26888

SEQ ID NO: 28289 - protein, 370 aa, Bacillus cereus VD148; identical to SEQ ID NO: 26891

SEQ ID NO: 28290 - protein, 109 aa, Bacillus cereus VD148
NPTTPPTGEGNNGGNPTTPPTGEGNNGGNPTTPPTNEGNSGNNAGSGQTTTDDQNTKETTTTVSENKEADKDERDLPKTGASVASTIGAGLAFVGAGLLMLFRRKKANR

SEQ ID NO: 28291 - protein, 431 aa, Bacillus cereus VD148; identical to SEQ ID NO: 26893

SEQ ID NO: 28292 - protein, 906 aa, Bacillus cereus VD154
MKRISKIIIMLLCCTMLGSVHVVQASSIQISSKLIISRPVSSVAQGMLGNALVPPHNPSPYGFHVNSSKIKRQYMAQQPFQKPYLYTSHLFPTPFQIDQSIQPPDEKLNFATLAATSATQQVYTMAQLQALSYENLVQVLSTIRWSDITDLFQFNADSLAFYQDQNRVQFLIQALAKRGATYTTTNSNGIETFVEVLRSGFYLGYYYKELAYLNERTFHDTCLPALQAIANNPAFRLGTIEQDRVVKAYGNLIGNASSNPEIVSLAVPILNQFNQNLQTYAKEYSKGTAVYSLLSGIDYDLQMYLYQTGTSPNQSPWYGKINTFIDEIGKMALYGQVNADTGWIINNGIYYTSRIGDFHTTAQKGLQMITNALQVYPYLSEAYLTAAQQIDERYNGKDYKGNLFSYKQIQEAGKKKYIPKAYTFDNGSMIIRTGQQVTTEKAQRLYWASKEVQAQFYRVVGSDTPLEQGHRDDILTMVIYNNPEEYRLNRLLYGYDTNNGGMYIEQDGTFFTYERTPQDSIYSLEELFRHEYTHYLQGRYLVPGLFGEGKLYENERLTWFEEGGAEFFAGSTRTHQVVPRKTIVQQLAVNPLNRYTLQQTLYATYGNWEFYNYAFALQSYLYQNQWDLFSQLHHIIKNNQVIQYDQYRTTVSKDVTLNVAYQNYMQLLIDHQNEYTDSAVSDEYLQQPTAKPLADVQKEITKIIPLQNANMTEQTSDFFHTFTLQGTYTGMKTAGAESDWRNLNTVLDTILEQLSAKPWNGYKTMTAYFTNYRVNTNNQIECEIVFQGIANNIVESKEPNESIQEATPLPFRTNFIGHFDANNSLDMYQLNVQSPNKLAIEVINQHQIQMNWVLYHEKNLKNPVAYAKFQGQQLFETYTAQPGKYYLYVYSYDNRPGRYQGLVTIE

SEQ ID NO: 28293 - protein, 785 aa, Bacillus cereus VD154
MKKSKKMLAGATLAIGVIAPQVMPTTAHADENAGESTVNLRILETSDIHVNLMNYDYYQTKTDNKVGLVQTATLVNKAREEAKNSVLFDDGDALQGTPLGDYVANKIKDPKNPVDPSYTHPLYRVMNLMKYDVISLGNHEFNYGLDYLNKVIEKTDFPVINSNVYKDDHDDKEENDENYFKPYHILKKEVVDEAGQKQIVKIGVMGFVPPQIMNWDKANLEGKVKAKDIVATAKIMVKKMQDEGADIIVALAHSGVDKSEYKEANKMENASYHLATQVPGVDAVLMGHSHTEVQDVFNGVPVVMPGVFGSNLGIIDMQLKKVNGKWEVQKDQSKPQLRPIANSKGTPLVESDQKLVNEIKDEHEKTIEYVNTHVGETKAPINSYFSLVQDDPSVQIVTNAQKWYVEQELKKPEYEKIKDIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANANRIVNMTYEGKPVADKQEFIVATNNYRGSSQTFPGVSKGEVVYQSQDETRQIIVKYMQKIKDIDPAADQNWTFKPIVADKLNTTFDSSPNAQKYIKKDGKISYVGPSENEFAKYAIDITKKNDDKETGEGNPTTPPTGGGENPTTPPKGDGENPTTPPTGNGENPTPPTEEGNNGNEPKQDGNNTESGQTTTDDQNTKETTTVSENKEAEKDERDLPKTGASIASTIGAGLAFVGAGLLLLFRRKKANR

SEQ ID NO: 28294 - protein, 336 aa, Bacillus cereus VD154; identical to SEQ ID NO: 26633

SEQ ID NO: 28295 - protein, 893 aa, Bacillus cereus VD154
MGNKKEIAIVALTTGFVLTSVTPYGVGHAEEPGQMQVEIQEDSFRTGDLTQPSKKAPENVVKDALKENTEHALSLKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGKKVVSVVHVWDSGGTNDPENWQNAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLMAQGGTHNGVNVNGIGEDRMFDIFYYANTDELNMTSNFSELKLACLKVATNKYGANSIEVQAVQNAFDAAKITRTVKENEKTAENQAPELTVPFTITLRVGDTFDPMRNVKAVDKEDGDLTNKVKHKGDVDTSKPGTYIVEYLVVDSQGRNTTARQTVIVEGNGETSDLEPKLTVPVGATIHVGDSFVPMAEVLTIDKEDGDLTSKIKVDGEVDTTKAGTYVLTYTVTDSKGHEVTAKQTVTVKVREEVKNDKPILKVPATTSITEGDQFDPLVGVSATDKEDGDLISKVAYEGTIDTTKAGTYEIIYSVRDSVGNEVNAIQKVLVKDKETSKANGLANKENKSNISNNSNSDKKEYTYKELPKTGVSTTNSAAIGILMIITGIVLTFVRKFRKIQK

SEQ ID NO: 28296 - protein, 282 aa, Bacillus cereus VD154
MKNKHMLNLCSVCIGMMALLSIPIHTSAETVTSNQQCHSTNPLDFHSTCKSEATAWGNELFNLWNKLTPQVEKDAIRGYTATDYISINGYLRSDYYDVLDQAKIEKSIKQIDRAFSKVRLHDDIIVYRRVSEQAFGLPGNSLVNHAEQEENPVNSVSKINRENFEFFKNRFQGKYKKDPAYISTSIVKDAAEGFSGAPILMKIHVPKGVPAIYVDPLSNVPGEMELLFPRNRSYKITNISPVIEKDREYIMMDVEILDISSNYLNKRATNIVYDDSLPSLSK

SEQ ID NO: 28297 - protein, 1014 aa, Bacillus cereus VD154
MNKKSKINKVMLSISTMALSLGALQTHAVAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYITYVNDRMKGQAIYDIMQGIDYDMQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRTNDVKNYDAYRENLSKDPKLNKEYQEYMQQLIDNQDKYNVPEVADDYLAEHAPKSLTEVKKEISDTLPMNDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSVEVNPVHVYEREGSYKVSLRVKDDKGKESRSETTVTIKDGSLTESEPNNRPEEANRIGLNSTIKGNLIGEDHTDVYTFNVASAKDIDISVLNEYGIGMTWVLHHESDMQNYAAYGQANGNHIEAKFNAKPGKYYLSDHGGFSPYNKHFKCKIRSIRPQFAHVNLKRYRIVVQQFLPWISLHVNKHLLSCQSWHVLSVLKHI

SEQ ID NO: 28298 - protein, 163 aa, Bacillus cereus VD154; identical to SEQ ID NO: 26509

SEQ ID NO: 28299 - protein, 179 aa, Bacillus cereus VD154; identical to SEQ ID NO: 26496

SEQ ID NO: 28300 - protein, 970 aa, Bacillus cereus VD154
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNVNNESVGKITTGADGMAELNNLPIGTYTLKEIKAPTGYVSDDKPQTIEVKTGETGAVQIVNNKVKGSIEIKKLSDSGKILPNVEFTVFTEDGKEVKKVVTKENGIANVEGLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPHGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIKTTATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGSKELDISKSVTIQDKVEYKDLIAGKEYVVKGKLMDKATNKPLLVDGKEVTVESKFTAKEKNGSITLDFTFNASALQGKEVVVFEELYQDNILVAIHAEIEDKGQTVKFKEVKPEQPKPEQQNSDKNTPTPEQPNEQVKEQPQPKQEIQSKIGWLPQTGTNLTSWISMVAGALLLIVGGVIFLKRKNA

SEQ ID NO: 28301 - protein, 971 aa, Bacillus cereus VD154
MKGYSKKMLVGVSFASLMLGSFQGVSLAEDTKGEQVSYRNLLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLMMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKSVSDIAAEITAEAKLKNVSVKKNESQFFNTFTLQGTYTGTTAKGEYEDWKTITQNVNDTLKRLSAKEWTGYKTVTAYFVNYRVNASGQFEYDVVFHGINTEEGAENKAPVAVINGPYSGNVNEAISFKSDGSKDEDGKITLYRWEFGDGAVSNEQNPTHVYTKEGTYTTKLTVTDDKGATNTATATVTVQKKEDNSVEKEPNNSFQTANKLQLNQVLRASLGNGDTSDFFEINVENAKNLQINVTNENNIGMNWVLYSAADLNNYVTYAQQQGNKLVGSYYTYPGKYYLHVYQYGGGTGNYTVEVK

SEQ ID NO: 28302 - protein, 136 aa, Bacillus cereus VD154
PEVKPEDPKEPKEPEVKPEDPKEPKEPEVKPEDPKEPKEPEVKPEDPKEPKEPEVKPEDPKEPKEPEVKPEDPKEPKEPEVKPEVRLEKLIKEPQVKTERELPKTGAASPWMMSVGAGISFLVGGVLFVLGRRRKQ

SEQ ID NO: 28303 - protein, 431 aa, Bacillus cereus VD154; identical to SEQ ID NO: 26472

SEQ ID NO: 28304 - protein, 348 aa, Bacillus cereus VD154
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAEKIQYVFAKGCGPDNLSNKGFVYTKIKKNDRFVHVIGTHLQAEDSMCGKTSPASVRTNQLKEIQDFIKNKNIPNNEYVLIGGDMNVNKINAENNNDSEYASMFKTLNASVPSYTGHTATWDATTNSIAKYNFPDSPAEYLDYIIASKDHANPSYIENKVLQPKSPQWTVTSWFQKYTYNDYSDHCELHNINLLKGVGHELVTKMINLVP

SEQ ID NO: 28305 - protein, 960 aa, Bacillus cereus VD154
MNKNLKFTQMMIGISTVALSFGSIQTQVSAEEKVPYNILQIKPIGTETSKDEIVHATKTDETLTFEERLKVGDFSQRPTLVMKRDEIQLKQSYSLAELNKMPDSELIDTLSKISWNQITDLFQFNQDTKAFYQNKERMNVIINELGQRGKTFTKENSKGIETFVEVLRSAFYVGYYNNELSYLKERSFHDKCLPALKAIARNPNFALGTAEQDRVIAAYGKLISNASSDTETVQYAVNILKQYNDNLSTYVSNYAKGQAVYEIVKGIDYDIQSYLQDTNKKPNETMWYGKIDNFINEVSRIALVGNITNENSWLINNGIYYAGRLGKFDSNPNKGLEVITQAMNLYPRLSGAYFVAVEQMKTNYGGKDYSGNAVDLQKIREEGKQQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTVKQTLFSKYGSWDFYKYSFALQSYLYNHQFETFDKLQDLIRANDVKKYDSYRESLSNNTQLNAEYQAYMQQLIDNQDKYNIPQVTNDYLIQHAPKPLAEVKNEIVDVANIKDAQITKYESQFFNTFIVEGKYTGGTSKGESEDWKTMSKKVNQTLEQLSQKGWSGYKTVTAYFVNYRVNAANQFEYDIVFHGVATEEKEKTTTIVNMNGPYSGIVNEEIQFHSDGTKSENGKVISYLWNFGDGTTSTEANPTHVYGEKGTYTVELTVKDSRGKESKEQTKITVKQDPQIGESLEEEKVLPFNKLVKGNLITPDQTDVYTFNVTDPKEVEISVVNEQNIGMTWILYHESDMQNYVACGEDEGNTIKGKFVAKPGKYYLNVYKFDDKNGEYSLLVK

SEQ ID NO: 28306 - protein, 176 aa, Bacillus cereus VD154; identical to SEQ ID NO: 26630

SEQ ID NO: 28307 - protein, 370 aa, Bacillus cereus VD154; identical to SEQ ID NO: 26909

SEQ ID NO: 28308 - protein, 878 aa, Bacillus cereus VD154
MVKYSKISKWILGVGLVTITCNGLQIQAETKEQNVKNVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNSNFKLGTSEQNKIIASYGKLIGNASADVETVLYAGEIFKQYNDNLATFIEDRTKGDAIYELMKGIDFDIQTDMYTTGKEPKDTMWFRNIDNFINEVNRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDVTSDITNEAKLKDVKVTKNKSQFFNTFTLQGTYTGSVAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 28309 - protein, 503 aa, Bacillus cereus VD154
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKAEGTGKVFLPNPVVSSGSLVGLKDNNDADSTALTNQLKTVTLKGLDGTGFLIGEYVTISSKARTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAVAYSSSDPTCLRRLDTNKVYPKDITNEVHDDGEIWAQGQYEMAQAFGRDVATKIILQSHWSLTPNSKFSDGAKAIKQADALLYGGQHAADIDRIWAARGISTN

SEQ ID NO: 28310 - protein, 553 aa, Bacillus cereus VD154
MKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVSGPPHVNLNPNTYTVDIPLTNKEGKVLNYDVHMYPKNEIKRGAVDLIKTGVNEKALAGAVFSLFKKDGTEVKKELATDANGHIRVQGLEYGEYYFQETKPPKGYVIDPTKREFFVKNSGTINEDGTITSGTVVKLEVKNYEEPTIDKKINGKLEALPINPLTNYNYDIKTLIPEDIKEYKKYVVTDTLDNRLVIQGKPIVKIDGAEVNANVVEVAIEDQKVTATVKDFTKLDGKKEFHLQIKSQVKEGVPSGSEIFNTAKIHFTNKNDVIGEKESKPVVVIPTTGIIELTKIDGANKNKLKGVEFVLKDNNGKIVVVAGKEVTGVSDENGIIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 28311 - protein, 455 aa, Bacillus cereus VD154
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVIGTHFIDKKLQPSTEYSYTVKAIDAAGNVSKESTALTVKTTVEIPDTEAPTQPKGLHSMGTTASSVDLMWSPSDDNIGVDHYDIYRETEGSMKKIATSNTASYMDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 28312 - protein, 430 aa, Bacillus cereus VD156
EIKKGMTEVLSLKIENEMVDTGNVEITKIDKDNKAPLAGVVFEVQDDKGKVVTKVTTDKAGKAIVADLSVGKYKLVEVESLPGYKKLEKPVLFEITKGMTKSLAFTVENEMVDTGNVEITKIDKDSKAPLENVVFEVRDSKGKVVAKVTTDKEGKADVSDLSIGKYELVEVETPAGYKPLEKPVSFEIKKGMTKVLSLKVENEQLDKGSVEITKMAAESKEVLSGAVFEVHDEKGKVVVKVTTDKDGKAKIADLSVGNYTLVEVEAPKGYEKLTNPIPFEITNGMINAVQLEVLNKLNHLAPPGPETPDPENPGTPDPENPGIPDPENPGTPDPENPGTPDPENPETPDPENPGTTNPENPGTPNSEKPGTPNSENPGTPDPEKPGTQNPEKPEKELPKTGQKMPVEPYMGALLVMMSFGLLVLGRKQQR

SEQ ID NO: 28313 - protein, 333 aa, Bacillus cereus VD156
MKGKLLKGVLSLGVGLGALYSGTSAQAEASTNQNDTLKVMTHNVYMLSTNLYPNWGQTERADLIGAADYIKNQDVVILNEVFDNSASDRLLGNLKKEYPNQTAVLGRSSGSKWDKTLGNYSSSTPEDGGVAIVSKWPIAEKIQYVFAKGCGPDNLSNKGFVYTKIKKNDRFIHVIGTHLQAEDSMCGKTSPASVRTDQLKEIQDFIKNKNIPKNEYVLIGGDMNVNKINTENKNDSEYASMFKTLNASVPSYTGHTATWDATTNSIAKYNFPDSPAEYLDYIIASKDHANPSYIENKVLQPKSPQWTVTSWFQKYTYNDYSDHYPVEATLSMK

SEQ ID NO: 28314 - protein, 370 aa, Bacillus cereus VD156; identical to SEQ ID NO: 28110

SEQ ID NO: 28315 - protein, 455 aa, Bacillus cereus VD156
MNNRFLKQLQNMKMNKKSLGVVVLTAGIIGTTIIPQNASAHGFVEKPGSRSALCSATYGALNGNCGSVMYEPQSLEAPKGFPQGGPADGQIASAGGKFGGILDQQTAGRWFKNTITGGENTFTWKYTAPHLTSKWHYYITKKGWNPNKALTRADFEPIGTVQHDGSTASNNLTHKINVPTDRSGYHVILAVWDVADTANAFYNVIDVNLINDVKPDIEAPSIPDGLQTQKVTANSIELTWNASTDNIGVKGYQIFRNGEMIDTVPGTHFIDKKLQASTEYSYTVKAIDAAGNVSKESQSLTVKTTVETPDTEAPTQPKGLHSMGTTTSSVDLMWSPSDDNIGVDHYDIYRETEGSMKKIATANTTSYMDKNLLANTTYKYVVKAVDVAGNESVQSDVFTITTKTENDSYEEWNAKKAYKKGDRVLHEGKIYEAVQSYQGNGDANWIYALSLWKTV

SEQ ID NO: 28316 - protein, 336 aa, Bacillus cereus VD156; identical to SEQ ID NO: 28107

SEQ ID NO: 28317 - protein, 166 aa, Bacillus cereus VD156
MQTTDEAKTKENTKQKNTEQTKEKSKIKEKEYAVNKNFHTPKFDVTVKRVVERDKVGKESIGFQKPEDGHVFIVVEAEGKNITNEPMKLAVLPSVDLVDENDNAYQSDVLAASSYAVEKGETSTITKGLKPGEVMRESKVYVINKEKFDTGKWYVVVNREYKEQIK

SEQ ID NO: 28318 - protein, 55 aa, Bacillus cereus VD156; identical to SEQ ID NO: 26651

SEQ ID NO: 28319 - protein, 179 aa, Bacillus cereus VD156; identical to SEQ ID NO: 26847

SEQ ID NO: 28320 - protein, 457 aa, Bacillus cereus VD156
MNKKFFKQLKKMATNKKGLSAAAVAVGIMGTTLIPQNAYAHGFVEKPGSRAALCSQNYGALNSNCGNIMYEPQSLEAPKGFPQGGPADGKIASAGGLFGGILDQQTADRWFKNTIKGGENTFTWKYTAPHSTSQWHYYITKKGWNPNKPLTRMDFEPIGTVKHDGSAASNNLSHKINVPTDRSGYHVILAVWDVADTVNAFYNVIDVNLINNEKTDTEAPTQPSGVQVVKATSNSVELSWKPAIDNVGVKEYQVLRNGQLINTIVGTSVVDKKLSPNTEYTYTVKAVDAAGNISRESEALVVKTTVEKPDTEAPTQPKGLHSMGTTTNSIDLMWSPSEDNIDVNHYIVYREVGGVMKEIGTANTTSFMDKDLQANTIYKYVVSAVDTAGNESMKSDALTIATKGQENTYEQWGAYKAYKKGDKVVHEGKVYEAVQSYQGNGDPNWIFALSLWNEVNK

SEQ ID NO: 28321 - protein, 172 aa, Bacillus cereus VD156; identical to SEQ ID NO: 28096

SEQ ID NO: 28322 - protein, 458 aa, Bacillus cereus VD156
MNLKLTSKLERLRKSKKGIGACVLAAGVTAITMIPQSAYAHGFVEKPSSRAALCSQNYGSLNLNCGNIMYEPQSLEAPKGFPDGGPIDGKIASAGGLFGGILDQQTSNRWFKNTIKGGANTFTWKYTAAHPTSKWHYYITKKGWDPNKPLTRAELEPIGTVKHDGSAASNNLTHTINVPTDRNGYHVILAVWDVEDTSNAFYNVIDVNLVNNETPDTVAPSQPTELNASKVSANSVEITWKASTDNIGVKEYQVLRNGELIDTVPGTTFIDKKLKADTEYTYTIKALDSVENISKESEKLKVKTTHAIPDIEAPTQPKGLHSMGTTATTVDLMWSPSEDNVSVDHYIVYRESAGVMNKIGTAANTSFMDKDLKANTSYKYVVTAVDLAGNESSRSDVLNVTTKSEDSTYEKWDARKAYTKGDRVVHEGKVYEAVQDHQGNGDSNWIFALSLWKPVLNK

SEQ ID NO: 28323 - protein, 960 aa, Bacillus cereus VD156
MNKKSKFTQMMLSISTMALSFGSIQTQVSAEEKAPYNVLQIKPIGAETSKDEIVHTTKADETLTFEERLKVGDFSQRPTLVMKRDENQLKQSYTLAELNKMPDSELIDTLSKISWNQITDLFQFNQDTKAFYQNKERMNIIINELGQRGSTFTKENSGGIETFVEVLRSAFYVGYYNNELSYLKERSFHNKCLPALKAIAKNPNFTLGTAEQDRVVAAYGKLIGNASSDTETVQYAVNILKQYNDNLSTYVSDYAKGQAVYEIVKGIDYDIQSYLQDTNKKPNETMWYGKIDTFINEVNRIALVGNITNENSWLINNGIYYAGRLGKFHSNPSKGVEVITQAMSLYPRLSGPYFVAVEQIKTNYGGKDYSGNAVDLQKIREEGKQQYLPKTYTFDDGSIVFKTGDKVTEEKIKRLYWAAKEVKAQYHRVIGNDKALEPGNADDVLTIVIYNDPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFETFDKLQDLIRANDVKNYDSYRESLSNNTQLNAEYQAYMQQLIDNQDKYNVPQVTNDYLIQHAPKPLAEVKNEIVDVANIKDAKITKYESQFFNTFTVEGKYTGGTSKGESEDWKTMSKQVNRTLEQLSQKGWSGYKTVTAYFVNYCVNAANQFEYDIVFHGVATEEKEKTNTIVNMNGPYSGIVNEEIQFHSDGTTSENGKVTSYLWNFGDGTTSTEANPTHVYGEKGTYTVELTVKDSRGKESKEQTKVTVKQDPQTGESYEEEKVLPFNTLVKGNLITPDQTDVYTFNVTDPKEVEISVVNEQNIGMTWVLYHESDMQNYVACGEDEGNTIKGKFVAKPGKYYLNVYKFDDKNGEYSLLVK

SEQ ID NO: 28324 - protein, 965 aa, Bacillus cereus VD156
MNKKSKINKVMISISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIANNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNREYQEYMQQLIDNQDTYTVPEVADDYLAEHATKSLAAVKNEISDTLPMKDAKMTKHSSQFFNTFTLEGTFTGNVTKGESEDWKAMSKRVNEALEQLAQKEWSGYKTVTAYFVNYRVNSSNEFEYDVVFHGIAKDDGENKAPTVNINGPYSGLVKEGIQFKSDGSNDEDGKIVSYLWEFGDGSTSAEVNPVHVYEREGSYKVSLRVKDDKGKESRSETTVTIKDGSLTESEPNNRPEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYSLSVK

SEQ ID NO: 28325 - protein, 1093 aa, Bacillus cereus VD156
MGKRVIIRVFTLLSVLVLFLNVFLPRASAEVMTHEKYSMDWSYSNSLAKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNTNNESVGKITTGADGMAELNNLPIGTYTLKEIKAPTGYVSDDKPQTIEVKTGETGAVQIVNNKVKGNIEIKKLSDSGKILPNVEFTVFTEDGREVKKVVTKENGIANVEGLTYGKYYFLETKTPNGYVGNKTKYPFEIKEHNKTLTFTVENTEVKGSVKLLKVDNEDISKKLEGAVFELKDESGKVVGKYKTDKNGEINVKDLAYGKYSFVEKASPNGYVLVKEQIVFEIKEHGKIIELLAVNHLIKGDLEITKVDVADGNNKLPNAEFTIYNEVGKEVVKGKTDDKGIAKFEKLPFGKYTYNETIAPKGYVLNEETFCFEIKENGQIIKHIVKDEKIPSIKTTATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSIKTTATNKADGGKEIHSKDSITIQDKVEYTNLVVGKEYTVKGKLMNKAINKPLLIDGKEVTAETKFTAKEKNGFVTLDFTFAGAEQQGREVVVFEDLLHEGQVIATHADINDVGQTVRFVEPSIKTTATNKADGSKELDVSKSVTIQDKVEYKDLIVGKEYVVKGKLMDKATNKPLLVDGKEVTVESKFTAKEKNGSITLDFILNASELQGKEVVVFEELYQDNILVAIHAEIEDKGQTVKFKEGKSEQPKPEQPNSGKNTPTPEQPNEQVKEQPQLKKEIQSKIGWLPQTGTNLTSWISMAAGALLLIVGGVIFLKRKNA

SEQ ID NO: 28326 - protein, 163 aa, Bacillus cereus VD156; identical to SEQ ID NO: 28100

SEQ ID NO: 28327 - protein, 503 aa, Bacillus cereus VD156
MFNKKMVAMAMTVPLVMGTISTVSALEKQQQVKLEAYSPQKKATEYLKENAAQYGLKTDLSDLQYISTTETSVASYVRFQQVVNGAPVFSKQITVTLNGEGKGVLAVSDYQPVTGVKEVTTKISEKDAIQKSMAYVGEASEQNLWAPTDKEFGYIVEEGIARPVYKVVVHSNNPFGAWETFIDAENGKLIKKVDINRKVEGTGKVFLPNPVVSSGSLVGLKDNNDADSTALTNQLKTVTLKGLDGTGFLIGEYVTISSKARTKSTNLQFNYTRANDSFEDVMSYYHIDTLQRYIQSLGFKNINNRSIKVNVNGTTADNSFYSPTTKALTFGTGGVDDAEDAGIIAHEYGHSIQDNQVPGFGSSTEGGAMGEGFGDFLGATYEDAVSTTGYGKACVGEWDAAAYSSSDPTCLRRLDTNKAYPKDIKNQVHADGEIWSQGQYEMAQAFGRDVATKIILQSHWSLTPNSKFSDGAKAIKQADALLYGGQHAADIDRIWAARGISTN

SEQ ID NO: 28328 - protein, 893 aa, Bacillus cereus VD156
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDIKFISEPEVKAVIFVDENHGQASNAYQVTFAATTPNYVSGTYLVNAHNGDMLKDMVQESSLKISEEYVESVKENKTSNFTSLTGTGKDDLGVTRTFGISKQTSGNYALADYTRGQGIETYDVNYRDITNEESYYPGILATSASTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLIAQGGTHNGVNINGIGEDKMFDIFYYANTDELNMTSNFSELKLACLKVATNKYGTNSIEVQAVQNAFDAAKIPGTVKENEKTAENQAPELTVPFTITLRVGDTFDPMRNVKAVDKEDGDLTNKVKHKGDVDTSKPGTYIVEYLVVDSQGRTTTARQTVIVEGNGEILDLEPKLTVPVGATMHVGDSFDPMIKVKAIDKEDGDLTSKVKVDGGVDTSKVGTYVLTYTVTDSKGHEVTAKQTVTVKVREEVTNEKPILKVPATTSITEGDQFDPLVGVSATDKEDGDLTSQVAYEGTIDTTKAGTYEIIYSVKDSMGNDVNTKQKVLVKDKETSKANGLANKANKSNISNNSNSDKKEYTYKELPKTGVSTNNSAAIGILMIITGTVLTFVRKFRKIQK

SEQ ID NO: 28329 - protein, 212 aa, Bacillus cereus VD156
MKPEEPKEPEVKSEEPKEPKEPEVKPEEPKEPKEPEVKPEEPKEPKEPEVKPEEPKEPKEPKEPKEPEVKPEEPKEPKEPEVKPEEPKEPKEPEVKPEEPKEPKEPEVKPEEPKEPKEPEMKPEEPKEPEVKPEEPKEPKEPEMKPKDLEKPEVKPEKPEVRLEKLIKEPQVKVEKELPKTGAAHSWMMSVGAGISFLVGGVLFVLGRRRKQ

SEQ ID NO: 28330 - protein, 563 aa, Bacillus cereus VD156
MIQVVKGKREMKKIFSVLLVFFLTFSTWSSVLVKADSPSKGTLTIHKYEQEKDGAQGLEGNGSANQEVPKDVKPLKGVTFEVKRVASFEKISNDGKIVKEDVKPVMGATPNQVVTDDNGQAVLKDLPLRRYEVKEVAGPPHVNLNPNTYTVDIPLTNKEGKVLNYDVHMYPKNEIKRGAVDLVKTGVNEKVLAGAVFSLFKKDGTEVKKELVTDANGHIRVQGLEYGEYYFQETKAPKGYVIDPTKREFFVKNSGTINEDGTITSGTVVKLEVKNYEEATIDKKINAKLEALPINPLTNYNYDIKTLIPEDIKEYKKYVVTDTLDNRLVIQGKPIVKIDGAEVNANFVELAIEGQKVTATVKDFTKLDGKKEFHLQIKSQVKEGVPSGSEILNTAKIDFTNKNDVMGEKESKPVVVVPTTRIIELTKIDGANKNKLKGAEFVLKDHNGKIVVVAGKEVTGVSDEHGVIKWSNIPYGDYQIFETKAPTYTKEDGTKASYQLLKDPIDVKISENNQTVKLTIENNKSGWILPVTGGIGTTLFTVIGLTLMLTAALVFFRKKFARN

SEQ ID NO: 28331 - protein, 455 aa, Bacillus cereus VD156
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTKKVTANSVELTWNSSTDNVGVKGYQIFRNGEMIDTILGTHFIDKKLQPSTEHSYTVKAIDAAGNVSKESTALTVKTTVATPDTEAPTQPKGLHSMGTTASSVDLMWSPSDDNIGVDHYDIYREIEGLMKKIATSNTTSYMDKNLLANTTYKYVVKAVDVAGNESVQSDIFTITTKAESASYEAWDAKKAYKKGDRVLHEGKVYEAVQSYQGNGDPNWIYALSLWKTV

SEQ ID NO: 28332 - protein, 971 aa, Bacillus cereus VD156; identical to SEQ ID NO: 28109

SEQ ID NO: 28333 - protein, 431 aa, Bacillus cereus VD156; identical to SEQ ID NO: 26534

SEQ ID NO: 28334 - protein, 172 aa, Bacillus cereus VD166; identical to SEQ ID NO: 28096

SEQ ID NO: 28335 - protein, 336 aa, Bacillus cereus VD166
MKRSKTYLKCLALSAVFASSALTLSTPAAYAQTTSQVVTDIGQNAKTHTSYNTFNNDQTDNMTMSLKVTFIDDPSADKQIAVINTTGSFLKANPTISDAPIDNYLIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLIPMDQLPALTNSGFSPGMIAVVISEKNTDQSNLQVAYTKHADDYQLRPGFTFGTANWVGNNVKDVDQKTFNKLFTLDWKNKKLVEKK

SEQ ID NO: 28336 - protein, 572 aa, Bacillus cereus VD166; identical to SEQ ID NO: 26803

SEQ ID NO: 28337 - protein, 893 aa, Bacillus cereus VD166
MGNKKEIAIVALTTGFVLTSVTLYGVGHAEEPGQMQVEIQEDSFRTGNLTQPSKKAPENVVKDALKENTEHALSPKQVSAETGVDYKVLQKRGSYDGTTLVRMQQIYEGKEVYGHQLTAHVDKKGIIKSISGASAQNLTQEDLKKPINLSKEEAKQYIYKKYGNDTKFISEPEVKAVIFVDQNHGEASNAYQVTFAATTPNYVSGTYLVNAHNGEMLKDMVQESSLKISEEYVESVKENKTSNFTSLTGTGKDDLGVTRTFGISKQTSGNYALADYTRGQGIETYDVNYRDITNEESYYPGILATSVSTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLMAQGGTHNGVNVNGIGEDRMFDIFYYANTDELNMTSNFSELKLACLKVATNKYGANSIEVQAVQNAFDAAKITGTVKENEKTAENQAPELTVPFTITLRVGDTFDPMRNVKAVDKEDGDLTNKVKHKGDVDTSKPGTYIVEYLVVDSQGRNTTARQTVIVEGNGETSDLEPKLIVPVGATIHVGDSFVPMAEVLAIDKEDGDLTSKIKVDGEVDITKAGTYVLTYTVTDSKGHEVTAKQTVTVKVREEVKNDKPILKVPATTSITEGDQFDPLVGVSATDKEDGDLISKVAYEGTIDTTKAGTYEIIYSVRDSVGNEVNAIQKVLVKDKETSKANGLANKENKSNISNNSNSDKKEYTYKELPKTGVSTTNSAAIGILMIITGTVLTFVRKFRKIQK

SEQ ID NO: 28338 - protein, 370 aa, Bacillus cereus VD166
MKTKQTIAASTLALAMIAGANSTHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNNNAKELPNAGSEQSNNMALGMLSVLGGILLLTRNKIKTLFSK

SEQ ID NO: 28339 - protein, 446 aa, Bacillus cereus VD166
MATNKKGLSAAAVAVGIMGTTLISQNAYAHGFVEKPGSRAALCSQNYGALNSNCGNIMYEPQSLEAPKGFPQGGPADGKIASAGGLFGGILDQQTADRWFKNTIKGGENTFTWKYTAPHSTSQWHYYITKKGWNPNKPLTRVDFEPIGTVKHDGSAASNNLSHKINVPTDRSGYHVILAVWDVADTVNAFYNVIDVNLINNEKPDTEAPTQPSGVQVVKATSNSVELSWKPAIDNVGVKEYQVLRNGQLINTVVGTSVVDKKLSSNTEYTYTVKAVDAAGNISRESEALVVKTTVEKPDTEAPTQPKGLHSMGTTANSIDLMWSPSEDNIDVNHYIVYREDGGVMKEIGTANTTSFTDKDLRANTIYKYVVSAVDTAGNESMKSDALTIATKGQENTYEQWDAYKAYKKGDKVVHEGKVYEAVQSYQGNGDPNWIFALSLWNEVNK

SEQ ID NO: 28340 - protein, 431 aa, Bacillus cereus VD166; identical to SEQ ID NO: 26472

SEQ ID NO: 28341 - protein, 357 aa, Bacillus cereus VD166
MKLRKIFMICFLFIFTLTIVIGCSSSQSSTTVKNGKASSSSKNVEIEVENAEYVLPLSGSMGGINKDKVLKFKVSLKNKGDEMLEISPYLFTLYQGDEKMKKYDKADSDKLRLIELEPGKKTSGILYYEVNKASSYELVYSNEETKKRDDETEKVSFKIDTQEIEKNTKDLNKPAEALKTYINAVYYDKDIDKINELSGEDGKQFTQNIHQEFKKDAMSSTHNGISDQEFESYYKKLKSVLQEKVTFTVKSVGSSPEEDKVEVELKVKPLLLSELQPKLNKKNEKLLKENPGIEQPKLFSQSFSYFISILPEAKVSDKEKVIKVEMERYGKEQWRFSKGKVTDSEDVMEIMGEFLKQ

SEQ ID NO: 28342 - protein, 965 aa, Bacillus cereus VD166
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTSENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHAPKSLTEVKKEISDTLPMNDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSVEVNPVHVYEREGSYKVSLRVKDDKGKESRSETTVTIKDGSLTESEPNNRPEEANRIGLNSTIKGHLIGEDHTDVYTFNVASAKDIDISVLNEYGIGMTWVLHHESDMQNYAAYGQANGNHIEAKFNAKPGKYYLYVYKYDNGDGTYSLSVK

SEQ ID NO: 28343 - protein, 333 aa, Bacillus cereus VD166; identical to SEQ ID NO: 27898

SEQ ID NO: 28344 - protein, 458 aa, Bacillus cereus VD166
MNLKLTSKLERLRKSKKGIGACVLAAGVTAITMIPQSAYAHGFVEKPSSRAALCSQNYGALNLNCGNVMYEPQSLEAPKGFPDGGPIDGKIASAGGLFGGNLDQQTTNRWFKNTIKGGANTFTWKYTAAHSTSKWHYYITKKGWDPNKPLTRAELEPIGTVKHDGSAASNNLTQTINVPTDRNGYHVILAVWDVADTSNAFYNVIDVNLVNNETPDTVAPSQPTELNASKVSANSVEITWKASTDNIGVKEYQVLRNGEVIDTVPGTTFIDKKLKADTEYTYTIKALDSAGNISKESEKLKVKTTHAIPDIEAPSQPKGLHSMGTTATTVDLMWSPSEDNVGVDHYIVYRESAGVMNKIGTAANTSFMDKDLKANTSYKYVVTAVDLAGNESSRSDVLNVTTKSEDSTYEKWDARKAYTKGDRVVHEGKVYEAVQDHQGNGDSNWIFALSLWKPVLNK

SEQ ID NO: 28345 - protein, 183 aa, Bacillus cereus VD166; identical to SEQ ID NO: 27306

SEQ ID NO: 28346 - protein, 490 aa, Bacillus cereus VD166
QKVLEGVVFEVQDDKGKVVTEVKTDKNGKAKISDLSVGKYKLVEKESLPGYKQLTEPVSFEITKGMTEVLSLNIENEMVDTGNVEITKIDKDNKAPLAGVVFEVQDDKGKVVTKVTTDKAGKATVSDLSVGKYKLVEVESLPGYKKLEKPVPFEITKGMTKSLAFTVENEMVDTGNVEITKIDKDSKTPLENVVFEVRDSKGKVVAKVTTDKEGKANVSDLSVGKYKLVETKSLPGYKKLTEPVSFEITKGMTKVLSLKVENEQLDKGSVEITKMAAESKEVLSGAVFEVHDEKGKVVVKVTTDKDGKAKITDLSVGNYTLVEVEAPKGYEKLTNPIPFEITNGMINAVQLEVLNKLNHLAPPGPETPDPEKPGTPDPEKPGTPDPEKPGTPDPEKPGTPDPEKPGTPDPEKPGTPDPEKPGTPNPEKPGTPDLEKPGTPDPEKPGTPNPEKPEKELPKTGQKMPVEPYMGALLVMMSFGLLVLGRKQQR

SEQ ID NO: 28347 - protein, 163 aa, Bacillus cereus VD166; identical to SEQ ID NO: 26509

SEQ ID NO: 28348 - protein, 503 aa, Bacillus cereus VD166; identical to SEQ ID NO: 28160

SEQ ID NO: 28349 - protein, 455 aa, Bacillus cereus VD166
MNNRFLKQLQNMKMNKKSLGAVALTAGIISTTLIPQNAYAHGFVEKPGSRSALCSPTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVLGTHFIDKKLQPSTEYSYTVKAIDAAGNVSKESAALTVKTTVETPDTEAPTQPKGLHSMGTTASSVDLMWSPSDDNIGVDHYDIYRETEGAMNKIATSNTTSYLDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 28350 - protein, 66 aa, Bacillus cereus VD166
EDPKEPKEPEVKPEVRLEKLIKEPQVKTERELPKTGAASPWMMSVGAGISFLVGGVLFVLGRRRKQ

SEQ ID NO: 28351 - protein, 553 aa, Bacillus cereus VD166
MKKIFSVLLVLFLTFSTWSSVLVKADSPSKGTLTIHKYEQEKDGAQGLEGDGSANQEVPKDVKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEIKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPTIDKKINGKLEALLINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDGANKNKLKGAEFVLKDNNGKIVVVAGKEVTGVSDENGVIKWSNIPYGDYQIFETKAPTYTKEDGTKASYQLLKDPIDVKISENNQTVKLTIENNKSGWILPVTGGIGTTLFTVIGLTLMLTAAFVFFRKKFARN

SEQ ID NO: 28352 - protein, 91 aa, Bacillus cereus VD166; identical to SEQ ID NO: 26808

SEQ ID NO: 28353 - protein, 960 aa, Bacillus cereus VD166
MNKNLRFTQMMIGISTMALSFGSIQTQVSAEETAPYNILQMKPMGTETSKDEIVHATKADETLNFEERLKIGDFSQRPTLVMKRDEIQLKQSYTLAELNKMPNSELIDTLSKISWNQITDLFQFNQDTKAFYQNKERMNVIINELGQRGRTFTKENSKGIETFVEVLRSAFYVGYYNNELSYLKERSFHDKCLPALKAIAKNRNFTLGTAEQDRVVTAYGKLIGNASSDTETVQYAVNVLKHYNDNLSTYVSDYAKGQAVYEIVKGIDYDIQSYLQDTNKQPNETMWYGKIDNFINEVSRIALVGNITNENSWLINNGIYYAGRLGKFHSNPYKGLEVITQSMSLYPRLSGPYFVAVEQMKTNYGGKDYSGNAVDLQKIREEGKRQYLPKTYTFDDGSIVFKTGDKVTEEKIKKLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSNPASRYTAKQTLFSKYGSWDFYKYSFALQSYLYNHQFETFDKLQDLIRANDVKNYDSYRESLSNNTQLNAEYQAYMQQLIDNQDKYNVPKVTNDYLIQHAPKPLAEVKNEIVDVANIKDAKITKYESQFFNTFTVEGKYTGGTSKGESEDWKAMSKQVNQTLEQLSQKGWSGYKTVTAYFVNYRVNAANQFEYDIVFHGVATEEKEKTTTIVNMNGPYSGIVNEEIQFHSDGTKSENGKVISYLWNFGDGTTSTEANPTHVYGEKGTYTVELTVKDSRGKESKEQTKVTVKQDPQTSESYEEEKVLPFNTLVKGNLITPDQTDVYTFNVTDPKEVDISVVNEQNIGMTWVLYHESDMQNYVACGEDEGNVIKGKFAAKPGKYYLNVYKFDDKNGEYSLLVK

SEQ ID NO: 28354 - protein, 878 aa, Bacillus cereus VD166
MVKYSKISKWILGVGLVTITCNGLQIQAETKEQNVKNVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKIIASYGKLIGNASADVETVLYAGEIFKQYNDNLATFIEDRTKGDAIYELMKGIDFDIQTDMYTTGKEPKDTMWFRNIDNFINEVNRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTIVIYNSPDEYQFNRQLYGYETNNGGIYIEGTGTFFTYERTPEQSIYSLEELFRHEFTHYLQGRYEVQGLWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDVTSDITNEAKLKDVKVTKNKSQFFNTFTLQGTYTGSVAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 28355 - protein, 970 aa, Bacillus cereus VD166
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKIVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNVNNESVGKITTGADGMAELNNLPIGTYTLKEIKAPTGYVSDDKPQTIEVKTGETGAVQIVNNKVKGSIEIKKLSDSGKILPNVEFTVFTEDGKEVKKVVTKENGIANVEGLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIETKATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGSKELDASKSVTIQDKVEYKDLIVGKEYVVKGKLVDKATNKPLLVDGKEVTVESKFTAKEKNGSITLDFTFNASALQGKEVVVFEELYQDNILVAIHAEIEDKGQTVKFKEGKSEQPKPEQPNSGKNTTTPEQPNEQVKEQPQLKKEIQSKIGWLPQTGTNLTSWISMAAGALLLIVGGVIFLKRKNA

SEQ ID NO: 28356 - protein, 775 aa, Bacillus cereus VD166
MKKSKKMLAGATLAIGVIAPQVMPTTAHADENAGESTVNLRILETSDIHVNLMNYDYYQTKTDNKVGLVQTATLVNKAREEAKNSVLFDDGDALQGTPLGDYVANKIKDPKNPVDPSYTHPLYRVMNLMKYDVISLGNHEFNYGLDYLNKVIEKTDFPVINSNVYKDDHDDKEENDENYFKPYHILKKEVVDEAGQKQIVKIGVMGFVPPQIMNWDKANLEGKVKAKDIVATAKIMVKKMQDEGADIIVALAHSGVDKSEYKEANKMENASYHLATQVPGVDAVLMGHSHTEVQDVFNGVPVVMPGVFGSNLGIIDMQLKKVNGKWEVQKDQSKPQLRPIANSKGTPLVESDQKLVNEIKDEHEKTIEYVNTHVGETKAPINSYFSLVQDDPSVQIVTNAQKWYVEQELKKPEYEKIKDIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIVNMTYEGKPVADKQEFIVATNNYRGSSQTFPGVSKGEVVYQSQDETRQIIVKYMQKIKDIDPAADQNWTFKPIVADKLNTTFDSSPNAQKYIKKDGKISYVGPSENEFAKYAIDITKKNDDKETGEGNPTTPPTGGGENPTTPPKGDGENPTTPPTEEGNNGNEPKQDGNNTGSGQTTTDDQNTKETTTVSENKEAEKDERDLPKTGASIASTIGAGLAFVGAGLLLLFRRKKANR

SEQ ID NO: 28357 - protein, 971 aa, Bacillus cereus VD166
MKSYSKKMLVGVSFASLMLGSFQGGSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSILVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSVKEWTGYKTVTAYFVNYRVNASGQFEYDVVFHGIDTEEGAENKAPVAVINGPYSGNVNEAISFTSNGSKDEDGKIISYKWEFGDGAVSNEQNPTHVYTKEGAYTAKLTVTDDKGATNTATATVTVQKKEDNSVEKEPNNSFQTANKLQLNQVLRASLGNGDTSDFFEINVENAKNLQINVTNENNIGMNWVLYSEADLNNYVTYAQQQGNKLVGSYYTYPGKYYLHVYQYGGGTGNYTVEVK

SEQ ID NO: 28358 - protein, 172 aa, Bacillus cereus VD169
MGKIFKFGCLGIIALFVIGIIAMVAGGGDSTEKTSTDTKAVSKEGVSSDVKIAVGSMETVDSVGNEYTKEQAQGVFKILEVTLTNNQKDAITVDANSFKLVDNKGREFTYSTQGQTSFDLANGGKTDFFLKQLNPGLTQTGKIVFDIPKDAEGLFLKASGGMTGKEIKLKVE

SEQ ID NO: 28359 - protein, 960 aa, Bacillus cereus VD169
MNKNLKFTQMMIGIGTVALSFGSIQTQVSAEETAPYNILQMKPMGTETSKDEIVHATKADETLTFEERLKVGDFSQRPTLAMKRDEIQLKQSYTLAELNKMPDNELIDTLSKISWNQITDLFQFNQDTKAFYQNKERMNVIINELGQRGRTFTKEDSKGIETFVEILRSAFYVGYYNNELSYLKDRGFHDKCLPALKALAKNPNFTLGTAEQDRVVAAYGKLIGNASSDTETVQYAVNVLKQYNDNLSTYESDYAKGQAVYEIVKGIDYDIQSYLQDTNKQPNETMWYGKIDNFINEVNRIALVGNITNENSWLINNGIYYTGRLGKFHSNQSKGLEVITQAMSLYPRLSGPYFVAVEQIKTNYGGKDYSGNTVDLQKIREEGKQQYLPKTYTFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFETFDKLQDLIRANDVKKYDSYRESLSNNIQLNAEYQAYMQQLIDNQDKYNVPQVTNDYLIQHAPKPLAEVKNEIVNVANIKDAKITKYESQFFNTFTVEGKYTGGTSKGESEDWKTMSKQVNQTLEQLSQKGWSGYKTVTAYFVNYRVNAANQFEYDIVFHGVATEEKEKTTTIVNMNGPYSGIVNEEIQFHSDGTESENGKVISYLWNFGDGTTSTEANPTHVYGEKGTYTVELIVKDSRGKESKEQTKVTVKQDPQTGGSHEEEKVLPFNKLVKGNLIAPDQTDVYTFNVTVPKEVDISVVNEQNIGMTWVLYHESDMQNYVACGEDEGNAIKGKVVAKPGKYYLNVYKFDDNNGEYSLIVK

SEQ ID NO: 28360 - protein, 412 aa, Bacillus cereus VD169
MKKAKEIAKCVAVASVIMSGSFGLQATSAFADSKGTVENLQNGGKVYNSFKTTYDMKQNIKNSIKVSFIEDPYADKKIAIVTTDGSNIDAKYTINSGYYNAGLKWPSAYHTEAEVTSGDSAQFHKAAPVNTMTSAKVTSEVGYTLGGSVKVGVNDKGPNADASITGSFAWKESVSYDQVDYKTVLETHTDKKLNWKVGFQSFNFPEWGIYNRDSFNTFYGNQLFMKSRSYNEGTNNFVSKDTVPALTGYGFSPNVVAVITADKTETTSDLKITNRRISDQYNIEWVSSKWWGTNNKDTYNEFFTNHYKLDWKNHQVTLDNQKALEEQMNSINSVNDKLNKGKGKLSLSMNGNQLKATSSNAGYGISYEDKNWGIFVNGEKVYTFNEKSTVGNISNDINKLNIKGPYIEIKQI

SEQ ID NO: 28361 - protein, 893 aa, Bacillus cereus VD169
MGNKKEIAIVALTTGFVLTSVTPYGVGHAEEPGQMQVEIQEDSFRTGDLTQPSKKAPENVVKDALKENTEHALSPKQVSAETGVDYKVLQKRGSYDGTTLVRIQQIYEGKEVYGHQLTAHVDKKGIIKSISGASAQNLTQEDLKKPINLSKEEAKQYIYKKYGNDTKFISEPEVKAVIFVDENHGQASNAYQVTFAATTPNYVSGTYLVNAHNGEMLKDMVQESSLKISEEYVESVKENKTSNFTSLTGTGKDDLGVTRTFGISTQTSGNYALADYTRGQGIETYDVNYRDITNEESYYPGILATSVSTTFNDPKAVSAHFLATKVYDFYKEKYKRNSFDNKGKKVVSVVHAWDSGGTNDPENWENAFSTNINNISMLLYGDPMVKAFDIAGHEFTHAVTSSESNLEFSGESGAINEALSDIMGTAIEKYINNGEFNWTIGEQTGSTFRNMKNPTAINFSEGLPYPDDYSKYNDLNGEDYGGVHFNSSIINKVAYLMAQGGTHNGVNVNGIGEDRMFDIFYYANTDELNMTSNFSELKLACLKVATNKYGANSIEVQAVQNAFDAAKITGTVKENEKTAENQAPELTVPFTITLRVGDTFDLMRNVKAVDKEDGDLTNKVKHKGDVDTSKPGTYIVEYLVVDSQGRNTTARQTVIVEGNGETSDLEPKLTVPVGATIHVGDSFVPMAEVLAIDKEDGDLTSKIKVDGEVDTTKAGTYVLTYTVTDSKGHEVTAKQTVTVKVREEVKNDKPILKVPATTSITEGDQFDPLVGVSATDKEDGDLISKVAYEGTIDTTKAGTYEIIYSVRDSVGNEVNAIQKVLVKDKETSKANGLANKENKSNISNNSNSDKKEYTYKELPKTGVSTTNSAAIGILMIITGTVLTFVRKFRKIQK

SEQ ID NO: 28362 - protein, 503 aa, Bacillus cereus VD169; identical to SEQ ID NO: 26634

SEQ ID NO: 28363 - protein, 181 aa, Bacillus cereus VD169; identical to SEQ ID NO: 26799

SEQ ID NO: 28364 - protein, 403 aa, Bacillus cereus VD169
MKRFIGKATIPTVALAAVIGFSPIQTANALEYTTSTSLNIDLDGINIEEGNIAVEGSGLVPEHVEKFKNVAKERNVFIFVRPVNKLATSLIKEGAATKGMNVHGKSSDWGPAAGYIPFDQNLSKKHENKVAVEKGNADNKESLQEHKNEISKVKLKLDDNRIADLEKAGLISIREKISDNGKDYNIIKTENWIYDFRIDRLSHEVQYKTKNGKHTILGEKFGWKDLEVMAKIVNGNNKPLTADYDLFALSPTLTEIKKYIPTQEWEQAVIDKKPLDKLKNITNLLIKYGLKRESFDGMGQMPNWQVDLIDALNKAARDSGYEGGTVVNHATEQDNERFPEQDNEIFIITPNGKLILTKSWKDTRKFIENNIVKNGYFFYFNRIYNKIAPGNQKQIEWTDPTRK

SEQ ID NO: 28365 - protein, 183 aa, Bacillus cereus VD169
MNRVLNNKWIVFTVFLVAFVLFALRLIYVNKPYFNKTQIKVYDMNQSVNLKDLQVKIKDVSVTGTIDGYEGKKTDDDVFLIIDVNFKNNSIEDASLYKDEFMLQYKNLVFPVDIIAFKIINKDSSFLTQKILNSKQEIQGKLVYLVPKKYLDELVLHLPNKLYDLDNIHVKKKIKLELDKNNN

SEQ ID NO: 28366 - protein, 774 aa, Bacillus cereus VD169
MKKSKKMLAGATLAIGVIAPQVMPTTAHADENAGESTVNLRILETSDIHVNLMNYDYYQTKTDNKVGLVQTATLVNKAREEAKNSVLFDDGDALQGTPLGDYVANKIKDPKNPVDPSYTHPLYRVMNLMKYDVISLGNHEFNYGLDYLNKVIEKTDFPVINSNVYIDDHDGNDENDEHYFDKPYHILEKEVVDEAGQKQIVKIGVMGFVPPQIMNWDKANLEGKVKAKDIVQTAKKLVPEMKAQGADIIVALAHSGVDKSGYNEGMENSSFYLATEVPGVDAVLMGHSHTEVKDVFNGVPVVMPGVFGSNLGIIDMQLKKVNGKWEVQKDQSKPQLRPIANSKGTPLVESDQKLVNEIKDEHQATIDYVNTPVGKTKAPINSYFSLVQDDPSVQIVTNAQKWYVEQELKKPEYEKIKNIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIVNMTYEGKPVADKQEFIVATNNYRGSSQTFPGVSKGEVVYQSQDETRQIIVKYMQKIKDIDPAADQNWTFKPIVADKLNTTFDSSPNAQKYIKKDGKISYVGPSENEFAKYAIDITKKNDDKETGEGNPTTPPTGGGENPTTPPKGDGENPTTPPTEEGNNGNEPKQDGNNTGSGQTTTDDQNTKETTTVSENKEAEKDERDLPKTGASIASTIGAGLAFVGAGLLLLFRRKKANR

SEQ ID NO: 28367 - protein, 451 aa, Bacillus cereus VD169
MIKHLKNLKMNKNSLGAVALAAAIIGTTLIPQNAYAHGFVEKPGSRSALCSQTYGALNVNCGSIMYEPQSLEAPKGFPQAGPVDGQIASAGGKFGGILDQQTIDRWFKNTINGGENTFTWKFTAPHLTSKWHYYITKKGWDPNKALTRADFEPIGTVQHDGSAASNNVAHKINVPTDRSGYHVILAVWDVADTVNAFYNVIDVNLINNVKPDTEAPSIPNGLQAQKVTANSIELTWNASTDNVGVKGYQVFRNGEMIDTVPGTHFINKKLQPSMEYTYTVKAIDTAGNVSKESEAFTVKTTVEAPDTEAPTQPKGLHSMGTTASSVDLMWSPSDDNIGVDHYDIYRETEGSMKKIATSTTTSYLDKNLVANTIYKYVVKAVDVAGNESIQSDTFTVTTKTENAPYEAWDAKKAYKKGDKVLHEGKVYEAVQNHQGHGDPNWIYALSLWKTV

SEQ ID NO: 28368 - protein, 357 aa, Bacillus cereus VD169
MKLRKIFMICFLFIFTLTIVTGCSSSQSSTTVKNGKASSSSKNVEIEVENAEYVLPLSGSMGGINKDKVLKFKVSLKNKGDEMLEISPYLFTLYQDDEKMKKYDKADSDKLRLIELEPGKKTSGILYYEVNKASSYELVYSNEETKKRDDETEKVSFKIDTQEIEKNTKDLNKPAEALKTYINAVYYDKDIDKINELSGEDGKQFTLNIHQEFKKDAMSSTHNGISDQEFESYYKKLKSVLQEKVTFTVKSVGSSPEEDKVEVELKVKPLLLSELQPKLNKENEKLLKENPGIEQPKLFSQSFSYFISILPEAKVSDKEKVIKVEMERYGKEQWRFSKGKVTDSEDVMEIMGEFLKQ

SEQ ID NO: 28369 - protein, 970 aa, Bacillus cereus VD169
MGKRVIIRVFTLLSVLALFLNVFLPRASAEVMTHEKYSMDWSYSNSLGKYIRTEMIKNSSGQIAYCLTLGLKSPNGEDLPEMGKTDNVVYRVLLNGFPQKSAEQLGVANKNEAHYATQLAVWNALGQLDVNELKHENKNVEKAAKAIISNANNSEETQDVFMNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNVNNESVGKITTGADGMAELNNLPIGTYTLKEIKAPTGYVSDDKPQTIEVKTGETGAVQIVNNKVKGSIEIKKLSDSGKILPNVEFTVFTEDGKEVKKVVTKENGIANVEGLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIETKATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGSKELDASKSVTIQDKVEYKDLIAGKEYVVKGKLMDKATNKPLLVDGKEVTVESKFTAKEKNGSITLDFTFNASALQGKEVVVFEELYQDNILVAIHAEIEDKGQTVKFKEVKPEQPKPEQQNSDKNTPTPEQPNEQVKEQPQPKQEIQSKIGWLPQTGTNLTSWISMVAGALLLIVGGVIFLKRKNA

SEQ ID NO: 28370 - protein, 370 aa, Bacillus cereus VD169
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNDNAKELPNAGSEQSNNMALGMLSVLGGILLLTRNKIKTLFSK

SEQ ID NO: 28371 - protein, 431 aa, Bacillus cereus VD169; identical to SEQ ID NO: 27327

SEQ ID NO: 28372 - protein, 965 aa, Bacillus cereus VD169
MNKKSKINKVMLSISTMALSLGALQTHAAAEEKVPYNVLKTKPVGIEKSVDEVGHISKGDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTPENKWLVNNGIYFASRLGKFHINPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDTYTVPEVADDYLAEHETKSLAAVKKEISDTLPMKDTKMTKHNSQFFNTFTLEGTYTGSVTKGESEDWKEMSKRVNESLEQLAQKEWSGYKTVTAYFVNYRVNSSNEFEYDVVFHGIAKDDGENKAPTVNINGPYSGLVKEGIQFKSDGSNDEDGKIASYLWEFGDGSTSAEVNPVHVYEREGSYKVSLRVKDDKGKESRSETTVTIKDGSLTESEPNNRPEEANRIGLNSTIKGSLIGGDHTDVYTFNVALAKDIDISVLNEYGIGMTWVLHHESDMQNYAAYGQANGNHIEAKFNAKPGKYYLYVYKYDNGDGTYELSVK

SEQ ID NO: 28373 - protein, 163 aa, Bacillus cereus VD169; identical to SEQ ID NO: 26501

SEQ ID NO: 28374 - protein, 84 aa, Bacillus cereus VD169
PEVKPEDPKEPKEPEVKPEDPKEPKEPEVKPEVRLEKLIKEPQVKTERELPKTGAASPWMMSVGAGISFLVGGVLFVLGRRRKQ

SEQ ID NO: 28375 - protein, 211 aa, Bacillus cereus VD169
MIKNKKLARAKFHIEDSKGKIVGELVTNEEGEVISKDLPIGNYTLVEVEAPKGYELLKEKITVKIEKDAVVEIKIGNKKLPDPTGQFEIEKVDDMDSELKLKGAVFQVLDKEGKEVSRLITDEKGKVISNQLAIGKYTIKEIKAPNGYMLLRDPIEIEITEAVKTQKITVKNAKNNWVIPNTGGSGTTIFYVIGIMLMFAVLYFYKKNRIL

SEQ ID NO: 28376 - protein, 455 aa, Bacillus cereus VD169
MNNRFLKQLQNMKMNKKSLGAVALTAGIISTTLIPQNAYAHGFVEKPGSRSALCSSTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVIGTHFIDKKLQPSTEYSYTVKAIDAAGNVSKESTALTVKTTVEIPDTEAPTQPKGLHSMGTTASSVDLMWSPSDDNIGVDHYDIYRETEGSMKKIATSNTTSYMDKNLLANTTYKYVVKAIDVAGNESVQSDIFTITTKTESASYEAWDAKKAYKKGDRVLHEGKVYEAVQSHQGNGDPNWIYALSLWKTV

SEQ ID NO: 28377 - protein, 971 aa, Bacillus cereus VD169; identical to SEQ ID NO: 28144

SEQ ID NO: 28378 - protein, 878 aa, Bacillus cereus VD169
MVKYSKISKWILGVGLVTITCNGLQIQAETKEQNVKNVLQMEPVGIQKSVDELAHPSKVQENASFTKRLKLADLSQRPLAPTDNIKPLAEEKKYSMAELNQLNNKQLTDLLVTIKWYQIPELFQFNSDSLKFYQDDSRMQAIINKLAEQGQAYTKDDSKGIETLVEALRAAFYLGFYHDELSKLNERSYHDKCLPALKTIAKNPNFKLGTSEQNKIIASYGKLIGNASADVETVLYAGEIFKQYNDNLATFIEDRTKGDAIYELMKGIDFDIQTDMYTTGKEPKDTMWFRNIDNFINEVNRFALLGTVTNKNGWLINNGIYYAGRLGKLHSTPTKGQQVVTDAMRIYPYLGEQYFVAAEQITTNYGGIDANGKTVNLDQIREEGKKKYLPKTYTFDDGAIVFKAGDKVSEEKIKRLYWAAKEVRSQFYRTVGSDKPLESGHADDVLTMVIYNSPDEYQFNRQLYGYETNNGGIYIEGTGTFFTYERTPEQSIYSLEELFRHEFTHYLQGRYEVQELWGQGEMYQNERLTWFEEGNAEFFAGATRLDSVVPRKSIIGGLSNDPAKRYTASQTLNAKYGTWDFYNYSFALQSYMYNKRPEMFDKVHDLIRANDVSSYDAYRATLSKDNKLNEEYQSYMQMLIDNRDKYTIPQVSDEYLTQHDPKSLSDVTSDITNEAKLKDVKVTKNKSQFFNTFTLQGTYTGSVAKGEVEDWKVMNEATNDMLKRLSGKEWTGYKTLTAYFVNYRVNNAGQFEYDVVFSGVNTEEGTAVEKEPNNSFETANPLSLNILLRGTLSDQDQGDKFVIDVKDQKDLQISVTNEQNLGLNWVLYSESDLNNYVAYATKRDGNKLLGNYNAKPGKYYLSVYKYGGGTGNYTVQVK

SEQ ID NO: 28379 - protein, 572 aa, Bacillus cereus VD169
MKKIIFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSIISGLSSDPASRYTAKQTLFAKYGSWDFYKYSFALQSYLYNHQFDTFDKLQDLIRANDVKNYDAYRELLSKNTQLNAEYQAYMQQLTDNQGKYNVPQVTNDYLIQHAPKPLAEVKNEIVDVANIKDAKITKHESQFFNTFSVEGTYVGGISKGDSEDWKTMSKQVNQTLEQLSQKGWSGYKTVTAYFVNYRVNAANQFEYDIVFHGVATEEKEKTTTIVNMNGQYSGIVNEEIQFHSNGTTSENGKVISYLWNFGDGITSTKANPTHIYGEKGTYTVELTVKDSRGKESIEQTKVTVKQDPQTGGSLEEEKILPFNTLVKGNLVTPDQTDVYTFNVTDPKEVEISVVNEQNIGMTWVLYHESDMQNYVACGEDEGNTIKGKFVAKPGKYYLNVYKFDDKNGEYSLLVK

SEQ ID NO: 28380 - protein, 209 aa, Bacillus cereus VD169; identical to SEQ ID NO: 27899

SEQ ID NO: 28381 - protein, 553 aa, Bacillus cereus VD169
MKKIFSVLLVFFLTFSTWSSVLVKADSPSKGTLTIHKYEQEKDGAQGLEGDGSANQEVPKDAKPLKGVTFEVKKVASFEKISNDGKIVKEDVKPVMGATPNQVVTDDNGQAVLKDLPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLVYGEYYFQETKAPKGYVIDPTKREFFVKNSGTINEDGTITSGTVVKLEVKNYEEPTIDKKINGKLEALLINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDGANKNKLKGAEFVLKDNNGKIVVVAGKEVTGVSDENGVIKWSNIPYGDYQIFETKAPTYTKEDGTKTSYQLLKDPIDVKISENNQTVKLTIENNKSGWILPVTGGIGTTLFTVIGLTLMLTAAFVFFRKKFARN

SEQ ID NO: 28382 - protein, 336 aa, Bacillus cereus VD169; identical to SEQ ID NO: 28335

SEQ ID NO: 28383 - protein, 333 aa, Bacillus cereus VD169; identical to SEQ ID NO: 26499

SEQ ID NO: 28384 - protein, 431 aa, Bacillus cereus VD200; identical to SEQ ID NO: 27327

SEQ ID NO: 28385 - protein, 66 aa, Bacillus cereus VD200; identical to SEQ ID NO: 28350

SEQ ID NO: 28386 - protein, 563 aa, Bacillus cereus VD200
MIEVVKGIREMKKIFSVLLVLFLTFSTWSSVLVKADSPSKGTLTIHKYEQEKDGAQGLEGDGSANQEVPKDAKPLKGVTFEVKRVASFEKISNDGKIVKEDVKPVMGATPNQVVTDDNGQAVLKDLPLGRYEVKEVAGPPHVNLNPNTYTVDIPLTNKEGKVLNYDVHMYPKNEVKRGAVDLIKTGVNEKALAGAVFSLFKKDGTEVKKELVTDANGHIRVQGLEYGEYYFQETKAPKGYVIDPTKREFFVKNSGTINEDGTITSGTVVKIEVKNNEEPTIDKKINGKLEALPINPLTNYNYDIKTLIPEDIKEYKKYVVTDTLDNRLVIQGKPIVKIDGAEVNANVVEVAIEGQKVTATVKDFTKLDGKKEFHLQIKSQVKEGVPSGSEILNTAKIHFTNKNDVIGEKESKPVVVIPTTGIIELTKIDSANKNKLKGAEFVLKDNNGKIVVVAGKEVTGVSDENGVIKWSNIPYGDYQIFETKAPTYTKEDGTKTSYQLLKDPIDVKISENNQTVKLTIENNKSGWILPVTGGIGTTLFTVIGLTLMLTAAFVFFRKKFARN

SEQ ID NO: 28387 - protein, 179 aa, Bacillus cereus VD200; identical to SEQ ID NO: 26496

SEQ ID NO: 28388 - protein, 181 aa, Bacillus cereus VD200
MNKKLLASLLCSTFLFGVSACSSHDAPAKNEQATSKKTENDKLSSKDPQKELPTNVDSSDVYMSMGSAESLDVLGTGEVKAQGVFKVLDIAVYNRKEEPITLDINNFKLIDGFGREYHISNEYQSVLKAANISTFKFNIVNPNESSDGNIVFDVPKNTRGLTLKFNNDKLDKELQLKVELE

SEQ ID NO: 28389 - protein, 183 aa, Bacillus cereus VD200; identical to SEQ ID NO: 27306

SEQ ID NO: 28390 - protein, 965 aa, Bacillus cereus VD200
MNKKSKINKVMLSISTMALSLGALQTHAAAEEKVPYNVLKTKPVGIEKSVDEVGHISKVDETLSFQERLKVGDFSQRPASITKKTAVKQVKESYSMADLNKMNDQELVETLGSIKWHQITDLFQFNEDAKAFYKDKGKMQVIIDELAHRGSTFTKDDSKGIQTFTEVLRSAFYLAFYNSELSDLNERSFQDKCLPALKAIAKNPNFKLGTVEQDTVVSAYGKLISNASSDVETVQYASNILKQYNDNYTTYVNDRMKGQAIYDIMQGIDYDIQSYLTEARKEANETMWYGKVDGFINEINRIALLNEVTSENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDVLTIVIYNSPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDPKLNKEYQEYMQQLIDNQDKYNVPEVADDYLAEHAPKSLTEVKKEISDTLPMNDTKMTKHNSQFFNTFTLEGTYTGSVTKGESEDWKAMSKRVNESLEQLAQKEWSGYKTVTAYFVNYRVNSSNEFEYDVVFHGIAKDDGENKAPTVNINGPYSGLVKEGIQFKSDGSNDEDGKIVSYLWEFGDGSTSAEVNPVHVYEREGSYKVSLRVKDDKGKESRSETTVTIKDGSLTESEPNNRPEEANRIGLNSTIKGSLIGGDHTDVYTFNVASAKDIDISVLNEYGIGMTWVLHHESDMQNYAAYGQANGNHIEAKFNAKPGKYYLYVYKYDNGDGTYELSVK

SEQ ID NO: 28391 - protein, 163 aa, Bacillus cereus VD200; identical to SEQ ID NO: 26509

SEQ ID NO: 28392 - protein, 487 aa, Bacillus cereus VD200
MLRSKYIFLLFMIFVSTIILPFEDYPTYANSEVLERERPGKDRDHQRKAEIYKQVVKINIQDVDVAEHHTTESIIQNIPTPILDMYKQIGGKIEIISDNLNDHPILSHNNNRQYKDIEGNTVSLANHYVYSHDGENPTVLIKASNEYGENYVHDRNVYYEIGKAIARDVFKQTPKWMVELVPIFNQIRGDEDGKNLLFTDVMKSYNNQFDETFLTQHPDDVQEVFARAFGYYFEPHSRSTLETYNQEMFNYMKKMDESGFEDYNKLLKNIILIDFGNNETRAKEWGTKNFKEWIDSLRLSERKALFDYTTGNGMDLSAIINDYLEKKSTPSSSDVRIIKEHISEMDTALDRAKLSQKMIVYRRVHVEEINKTGREYEDNDLRKGNKLDTEVVNKLSEKLQNCYMDYKRYISTSASKDPSEGVFSDRPVLLRMELPVGTHAGYLGDISGFPGELEVLIKRGYSFKVTGVSIISTEEKETLQVNLKLIK

SEQ ID NO: 28393 - protein, 358 aa, Bacillus cereus VD200
MKIITRLFLGTTLSFSMLLSGGDVTFAQEQKNVVDIGRDTKVHTNFSAMLSDGNVTFAQEQKNVVDIGRDTKVHTSFSTIYNEGAKVKTSIQVSFIEDPNSDKRIAIINTAGSNIAADKKIIDKSFSIGKPGETIAGLEWPSSYHIEMELKDEQAQFYKVVPANTVDTKSVMSTVGYAIGGGIKMSEKPDANISGAVNWLTSVKYDQSDYKTFLTYDSDKKVNWNISFVSAMNQGYGPYDRDSNNLTYGNQLFMKSRNGSVWAKNNFIANEEMPGLASYGFSPGVIAVVITDKNVTKPSKLNIRYGRTKDLYSLKWGDIAWVGGLEKNINSTWGGTYYEIDWSNHQIIEKLDLVSLEN

SEQ ID NO: 28394 - protein, 1124 aa, Bacillus cereus VD200
MGNKRVKKRMDQLKTVNVITTMAIVATTLFTPITHVLPGKYNVVHAEQEVAENNVINWGQYLQEININPSTDGKKSTIQVGVSMREYPAVDSLYLEVDGQLYDLEKQNKLPTSYGKLYEVENVSLTAGSTIRVFVRKAKEESKQVDFTLTRIPVDTEVLQGKRQKINILKEQNIKGFTLYKQNGAKTSDEKAPEAPSVNKVADQDISVTGMGKKGATVKVIVDGQETGTGKVDAEGKFKVDIPKQPVGKEIVVTLADAAGNTSQPTETKVETKDEKALEAPSVNKVTDQDTNVTGTGKKSTTVKVIVDGQETGTGKVDAEGKFKVDIPKQSVGKEIVATLADAAGNTSQPTKTKVETKDEKAPGAPNVNKVTDQDTNVTGTGKKGTTVKVIVDGQETGTGKVDDKGNFKVDSPEQPVGKEIVVTLADAAGNMSQPTKRTVQKNQDHQNTLVKEAKQAIDDILTDLIQTKYSHDFSIVKKGAIQLDVKQPKIDEAESKVQKIDDQRVEKTELQKGIDHARQLLNERENEQDGNMVQNGLFDFGFNNWKLWTGPGAIAPLVQEKDDKSVKIAKVNPNSSIEQTLTGLEPNTTYELTLYAKTENDEKFSIGVKNTGTPTVSAPVKSKNYSQTKLRFITGENTTTATLYLYKSAGKGSGYADVAIVKQVIDEQSIKQAVHHLFTDRIYNGDTGEETQTKRAIQPNVKRQDIERLENDVDSITDPKEKKQLKNEVKRAQDIYEEKQKQQTNKQLKNGSFEEKLNNWKSWKSSETNVAPIVIEKEGRLTNVLKLETSASSVEQTLQVEPNTTYELAGYGKTINGEKLSLGVKKMIGVADRGVTNSSNNYVEQVVRFKTGENTTSVTVYVYKGAGTNPSYIDDIRLYKVNSITNQQCHSTNPLDFKSVCKSEATAWGNELFSLWDKLTPQVEKDAVREYTGEGHRDINGYLRSDYFDARDQEKIKRSIQQMDLAFSRVRIHEDMIVYRRASESAFGYRDGELVNQDGIDMEQFEMFKDRFQGKYKKDPTYISTSIVKDAALGFNYRPILLKIHVPKGVPAMYLEPLTQVSGEMELLLPRNRTYKVTNISPVSEEDREYVMLDVQILDIPSNYQNKRAMDIGYEDSLPSLSK

SEQ ID NO: 28395 - protein, 679 aa, Bacillus cereus VD200
MNLKSRYKILAIAFVAGQLITVPTVSHANLQQTNNLFKKENSKKNSEKRGLLVNYYTDASFRNKAVLSIQPTGKPQVKKKDLESIVPKDKQVFQSANWIGMIKPSESGIYKFSTSDDEHAVIQLNGEALKGDVKLEKEKVYKILVECHTERREEENPLLNFELFWSRDGGNKETVPEENLVLPTYSKGDSSVNSFSLMDSGNITVALDSDSDGIDDDWEVSGYTVNKGIVVKWDDEIHKDKGFTKYKSDPFSKYTTGDPFTDIDKVISLIKGKVIDGGILSEAHNPVIAAYPKVGVDMEKMILTKNHNITHEQGQTETNEFSHTVGISTTNNHTESNTVGASASVSFPLGVSVAANYSHEWSNSVSVDNSSQKTSGHNNGKSWVETLGINTSEAAFLNGNVRYINVGTAPIYNVKPTLNFVVGLGNLATTVATVVAKSNTIANVLDPGEKYPELSQNPIAWNTMDDFNAQPIKLNFEQVQAIEKGTPLQIQTTQTSGLYKTYNADGKIVLDESQKWEDVMNDIKDRTASIMMDLGNGDTKERRISARKVADYERQSQPEVALGEAIEVAFPGAKIQGEKLSYNGLNAVKIIMDQKTYDDMHNQIRQTQDHNIFHVKLKQGMNILIINKNGFESKGGKTYYRDKTGTLATGWKQIDDKWYYFDSNGAMVTESWQQKGSKW

SEQ ID NO: 28396 - protein, 756 aa, Bacillus cereus VD200
MRYISKLLIFLFFLLQFCNVAKAGEHTKIEAKEPPSIYQDLSGGLIGYHFNDTNFNDLALITNHSTGNLEVDFEEIDERYQSAFWNGKIQISEAGMYTFKTPADRYIKLWINNQQLINEDENVTPIELESGKSYEIRIEYKNKDSEPNNEHLNLYWIKPNNQEEIIPAGTFLFPDNIINQEEEQQVSQRNRRSINIPTLPDSDNDGIPDSLETNGYTVDVKNGKLIVLGWNENIHRSKNLTKYYSSAMKWSTASDPYSDFQKVTGLIDKQIKPEARNPLLVAYPIVNTDMERIVISKNNNITVENNGNTIHTVSKSMNNSKTDAISSSINAEFTASLTGINTKVATSFSKEHSSTTSIEESDSSTNETGWTNAIGIQTGESAYFGANVRYKNIGTAPIYKVKPTTTFVLGNEQSIATITAKENQIANVLQPDGFYPNKTQASIMINTKDDFGSSPITLNFEQLRILEEQKKMRIEINQVSGGVGVLQGNGEIQVTSDWSLYLPQIENTSARIMLNTKDNEIIERRITAIDATDVLERTKPEISLKEALKIAFNIQEQNKQLYYKDRIVGGFEIVCDTDTFRNIQGQLNQMNEKDIYHVKLNAKMNFLIKELTIPEAVNQLFVKYKRGKGLKPNTKQATIQHIQELVNTLPDSVQKDQLQTRIDDANFIIKLRSLANINVTKMNRTDYRLEFKPNIRLPEIMGYSFLISNGGESWEGSNEDIVNIDKVITISNADMEGYVNFVVLLTNGNSYVLYEQ

SEQ ID NO: 28397 - protein, 283 aa, Bacillus cereus VD200
MILKKRILHAFIVCASFISILAVPINTSAETTTNRQCHSTNPLDFQSVCKSEATAWGNELFNLWNKLTPRVEKDVVRGYTAADYHIINGYLRSDYFNVLDQEKVEKGIKLMDRAFSRVRLHDDMIVYRRVSERAFGLSEGSLVTSDIKENDSLVNINSKIDMGNFETFKNMFQGKYKKDPTYISTSIVKDAAEGFRDLPILLKIHIPKGVPAIYVDPISNVPGEMELLLPRNRTYKVTNISPVIEKDREYIMLDVEILDIPSNYRNRRAVDIKYEDRLPSLSK

SEQ ID NO: 28398 - protein, 960 aa, Bacillus cereus VD200
MNKNLKFTQMMIGISTMALSFGSIQTQVSAEETAPYNILQMKPMGTETSKDEIVHATKTDETLTFEERLKIGDFSQRPTLVMKRDEIQLKQSYTLAELNKMPNSELIDTLSKISWNQITDLFQFNQDTKAFYQNKERMNVIINELGQRGRTFTKENSKGIETFVEVLRSAFYVGYYNNELSYLKERSFHDKCLPALKAIAKNPNFTLGTAEQDRVVAAYGKLIGNASSDTETIQYAVNVLKQYNDNLSTYVSNYAKGQAIYEIIKGIDYDIQSYLQDTNKQPNETMWYGKIDNFINEVNRIALVGNITNENGWLINNGIYYAGRLGKFHSNSNKGLEVITQAMSLYPRLSGPYFVAVEQMKTNYGGKDYSGNAVDLQKIREEGKRQYLPKTYTFDDGSIVFKTGDKVTEEKIKKLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFETFDKLQDLIRANDVKNYDSYRESLSNNTQLNAEYQAYMQQLIDNQDKYNVPQVTNDYLIQHAPKPLAEVKNEIVDVANIKDAKITKYESQFFNTFTVEGKYTGGTSKGESEDWKTMSKQVNRTLEQLSQKGWSGYKTVTAYFVNYRVNAANQFEYDIVFHGVATEEKEKTNTIVNMNGPYSGIVNEEIQFHSDGTTSENGKVTSYLWNFGDGTTSTEANPTHVYGEKGTYTVELTVKDSRGKESKEQTKVTIKQDPQTGESYEEEKVLPFNTLVKGNLITPDQTDVYTFNVTDPKEVDISVVNEQNIGMTWVLYHESDMQNYVACGEDEGNTIKGKFVAKPGKYYLNVYKFDDKNGEYSLLVK

SEQ ID NO: 28399 - protein, 262 aa, Bacillus cereus VD200
MNFKKGILVSLLSSVTFIMPITHEANVISVATVYANSVDLDFTDNKEAARKWGEKEYGDWKKNKLTAEERTAMENYTGSGYAAINEYLGKTNGELIEKQEELPEGYQLSDAKKLNKKIMKLDSALDKARLTETIMVYRRVSEQQFSMEASKLRPAGSTRIDPEKAENLSLEFTGKSFDQYNFMSTSIAKDPHKSYGPQRYAILMKIKLPKGTHAAYVADISKYPDQLELLVKRGYTFKYDKFSIINDHGWESLQVDVSLIKK

SEQ ID NO: 28400 - protein, 880 aa, Bacillus cereus VD200
MLNKKYNNLFLLTMIFCLWEGMFAYVPSNVIAQENTDAWLLQSHAPKKANNLFAEKSKENDQLLSNSSIKKDSFESPFGKKKITQLETNNKNQKYSMSQLNQLSYQKLKDLLITIQWYDIQDLFEFNPDSLQFYQDPNRVQTLMDALSQQGRLYKNNDSKGIETLVEVLRSGFYLGYYHAELQYLNEKSFQDKCLPALKIIAENPNFQLGTSEQDKVISSYGRLIGNASSDVQTVQYATPILKQYNKELENYMKEYSKKDAIYSLIHGIGYDLETYLNTTQQQPNQTQWYQNIDDFIDQVGKLALSEHITNDTGWLINNAIYYIGKIGVFHSTSSKGLQILTQALQLYPYLTEQYITAAQRIAYDYNAKDYYGNTVDLDKIREAGKSKYLPKTYTFDDGSMIIKSGDQVTEDKIKRLYWASKEVQAQFFRVVGHDQPLEKGHQDDVLTMVIYNSPRDYLLNKFLYGYDTNNGGIYIEGIGTFFTYERTPQDSIFSLEELFRHEFTHYLQGRYEVPGLFGQGEMYQDERLTWYEEGNAEFFAGSTRMDSVVPRRSLIDQLATKDPTQRYNVSQTLYARYGTWDFYNYSFVLQSHMYKNHFNILDKLDNLIQANDVSGYDTYRKTLSNDMILNQEYLAYMQQLIDNKNQYYTPMVSSDYVKSHESKPLQEISQEITEIAKLKDVKIKERHSQFFNTFTLQGTYVIENPQGKYEDWKQMNKKMNEDLKLLSGKTWSGYKTLTAYFINYRINSVGKLEYDVVFSGVNTEGNIAVEKEPNNSFETANPLSLNTLLRGSLDDKDQTDRFVIDIKKAKDLQITVIDEQNLGMNWVLFDERDLRKYVTYATKHEGNKLIGNYYAQPGKYYLVVYKSNGSKGNYTVGVK

SEQ ID NO: 28401 - protein, 893 aa, Bacillus cereus VD200; identical to SEQ ID NO: 27257

SEQ ID NO: 28402 - protein, 503 aa, Bacillus cereus VD200; identical to SEQ ID NO: 28160

SEQ ID NO: 28403 - protein, 775 aa, Bacillus cereus VD200
MKKSKKMLAGATLAIGVIAPQVMPTTAHADENAGESTVNLRILETSDIHVNLMNYDYYQTKTDNKVGLVQTATLVNKAREEAKNSVLFDDGDALQGTPLGDYVANKIKDPKNRVDPSYTHPLYRVMNLMKYDVISLGNHEFNYGLDYLNKVIEKTDFPVINSNVYKDDHDDKEENDENYFKPYHILKKEVVDEAGQKQIVKIGVMGFVPPQIMNWDKANLEGKVKAKDIVATAKIMVKKMQDEGADIIVALAHSGVDKSEYKEANKMENASYHLATQVPGVDAVLMGHSHTEVQDVFNGVPVVMPGVFGSNLGIIDMQLKKVNGKWEVQKDQSKPQLRPIANSKGTPLVESDQKLVNEIKDEHEKTIEYVNTHVGETKAPINSYFSLVQDDPSVQIVTNAQKWYVEQELKKPEYEKIKDIPVLSAGAPFKAGGRNGATYYTDIPAGTLAIKNVADLYVYPNTLYAVKVNGAQVKEWLEMSAGQFNQIDPKKTEEQPLVNIGYPTYNFDILDGLKYEIDVTQPAKYDKDGKVVNANTNRIVNMTYEGKPVADKQEFIVATNNYRGSSQTFPGVSKGEVVYQSQDETRQIIVKYMQKIKDIDPAADQNWTFKPIVADKLNTTFDSSPNAQKYIKKDGKISYVGPSENEFAKYAIDITKKNDDKETGEGNPTTPPTGGGENPTTPPKGDGENPTTPPTEEGNNGNEPKQDGNNTGSGQTTTDDQNTKETTTVSENKEAEKDERDLPKTGASIASTIGAGLAFVGAGLLLLFRRKKANR

SEQ ID NO: 28404 - protein, 932 aa, Bacillus cereus VD200
MNVIPAEKQKAELKGEFFETNLYSVQTNAKSGSYKVVAKNAPNGVRIVSENGEVKDQLSVGEKFRIQIPKNTKTGEFNLSVAANLTKVQAIAYRGTDTVQNATVLLERNEEKLSSDLAVNWEAAGSLKIKKVGENGEVLAGAVFEVFNANNESVGKITTGADGMAELNNLPIGTYTLKEIKAPTGYVSDDKPQTIEVKTGETGAVQIVNNKVKGNIEIKKLSDSGKVLPNVEFTVFTEDGKEVQKVVTKENGIANVEGLTYGKYYFLETKTPNGYIGNKTKYPFEIKEHNKTLTFTVENTEVKGSVKLLKVDNEDISKKLEGAAFELKDASGKVVGEYKTDKNGEINVKDLAYGKYSFVEKASPNGYVLVKEPIMFEIKEHGKIIELLAVNHLIKGDLEITKVDVADGNNKLPNAEFTIYNEAGKEVVKGKTDDKGIAKFEKLPFGKYTYKETVAPKGYVLNEETFSFEIKENGQIIKHIVKDEKIPSIETKATDKTDGTKEMHTSKSVTIQDKVEYKDLQVGKEYTLKGKLMNKETNKPLVVNGKEVTAETKFTPKEANGSITLDFTFDATGLEEKEVVVFEELLKDGKVVTTHADINDKGQTVKFVKPSVKTTATNKADGGKEIHSKDSITIQDKVEYTNLVVGKEYTVKGKLMNKAIKKPLLIDGKEVTAETKFTAKEKNGFVTLDFTFVGAEQQGREVVVFEDLLHEGQVIATHADINDVGQTVRFVEPFIKTTATNKADGSKELDASKTVTIQDKVEYKDLIAGKEYVVKGKLMDKATNKPLLVDGKEVTVESKFTAKEKNGSITLDFTFNASALQGKEVVVFEELYQDNILVAIHAEIEDKGQTVKFKEVKPEQPKPEQQNSDKNTPTPEQPNEQVKEQPQPKQEIQSKIGWLPQTGTNLTSWISMVAGALLLIVGGVIFLKRKNA

SEQ ID NO: 28405 - protein, 971 aa, Bacillus cereus VD200
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSRGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKMYTFDDGAIVLKAGDKVTEEKVKRLYWAAKEVKAQFHRTVESDQPLENGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSILSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSVKEWTGYKTVTAYFVNYRVNASGQFEYDVVFHGINIEEGAENKAPVAVINGPYSGNVNEAISFKSDGSKDEDGKITLYRWEFGDGAVSNEQNPTHVYTKEGTYTTKLTVTDDKGATNTATATVTVQKKEDNSVEKEPNNSFQTANKLQLNQVLRASLGNGDTSDFFEINVENAKNLQINVTNENNIGMNWVLYSAADLNNYVTYAQQQGNKLVGSYYTYPGKYYLHVYQYGGGTGNYTVEVK

SEQ ID NO: 28406 - protein, 455 aa, Bacillus cereus VD200
MNNRFLKQLQNMKMNKKSLGAVALTAGIISTTLIPQNAYAHGFVEKPGSRSALCSSTYGALNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINDVKPDIEAPSIPNGLQTQKVTANSVELTWNASTDNVGVKGYQIFRNGEMIDTVIGTHFIDKKLQPSTEYSYTVKAIDAAGNVSKESTALTVKTTVEIPDTEAPTQPKGLHSMGTTASSVDLMWSPSDDNIGVDHYDIYRETEGSMKKIATSNTTSYMDKNLLANTTYKYVVKAVDVAGNESVQSDIFTITTKTESASYEAWDAKKAYKKGDRVLHEGKVYEAVQSYQGNGDPNWIYALSLWKTV

SEQ ID NO: 28407 - protein, 370 aa, Bacillus cereus VD200
MKTKQTIAASTLALAMIAGANSTHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAELQKAREDLLNKINEIKQSKQTVSDDLTKKKQDLDIKINDFKHTEKKIDDKLAELHTTKQNVDNKINEVSQSKQTQADNGTKNDNAKELPNAGSEQSNNMALGMLSVLGGILLLTRNKIKTLFSK

SEQ ID NO: 28408 - protein, 237 aa, Bacillus cereus VD200
AVVEIKIGNKKLPDPMGKMKLVKVDISDKNKKLAGAKFKIEDSKGKIVGELVTNEEGEVISKDLPIGNYTLVEVEAPKGYELLKDNITVKIEKDAVVEIKIGNKKLPDPTGQFEIEKVDDMDSELKLKGAVFQVLDKEGKEVSRLITDEKGKVISNQLAIGKYTIKEIKAPNGYMLLRDPIEIEITEAVKTQKITVKNAKNNWVIPNTGGSGTTIFYVIGIMLMFAVLYFYKKNRIL

SEQ ID NO: 28409 - protein, 878 aa, Bacillus cereus VD200; identical to SEQ ID NO: 27315

SEQ ID NO: 28410 - protein, 572 aa, Bacillus cereus VD200
MKKIIFDDGSIVFKTGDKVTEEKIKRLYWAAKEVKAQYHRVIGNDKALEPGNADDVLTIVIYNNPDEYQLNRQLYGYETNNGGIYIEEKGTFFTYERTPKQSIYSLEELFRHEFTHYLQGRYEVPGLFGSGEMYQNERLTWFQEGNAEFFAGSTRTNNVVPRKSMISGLSSDPASRYTAKQTLFSKYGSWDFYKYSFALQSYLYNHQFETFDKLQDLIRANDVKKYDSYRESLSNNTQLNAEYQAYMQQLIDNQDKYNIPQVTNDYLIQHAPKPLAEVKNEIVDVANIKDAQITKYESQFFNTFIVEGKYTGGTSKGESEDWKAMSKQVNQTLEQLSQKGWSGYKTVTAYFVNYRVNAANQFEYDIVFHGVATEEKEKTTTIVNMNGPYSGIVNEEIQFHSDGTKSENGKVISYLWNFGDGTTSTEANPTHVYGEKGTYTVELTVKDSRGKESKEQTKITVKQDPQIGESLEEEKVLPFNKLVKGNLITPDQTDVYTFNVTDPKEVEISVVNEQNIGMTWVLYHESDMQNYVACGEDEGNTIKGKFVAKPGKYYLNVYKFDDKNGEYSLLVK

SEQ ID NO: 28411 - protein, 113 aa, Bacillus cereus VD200
GSGGNGSGGNGSGGNGSGGSGSGGNGSGDNGSSGNGSGSNGSGGNGSQGGNRVKGDSNSQEGNGSQGGNVKDNTKKQGDKLPNTATHYPISILMGLSTFLIGMLLFIRRKNVK

SEQ ID NO: 28412 - protein, 453 aa, Bacillus cereus VD200
VKTDKNGKAKISDLSVGKYKLVEKESLPGYKQLTEPVSFEITKGMTEVLSLKIENEMVDTGNVEITKIDKDNKAPLAGVVFEVQDDKGKVVTKVTTDKAGKATVSDLSVGKYKLVEVESLPGYKKLEKPVPFEITKGMTKSLAFTVENEMVDTGNVEITKIDKDSKAPLENVVFEVRDSKGKVVAKVTTDKEGKANVSDLSVGKYKLVETKSLPGYKKLMEPVSFEITKGMTKVLSLKVENEQLDKGSVEITKMAAESKEVLSGAVFEVHDEKGKVVVKVTTDKDGKAKITDLSVGNYTLVEVEAPKGYEKLTNPIPFEITNGMINAVQLEVLNKLNHLAPPGPETPDPEKPGTPDPEKPGTPDPEKPGTPDPEKPGTPDPEKPGTPNPEKPGTPDLEKPGTPDPEKPGTPNPEKPEKELPKTGQKMPVEPYMGALLVMMSFGLLVLGRKQQR

SEQ ID NO: 28413 - protein, 336 aa, Bacillus cereus VD200
MKRSKTYLKCLALSAVFASSAVTLSTPAAYAQTTSQVVTDIGQNAKTHTSYNTFNNDQADNMTMSLKVTFIDDPSADKQIAVINTTGSFLKANPTISDAPIDNYPIPGASATLRYPSQYDVAFNLQDNSARFFNVAPTNAVEETTVTSSVSYQLGGSVKASVTPNGPSGEAGATGQVTWSDSVSYKQTSYKTNLIDQTNKNVKWNVFFNGYNNQNWGIYTRDSYHSLYGNQLFMYSRTYLYESDAKGNLLPMDQLPALTNSGFSPGMIAVVISEKNTDQSNLQVAYTKHADDYQLRPGYTFGTANWVGNNVKDVDQKTFNKSFTLDWKNKKLVEKK

SEQ ID NO: 28414 - protein, 333 aa, Bacillus cereus VD200
MKGKLLKGVLSLGVVLGALYSGTSAQAEASTNQNDTLKVMTHNVYMLSTNLYPNWGQTERADLIGAADYIKNQDVVILNEVFDNSASDRLLGNLKKEYPNQTAVLGRSSGSEWDKTLGNYSSSTPEDGGVAIVSKWPIAERIQYVFAKGCGPDNLSNKGFVYTKIKKNDRFIHVIGTHLQAEDSMCGKTSPASVRTNQLKEIQDFIKNKNIPNNEYVLIGGDMNVNKINAENKNDSEYASMFKTLNASVPSYTGHTATWDATTNSIAKYNFPDSPAEYLDYIIASKDHANPSYIENKVLQPKSPQWTVTSWFQKYTYNDYSDHYPVEATISMK

SEQ ID NO: 28415 - protein, 958 aa, Bacillus cereus VDM022
MNKKSKFTQMILGISTMALSFGSIQTQVSAEENTPYNVLQKKPIGIETSTDEIAHSTKADETLSYEERLKVNDFSQRPAPVVKRAAAKQFQQKYSVTELNRMSDDELIDTLANVSWDQIADLSQFNQETKAFYQNKERIQVIIDELGRRGSTFTKDDTKGIETFVEVLYCGFYLGFNNKEINYLNERSFHDKCLPALKAIAKNPNFKLGTNKQDKVVSSYGKLISNASCDAETVQYAANIVKQYNDNISTYISDKNKGDALYNLIQAIDNDIQSYGKKADETIWYGKIDGFINEVSRMALLNQVTTENSWLINNGVYYTGRFGKFHSNPDKGLEILTQAMRMYPRLSEAYFNAVEQISTNYGGKDYNGNTVDLKKIREEGQKQYLPKTYTFDDGSIVFKTGDKVTEEKVKRLYWAAKEVKAQYHRVIGNDAALEAGKADDVLTIVIYNDPYEYKRNSQLYGYDTNNGGIYIEGKGTFFTYERTPQQSGYTLEELFRHEFTHYLQARYEVPGSWGQGELYQNERMTWFDEGNAEFFAGSTRTNNVVPRKSVISGLSSDPAQRYTAERTLFSKYGSWDFYNYSFALQSYLYTHQFETFDKIQDLIRANDVKGYDAYREALSKDPNLNKEYQDYMKQLIDNQDTYNTPQVSDDYLAEHAPKPLADVKKEIENVANIKDTTMTKHKSQFFDTFTLEGTYTGDVTKGESEDWKAMSKQINQSLEQLAQKEWSGYKTVTAYFVNYRVNANNQFEYDVVFHGVATGEEEKQTIKVNMNGPYNEMLNEKVEFHSDGTESTGGKIVSYLWDFGDGTTSTGANPTHVYGKEGTYTAKLTVKDNKGNVGRAQTTVTVKKDEPVGHGFDSAKEIRFNKLFKGNMDMPNMAYMYTFNVTSPKEVDISVIDEQGIGIGWNLIRGTDMEHPVAEGQVDGNNIKGKIELEPGKYYLVMFFSEENKNGTYSLLVK

SEQ ID NO: 28416 - protein, 968 aa, Bacillus cereus VDM022
MNKKSRFTQMMLGISTMALSFGSIQTQVSAEENTPYNVLQKKPIGIETSTDEIAHSTKADETLSYEERLKVGDFSQRPDPVVKRAAAKQFQQKYSVAELNRMSNDEFIDTLASISWNQITDLDQFNQETKEFYQNKERIQVIIDELGRRGSTFTKDDTKGIETFAEVLRSISYVGFNNKEVSYLNERSFHDKCLPALKAIAKNPNFKFGTDKQDAVVSAYGKLIRNASCDAETVQYAANIVKQYNDNISTYISDKKKGDALFELIQGIDDDIQSYLFETRKKADETIWYGKIDGYINEVSRMALLNHLTTENKWLINNGIYYTGRLGNFHSNPNKPLEVLTQAMHMYPRLSEAYFNAVEQISTNYGGKDYNGNTVDFKKIREEGQQQYLPKTYTFDDGSIVFKTGDKVTEEKVKKLYWAAKEVKAQYHRVIGKDGALESGKADDVLTIVIYNNPDEYKRNSQLYGYDTNNGGIYIEGIGTFFTFERTPQQSRYSLEELFRHEFTHYLQGRYEVPGSWGQGEMYQDQRLTWFEEGNAEFFAGSTRTNNVVPRKSIISGLSSDPAKRYTAERTLFSKYGEGEGDEKWDFYNYSFALQSYLYTHQFETFDKIQDFIRANDVKNYDAYREALSKDPNLNKGYQDYMKQLIDNQGTYNTPQVSDDYLATPSLKPLADVKKDITDVAKIKDATITKHKSQFFDTFTLEGTYTGGVTKGESEDWKTMSKKINQSLEQLAQKEWSGYKTVTAYFVNYRVNANNQFEYDVVFHGVATGEEEKQTVKVNMNGPYNEILNEKVEFHSDGTESTGGKIVSYLWDFGDGTTSTEANPTHVYGKEGTYTAKLTVKDNKGKVGRGQTSVTVKQDEPAGHNYQNAKVIRFNKLSKGNMDRPNLAYMHTFNVTSPKEVDISFIDEQGIGIQWDVYHESDLEHPVITGQADGNNIKGKFEAKPGKYYLVSFFEKENGKGTYSLVVK

SEQ ID NO: 28417 - protein, 883 aa, Bacillus cereus VDM022
MGNSTAKSKKLVGFVATATLATSMIAGASNASAQTTSTLKASEPVQEKAKDKKEERPESLFPSMDINYDTTIYVGDPFDPMAGVSAYDSKDGDITDKINIVGEVDPFEPGTYNLDYTVANSRGFSVIKQVSVWVKRGEKPILRLPYKVSINVGDNFDPMAGVSATDEEDGDITSKIKVDGNVDTSKPGTYEVTYTVTNSKGLTIVRKQPVKVKETEGTKNEAPVLTVPFTTTLHVGEEFDPMAGVSATDKEDGNLTNKVKYTGNVDTSKPGKYIVEYWVVDSKGVNATATQTVIVKENEEIPDMEPKLTVPVEATINVGDKFDSMAGVKAIDNEDGDITSKVTVDGNVDTSKPGTYELTYKVTDSKGHTVTAKQTVTVKQKVEPKDEVPVLTVSAEATINVGDKFNPLSGVKAIDNEDGDITSKVTVDGNVDTSKPGTYELTYKVTDSKGHTVTAKQTVTVKQKVEPKDEVPVLTVPAEATINVGDKFNPLSGVKAIDNEDGDITDNVTVDGSVDASKPGTYELTYTVSDSNGNKVTAKQTVTVKQKVETKNEAPVLTVPFTTTLRVGEEFDPMAGVSATDKEDGNLTNKIKYEGNVDTSKPGKYIVEYWVVDSKGVNATATQSVIVKENEETPDMEPRLTVPTGATITVGDKFNPLSGVKAIDNEDGDITDKVTFDGNVDTSKPGKYELTYKVTDSKGHTVTAKQTVTVKQKVESKDGTPALTVPAEVIINVGDKYNPLSGVKAIDNEDGDITSKVIHLGEVDTSKAGNFEVKFLVRDAGGNEVTATQKVIVKDKGTENGSDNSNNNTNTGNVSDNNNNTNTGNGSDISNNNTSSTLDNKKDTIKELPKTGASSNNGTAVGILAILVGMLITFGRKFKKAIK

SEQ ID NO: 28418 - protein, 279 aa, Bacillus cereus VDM022
MNKAINKPLLIDGKEVTAETKFTAKEKNGFVTLDFTFVGAEQQGREVVVFEDLLHEGQVIATYADINDVGQTVRFVEPSIKTTATNKADGSKELDATKSVTIQDKVEYKDLIVGKEYVVKGKLMDKATNKPLLVDGKEVTAESKFTTKEKNGSITLELDFTFNASELQGKEVVVFEELYQDNVLVAIHVDIEDMGQTVEFKEVKSEQPKPEQPNPDKNTPTSEQPKEQVKEQPQLKKEIQSKIGWLPQTGTNLTSWISMAAGALLLIVGGVIFLKRKNA

SEQ ID NO: 28419 - protein, 738 aa, Bacillus cereus VDM022
MKQLKPAISVLGSVSMALTLASPALADVKQPNPGGTVEIFKENANVKKEDKNFTLGSDGEIGSLITQNIEMANNDWDKDGISNDLEINGYKIEFNSQTGKNEAKAWDPEKDKGKPKFISNPMNANTDGDPFTDMYEVENYNNDSDTNFNPIVANMPNLQIGVKRIEVIPIATITDNNGGSVSRGWEKSVSTQHSFNVGLSGSGGVEGSAAGPVPSGSVSANVGYGYSKTTTETESYTNNFDWSTATTVDTANAAKLRVHLEYKNVGTASAENVSPHFNIRLGNKIINTVKATQDRYKANYLSTEKGGRNKTEVVIDSLEGQADANIVLSLDELKAVEQGELLSIEVLPTSTMDLSIEKGEEIMHLGDSGRYESRVNAVTEQLETDIGNIPKFRVYTPKDKSLADKPVLSYNEVFQQVNIDTKKVNHIVNKAKSTNNVSVVSANNGTDALNDLKAGQGDRGYLHKDSVHGAFAKLQQPTLVEGSYDSVTQKIRATILPGLFGVSKDIPTTYSKKWNAPSQTVTLVKRENGFTYESRENIHPIKSEIAAHRKVTFEINDAHNLTPTQKIDTEIKANKEFEDYVVDNSGEFVTEGVPYTVASYGNTAYLGSHHAGNKWEYLWAEKSSDEKVNVIIERVGQPKPGKPIKKDEEVLIKFQNPIYSDYAYLKLQDSYIHLDQKQNASTFKFNHAYPKNFTGHHKQWNILSNGNKLKVGYLIDYMKYGNGENGTDTIAWNLSRVQ

SEQ ID NO: 28420 - protein, 83 aa, Bacillus cereus VDM022
GGNGSQGGNRVKGDSSSQGGNGSQGGNRVKGDSGSQSGNAKDNATKQGNKLPNTATHYPASILIGLSTFLIGVLLFIRRKNAK

SEQ ID NO: 28421 - protein, 958 aa, Bacillus cereus VDM022
MNKKSKFTQMILGISTMALSFGSIQTQVSAEENTPYNVLQKKPIGIETSTDEIAHSTKADETLSYEERLKVNDFSQRPAPVVKRAAAKQFQQKYSVTELNRMSDDELIDTLANVSWDQIADLSQFNQETKAFYQNKERIQVIIDELGRRGSTFTKDDTKGIETFVEVLYCGFYLGFNNKEINYLNERSFHDKCLPALKAIAKNPNFKLGTNKQDKVVSSYGKLISNASCDAETVQYAANIVKQYNDNISTYISDKNKGDALYNLIQAIDNDIQSYGKKADETIWYGKIDGFINEVSRMALLNQVTTENSWLINNGVYYTGRFGKFHSNPDKGLEILTQAMRMYPRLSEAYFNAVEQISTNYGGKDYNGNTVDLKKIREEGQKQYLPKTYTFDDGSIVFKTGDKVTEEKVKRLYWAAKEVKAQYHRVIGNDAALEAGKADDVLTIVIYNDPYEYKRNSQLYGYDTNNGGIYIEGKGTFFTYERTPQQSGYTLEELFRHEFTHYLQARYEVPGSWGQGELYQNERMTWFDEGNAEFFAGSTRTNNVVPRKSVISGLSSDPAQRYTAERTLFSKYGSWDFYNYSFALQSYLYTHQFETFDKIQDLIRANDVKGYDAYREALSKDPNLNKEYQDYMKQLIDNQDTYNTPQVSDDYLAEHAPKPLADVKKEIENVANIKDTTMTKHKSQFFDTFTLEGTYTGDVTKGESEDWKAMSKQINQSLEQLAQKEWSGYKTVTAYFVNYRVNANNQFEYDVVFHGVATGEEEKQTIKVNMNGPYNEMLNEKVEFHSDGTESTGGKIVSYLWDFGDGTTSTEANPTHVYGKEGTYTAKLTVKDNKGNVGRAQTTVTVKKDEPVGHGFDSAKEIRFNKLFKGNMDMPNMAYMYTFNVTSPKEVDISVIDEQGIGIGWNLIRGTDMEHPVAEGQVDGNNIKGKIELEPGKYYLVMFFSEENKNGTYSLLVK

SEQ ID NO: 28422 - protein, 183 aa, Bacillus cereus VDM022; identical to SEQ ID NO: 27302

SEQ ID NO: 28423 - protein, 138 aa, Bacillus cereus VDM022
MKKKLVPICAMALLTVGYSSTASANAGSMPKEEVTQVQQEQMKKEAMTQEQQNQDKMKKETTTQEQQKQEQMKKEAAMQQQNQDKMKKDQMKQEAAKKVTKGEKLPNTASNNILMMALSAGLLAIGSVFGFTRRKNKA

SEQ ID NO: 28424 - protein, 916 aa, Bacillus cereus VDM022
MMKNKKRTATVALTTGLALTAVIPYGVGHAEETDQLQVQIQEDSFRTGELTQPSQKAPENVVKDALKEKTEQALSPKQVNGEMGVDYKVLQKRGSYDGTTLVRMQQTYEGKEVYGYQLTAHVDKKGVIKSVSGDSAQNLKQEDLKKPINLSQEKAKQYIFTKYGNDIKFISEPEVKEVIFVDENNGQASNAYQVTFAAVTPKYVSGTYLVNAHNGEMLKNMVQDSDLKASEKLVDALEESRKSNLASLTGTGNDAFGISRTFGISKQSNGEYALADYSRGQGIETYDVNYRDITKEESYYPGTLATSTSTTFNDPKAVSAHYLATKVFDFYKDKYKRNSFDNKGQKVVSVVHAWDSEDTNDPKNWKNALSANINNSSMLVYGDPMVKAFDVAGHEFTHAVTSSESNLEYSGESGAINEALSDIMGTAIEKYINNGNFNWTIGEQTGLVLRDMKNPSSINYSNGVPYPDDYSKYTNLNGEDDGGVHFNSSIINKVAYLIAKGGTHNGVTVKGIGEDKMFDIFYYANTDELNMTSDFFELRSACLRVATNKYGANSAEAQAVQKAFDAAKIKVTVEEKEKAVEKQAPELTVPFTTTLHVGDTFDPMRGVKAVDKEDGDLTNRVKHKGDVDTSKPGNYIVEYSVVDSQGVNATATQTVIVEENGETPDMEPKLTVPVGATINVGDSFDPMARVSATNKEDGDLTSKVTVDGKVDTSKAGTYVLTYTVTDTKGHEVTAKQIVTVKAGEEVKDEKPVLKVPAETTIIEGNQFASMAGVSATDKEGGDLTSKVTHEGTVDTSKAGTYEVIYSVKDSAGNKVTTIQKVVVKDKDNGNGSNNRNNGSDNDNGSDNGSTGTNNSNASDTGNSNISNNSTTDKKEDTYKELPKTGASTNNSAAMGVLMVLAGMVLSFGRKFRKVLK

SEQ ID NO: 28425 - protein, 965 aa, Bacillus cereus VDM022
MNKKSKINKVLLSISTMALSLGAIQTNVSAEEKVPYNVLHSKPVGIEKPVDEIGHASKAEETLSFQERLKVGDFSQRPASITKNSAVKQAKESYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNQVTPENKWLVNNGIYFASRLGKFHSNPNKGLEVVTQAMHMYPRLSESYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHTSQFFNTFTLEGTFTGSVTKGESEDWKAMSKRVNEALEQLAQKEWSGYKTVTAYFVNYRVNSSNQFEYDVVFHGIAKDDGENKAPTVNVNGPYNGLVKEGIQFKSDGSNDEDGKIVSYLWDFGDGSTSTEVNPVHAYEREGTYKVALRVKDDKGKESRNETTVTITDGSLTESEPNNRPEEANRIGLNTTIKGSLIGGDHTDVYTFNVASAKDIDISVLNEHGIGMTWVLHHESNMQNYAAYGQANGNHIEAKFNAKPGKYYLYVYKYDNGDGAYALSVK

SEQ ID NO: 28426 - protein, 333 aa, Bacillus cereus VDM022
MKGKLLKGVLSFGIGLGALYSGSSAQAEMSINQNNTLKVMTHNVYMLSMNLYPNWGQNERADLIGAADYMKNQDVVILNEVFDNNASNRLLGNLKKEYPNQTAVLGRSNGNEWDKTLGNYSSSTPEDGGVAIVSKWPIIEKIQYVFEKGCGPDNLSNKGFVYTKVKKNDRFVHVIGTHLQAEDNMCGQTSPASVRTKQLQEIQEFIKNKNIPNNEYVLIGGDMNVNKINAENNSDSEYASMFKTLHASIPSYTGHTATWDATTNSIAKYNFPDSPAEYLDYIITSKDHANPSYIENKVLQSKSPQWTVTSWLKEYTYNDYSDHYPVEATISMK

SEQ ID NO: 28427 - protein, 209 aa, Bacillus cereus VDM022; identical to SEQ ID NO: 26769

SEQ ID NO: 28428 - protein, 182 aa, Bacillus cereus VDM022
MNKKLLTSLLCSTFLFGLSACSSHDTSSSNTKNEQETSKETKNDELSNKDPQKELPTHGDSSDVYISIHSADSLDVIGNGEVKAQGVFKVLDVAVYNRQEEPITLNNNNFKLIDETGREYHISNESQLVLKAANTATFKFGVLNPNENSEGNIVFDVPKNTQGLTLKINGDMLDEGIELKVE

SEQ ID NO: 28429 - protein, 503 aa, Bacillus cereus VDM022; identical to SEQ ID NO: 27384

SEQ ID NO: 28430 - protein, 164 aa, Bacillus cereus VDM022; identical to SEQ ID NO: 27379

SEQ ID NO: 28431 - protein, 458 aa, Bacillus cereus VDM022; identical to SEQ ID NO: 28199

SEQ ID NO: 28432 - protein, 455 aa, Bacillus cereus VDM022; identical to SEQ ID NO: 27557

SEQ ID NO: 28433 - protein, 277 aa, Bacillus cereus VDM022
MNKAINKPLLIDGKEITAETKFIAKEKNGFVTLDFTFVGAEQQGREVVVFEDLLHEGQVIATHADINDVGQTVRFVEPSIKTTATNKADGSKELDASKSVTIQDKVEYKDLIVGKEYVVKGKLMDKATNKPLLVDDKEVTVESKFTAKEKNGSITLDFTFNASALQGKEVVVFEELYQDNILVAIHAEFEDKGQTVKFKEVKPEQPKPEQPNQDKNTPTSEQPKEQVKEQPQPKKEIQSKIGWLPQTGADLTSWISMAAGALLLIVGGVIFLKRKNA

SEQ ID NO: 28434 - protein, 971 aa, Bacillus cereus VDM022; identical to SEQ ID NO: 27385

SEQ ID NO: 28435 - protein, 431 aa, Bacillus cereus VDM022; identical to SEQ ID NO: 26767

SEQ ID NO: 28436 - protein, 291 aa, Bacillus cereus VDM034
MEYTNLVVGKEYTVKGKLMNKAINEPLLIDGKEVTAETKFTAKEKNGFVTLDFSFVGAEQQGREVVVFEDLLHEGQVIATHADINDVGQTVRFVEPSIKTTATNKADGSKELDASKSVTIQDKVEYKDLIVGKEYVVKGKLMDKATKKPLLVDDKEVTVESKFTAKEKNGSITLDFTFNASALQGKEVVVFEELYQDNVLVAIHVDIEDKGQTVKFKEVKPEQPKPEQPNQDKNTQTSEQPKEQPQPKKEIQSKIGWLPQTGADLTSWISMAAGALLLIVGGVIFLKRKNA

SEQ ID NO: 28437 - protein, 918 aa, Bacillus cereus VDM034
MMKNKKRTATVALTTGLALTAVIPYGVGHAEETDQLQVQIQEDSFRTGELTQPSQKAPENVVKDALKEKTEQALSPKQVNGEMGVDYKVLQKRGSYDGTTLVRMQQTYEGKEVYGYQLTAHVDKKGVIKSVSGDSAQNLKQEDLKKPINLSQEKAKQYIFTKYGNDIKFISEPEVKEVIFVDENNGQASNAYQVTFAAVTPKYVSGTYLVNAHNGEMLKNMVQDSDLKASEKLVDALEESRKSNLASLTGTGNDAFGISRTFGISKQSNGEYALADYSRGQGIETYDVNYRDITKEESYYPGTLATSTSTTFNDPKAVSAHYLATKVFDFYKDKYKRNSFDNKGQKVVSVVHAWDSEDTNDPKNWKNALSANINNSSMLVYGDPMVKAFDVAGHEFTHAVTSSESNLEYSGESGAINEALSDIMGTAIEKYINNGNFNWTIGEQTGLVLRDMKNPSSINYSNGVPYPDDYSKYTNLNGEDDGGVHFNSSIINKVAYLIAKGGTHNGVTVKGIGEDKMFDIFYYANTDELNMTSDFFELRSACLRVATNKYGANSAEAQAVQEAFDAAKIKVTVEEKEKAVEKQAPELTVPFTTTLHVGDTFDPMRGVKAVDKEDGDLTNRVKHKGDVDTSKPGNYIVEYSVVDSQGVNATATQTVIVEENGETPDMEPKLTVPVGATMNVGDSFDPMAGVSATDKEDGDLTSKVTVDGKVDTSKAGTYVLTYTITDSKGHEVTAKETVTVRAREEVKDEKTVLKVPAETTITEGNQFDPMAGVSATDKEGGDLTSKVTHEGTVDISKAGTYEVIYSVKDFAGNEVTTIQKVVVKDKDNGNGSDNGNNGSDNNNGNNPDKGSTGTNNSNASDTGNSKISNNSTSDKKEDTYKELPKTGASTNNSAAMGLLMVLAGMALSFGRKFRKVLK

SEQ ID NO: 28438 - protein, 958 aa, Bacillus cereus VDM034
MNKKSKFTQMILGISTMALSFGSIQTQVSAEENTPYNVLQKKPIGIETSTDEIAHSTKADETLSYEERLKVNDFSQRPAPVVKRAAAKQFQQKYSVTELNRMSDDELIDTLANVSWDQIADLSQFNQETKAFYQNKERIQVIIDELGRRGSTFTKDDTKGIETFVEVLYCGFYLGFNNKEINYLNERSFHDKCLPALKAIAKNPNFKLGTNKQDKVVSSYGKLISNASCDAETVQYAANIVKQYNDNISTYISDKNKGDALYNLIQAIDNDIQSYGKKADETIWYGKIDGFINEVSRMALLNQVTTENSWLINNGVYYTGRFGKFHSNPDKGLEILTQAMRMYPRLSEAYFNAVEQISTNYGGKDYNGNTVDLKKIREEGQKQYLPKTYTFDDGSIVFKTGDKVTEEKVKRLYWAAKEVKAQYHRVIGNDAALEAGKADDVLTIVIYNDPYEYKRNSQLYGYDTNNGGIYIEGKGTFFTYERTPQQSSYTLEELFRHEFTHYLQARYEVPGSWGQGELYQNERMTWFDEGNAEFFAGSTRTNNVVPRKSVIRGLSSNPAERYTAERTLFSKYGSWDFYNYSFALQSYLYTHQFETFDKIQDLIRANDVKGYDAYREALSKDPNLNKEYQDYMKQLIDNQDTYNTPQVSDDYLAEHATKPLADVKKEIENVANIKDTTMTKHKSQFFDTFTLEGTYTGDVTKGESEDWKAMSKQINQSLEQLAQKEWSGYKTVTAYFVNYRVNANNQFEYDVVFHGVATGEEEKQTIKVNMNGPYNEMLNEKVEFHSDGTESTGGKIVSYLWDFGDGTTSTEANPTHVYGKEGTYTAKLTVKDNKGNVGRAQTTVTVKKDEPVGHGFDSAKAIRFNKLFKGNMDMPNMAYMYTFNVTSPKEVDISVIDEQGIGIGWNLIRGTDMEHPVAEGQVDGNNIKGKIELEPGKYYLVMFFSEENRNGTYSLLVK

SEQ ID NO: 28439 - protein, 898 aa, Bacillus cereus VDM034
MENEKKAQSGAIMAEDKNIVRKQNGLMGNFYGDKEFKNLLLIRGNSCVNEQINSNEIQHFRLKENQKIQSVRWQGFIQPKEDGIYTFSTGKHDQVMIQVDNSIVVDTLGREIEIKLQKEKLYRIIVEYQVNPDVKDAFTLLWTTEEKKEVVPHEVLYAPSLAQKDQPTVIGSLHQLNYAVDDFIKEETDTDNDNIPDSWEYEGYTVVDGEFGVKDLVKWDDDLHEGAVDKEGNPLVKYVSSPMKWSTSDDPYSDYEKVTGIQMDTRVTKEAHHPLVAAYPDVHIDMEKYLLIPNTNFQSGEGGSSSKQVTRGTSSTVSNTESWGTTVTANASLLDFGGSVSASYESSTTTSTTKDESVSDSTTKDWNEVLGVNTAEAGKILPNVRYVNTGTAPVFNVKPAFTLHFPKTSNGDAISLISSLIGETHKGLEVLPGKTYPDQSKPPLAFDKPTHFGESLMLDQGNVSRLQNNDMLKIETNGIDSKVVLIDTQGQDYTSSQDWTPVISKIKANTAEIVFTTVGGPVTKRNVAAPGTTHVEKTVPEMTFKEALKIGYNVIEKNGKLYINDREITKDTVSLIVDQATEAEMKKQGVKSIFDVKLKARMHFEITEKVNASVVPYGNDAASFNIQIPGGVAETASFEMYMNGQKKGAVEFIKDRKSWNGHVYSFNVFIGDALNRNNTFDLKVKGRTVATFKGLDYYNEFKNWYTPRSQYVDGVNFSKMPATKVRYQLEIDGKLTEIRSDAVSDANGNRLVNFLKFNAGHGISYTKNIKVYVVDEKNDNFKIKAAEHKPYDTATETDIKNAHIFDSWVYGDFNGFRHYSAMYFKPFPPSILDKITKYKIQHSSIGDVTRNRQNFKHDGRLEINFLDYNNGYGFPLFPVTKVWAVTKGNREIEVYSLF

SEQ ID NO: 28440 - protein, 105 aa, Bacillus cereus VDM034
GSGGNGSGGNGSGGSGSGGSGSGGSGSQGGNRVKGDSSSQGGNGSQGGNRVKGDSGSQSGNAKDNATKQGNKLPNTATHYPASILIGLSTFLIGVLLFIRRKNAK

SEQ ID NO: 28441 - protein, 968 aa, Bacillus cereus VDM034
MNKKSRFTQMMLGISTMALSFGSIQTQVSAEENTPYNVLQKKPIGIETSTDEIAHSTKADETLSYEERLKVGDFSQRPDPVVKRAAAKQFQQKYSVAELNRMSNDEFIDTLASISWNQITDLDQFNQETKEFYQNKERIQVIIDELGRRGSTFTKDDTKGIETFAEVLRSISYVGFNNKEVSYLNERSFHDKCLPALKAIAKNPNFKFGTDKQDAVVSAYGKLIRNASCDAETVQYAANILKQYNDNISTYISDKKKGDALFELIQGIDDDIQSYLFETRKKADETIWYGKIDGYINEVSRMALLNHLTTENKWLINNGIYYTGRLGNFHSNPNKPLEVLTQAMHMYPRLSEAYFNAVEQISTNYGGKDYNGNTVDFKKIREEGQQQYLPKTYTFDDGSIVFKTGDKVTEEKVKKLYWAAKEVKAQYHRVIGKDGALESGKADDVLTIVIYNNPDEYKRNSQLYGYDTNNGGIYIEGIGTFFTFERTPQQSRYSLEELFRHEFTHYLQGRYEVPGSWGQGEMYQDQRLTWFEEGNAEFFAGSTRTNNVVPRKSIISGLSSDPAKRYTAERTLFSKYGEGEGDEKWDFYNYSFALQSYLYTHQFETFDKIQDFIRANDVKNYDAYREALSKDPNLNKGYQDYMKQLIDNQGTYNTPQVSDDYLATPSLKPLADVKKDITDVAKIKDATITKHKSQFFDTFTLEGTYTGGVTKGESEDWKTMSKKINQSLEQLAQKEWSGYKTVTAYFVNYRVNANNQFEYDVVFHGVATGEEEKQTVKVNMNGPYNEILNEKVEFHSDGTESTGGKIVSYLWDFGDGTTSTEANPTHVYGKEGTYTAKLTVKDNKGKVGRGQTSVTVKQDEPAGHNYQNAKVIRFNKLSKGNMDRPNLAYMHTFNVTSPKEVDISFIDEQGIGIQWDVYHESDLEHPVITGQADGNNIKGKFEAKPGKYYLVSFFEKENGKGTYSLVVK

SEQ ID NO: 28442 - protein, 746 aa, Bacillus cereus VDM034
MGNNSKNKTRKMLAATATVTMLATGMISSSDVFAEERQQQKKLSTSLQEEKSVKLENRTYTVPGKGDVEVLKQQERKSMAFSPYEPTGLYAKPNEQITINVEGNQDIQAYIGTYSYDASWREDSKIKSFTLKPGINTIQSPNGGMIYFYNKQQGGTIRTTVTTGGTTTPFFELGKHTKQDLINMLDQYPNAHAVELKGERVLITASPARVKKYLLGSNTDPVQLLKKMDEATRIQDKVAGLSEEQVDKHYVHYVEENHSPDYYMYAYPYRTAYVGDAIQYVLDINKFVKDGWGPWHEAGHLRQQWPWNFYNMTEVQNNIYSLSVEKAFNQPSNFEKSGIYPKAFQYLEQTNKNYDEISDVFVKLVMLWQLQLAYGEDFYPNLHQLYRDMPSNELPQTDENKKQLFMISASKVAKQNLIPFFEKWGLRPNNDTIQKVTALGYPILTAEIWKGTDSNPIKPDMPNGNNILEGKQFAWSLKGISDFEFAKINFNKSTEEMQIDLKAGIPHHYFNETYASIKVQSSSGKVVYKKDIYGNEQQNAESQKVPVKVGDFIELTHLEGVHRATFMNVDNSKQESFGKKAIYEVTKDGLKKVNQIVNPKPDTEAPTQPQELYASNLTSNSVELKWNPSTDNVGVKEYQVLRDGQLIQTVQGTTFTDQNLTANKEYKYAVKAVDAAGNTSIQSNILPVKTKDQNVSYEKWDPKKAYTKGDKVEHQGKVYEAVQNHQGNGDQNWIFALSLWKPITIK

SEQ ID NO: 28443 - protein, 727 aa, Bacillus cereus VDM034
MKKLKPALSVLGSVSMALTLASPALADIKQPNAGSTIEMFKEDANAKEGKDLIYGTDGKKGKMSTEKIEIQNNDWDQDGISNDLEIKGYKIEFNRQTGKNEAQAWDPERDKDKLKFITNPMSANSDGDPFTDAYEVQYYGSNSDTEFNPMVANIPNLQVGIKRIGVTPLAAITDSNGGSIDKGWEKSVSTQHSFGVGAGVEGGVEGSAAGPVPSGKASLNVSYGYSKTSTDTERYSSNIDWSTAKTVDSAKAAKVSLQLEYKNTGTASAQNVSPHFNIRLGDKIISTVKATQDRYKANQLSTEKGGRNTTEVLIDSVDNQADVNIYLSLDELKAVEQGAILSVEVLPTSTMELYIEKDGEFMNLGDSGKFESRVNASTTILETDIGNKPKFRMYAPEGVGSDTNLTFNEVLKHVKVDSKKINEFIDNSRGDQVIIAKENLENAKKSYVSKGAKVGVFTKIQQPELSYSAYDPFTKKFYAAVVPGLFGASNEISVSFENKNSKQTQQVTLVRKGNVYESKEAVSLNDFNPSQKVTFEINDAQKKLPTQKISTVVTYNKEYENYLTHRFSDELIVEGTPYTLKASGYPVLSYKGNDKWQYLAYGGNYTQPVNVIIERKGQPKPGQPIKKGEEVHIKVQNSAYSGYEYLKLQNGYIHFDQKQNASTFKFNHTHSPGSYDYQREWNLQSDGNNIGLDKGGSGYVTYGNDVQVYPVGNGNVILDRWSFEKAK

SEQ ID NO: 28444 - protein, 431 aa, Bacillus cereus VDM034; identical to SEQ ID NO: 26767

SEQ ID NO: 28445 - protein, 455 aa, Bacillus cereus VDM034
MNNRFLKQLQNLKMNKKSIGAVALTAGIISTTLIPQNAYAHGFVEKPGSRSALCSPTYGSLNVNCGSVMYEPQSLEAPKGFPQGGPVDGQIASAGGKFGGILDQQTANRWFKNTITGGENTFTWKYTAPHLTSKWHYYITKKGWNPNKALTRADFEPIGTVQHDGSAASNNLTHKINVPTDRSGYHVILAVWDVADTANAFYNVIDVNLINNVKPDTEAPSIPNGIQAQKVTANSIELTWNVSTDNVGVKGYQIFRNGEMIDTVPGTYFIDKKLQPSTEYTYTVKAIDAAGNVSKESTALTVKTTVEAPDTEAPTQPKGLHSMGTTASSVDLMWSPSDDNVGVDYYDIYREIEGTMKKIATSNTTSYMDKNLLANTTYKYAVKAVDVVGNESVQSDTFTITTKTESASYEAWDAKKAYKKEDRVLHEGKVYEAVQNYEGHGDPNWIFALSLWKTV

SEQ ID NO: 28446 - protein, 164 aa, Bacillus cereus VDM034
MKKKLLPICAMALLTVGYSSVASASTGTLTKEESAQMQQDKAKKEEAIKEQQKSEVEKKEAAQVQEKSDMAKKEEAIKAGQKNDTAKQEVTPQVQEKEALAKKEAAIKAGQKNDAAKQEVAKQAVQGEKLPNTASNNVAMMALSACLVGIGTLFGLKRRNKVKA

SEQ ID NO: 28447 - protein, 183 aa, Bacillus cereus VDM034; identical to SEQ ID NO: 27302

SEQ ID NO: 28448 - protein, 971 aa, Bacillus cereus VDM034
MKGYSKKVLVGVSFASLMLGSFQGSILAEDTKGEQVSYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTQDDSKGIETLVEVLRSGFYLGFYNTELSKLNERSYHDKCLPALKTIANNPNFKLGTLEQNKVVSSYGKLIGNASSDVETITSAAKIFKQYNDNFSTLVDNLSAGNAIYDIMQGVDYDIQSYLYDTRKAPKDTVWYQKIDSYINELSRFALMGTITEKNGWLINNGIYYTARLGTFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSAIAAEITAEAKLSNVSVKKNKSQFFNTFTLQGTYTGTAAKGENEDWKTITQNVNDTLKRLSAKEWTGYKTVTAYFVNYRVNASGQFEYDVVFHGINTEEGAVNKAPVAVINGPYSGHTNEAISFKSDGSKDEDGKIISYKWELGDGTVSNEQNPTHVYTKEGTYTAKLTVTEDKGLTNTATTSVTVQKKEDNSVEKEPNNSFQTANKLQLNQVLRASLGNGDTSDYFEINIETAKNLQINVTKENNIGVNWVLYSEADLNNYVTYAQQQGNKLVGSYYTYPGKYYLHVYQYGGGTGNYTVEVK

SEQ ID NO: 28449 - protein, 378 aa, Bacillus cereus VDM034
MKTKQTIAASTLALAMIAGANSTHAEVTDATPQQSTGDRLAEIKQHRQELDAKLQQHKENVDQTLNELNQVKENVDTKVNELHERKQVADEKIGEIKQHKQELDAKLQQDKQIAEDKIAEIKEHKKQVDEKVAEIKEHKQTVDEKVNEIKEHKQTVDEKVNEIKQHKENIDQKVNELKEVKKQVDDKLAELKKAKQTAEDKLAEIKENKPNTGNTLEELKKIKGNLDSLSSNLELAKQDVKNKLAELQEARQDLLNKINEMKQAKQTVSDDLTKKKQDLDIKINDFKHTEKKIDDKLAELHTTKQNVDNKINEVSQPKQTTVNNNTTTTPSTVPAKNNARELPNAGSEESNNMALGMLSVLGGVLLITRNKIKTLFSK

SEQ ID NO: 28450 - protein, 503 aa, Bacillus cereus VDM034
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGEGKGLLAVSDYQPVTGVKEVTKKISEKDAEQKSMAYVGGESEQNLWAPTEKEFGYIVEEGVAIPVYKVVVHSNNPFGAWETFIDAENGKLIKKVDINRKAEGTGKVFLPNPVVSSGSLAGLKDNNDADSTALTNQLKTVTLKGLDGTGFLIGEYVTISSKAKTKSTNLQFNYTRANDSFEDVMSYYHIDTLQRYIQGLGFQNINKRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDAAAYSSSDPTCLRRLDTNKVYPKDITNEVHNDGEIWAQGQYEMAQSFGRDVATKIILQSHWSLTPNAKFRDGAKAIKQADALLYGGQHAAEIDRIWTARGISTN

SEQ ID NO: 28451 - protein, 458 aa, Bacillus cereus VDM034; identical to SEQ ID NO: 26793

SEQ ID NO: 28452 - protein, 209 aa, Bacillus cereus VDM034
MLKKFTTCILGGALVFNLSGCGNTSDKTSSESKETNSKQEEKKVQTTDEAKPKENAKQKNTEQTKEKSKVKEKEYAVNKDFHTPKFDVTVKRVVERDKVGKESIGIQEPENGHVFIVVEVEGKNITNESMKLAVLPSVDLVDENDNAYQSDVWATSSYEVEKGETSTITKELKPGEVKRQNKVYVINKEKFDTGKWYVLVNHEYKEQIK

SEQ ID NO: 28453 - protein, 965 aa, Bacillus cereus VDM034
MNKQSKINKVLLSISTMALSLGAIQTNVSAEEKVPYNVLHSKPVGIEKTVDEIGHASKAEETLSFQERLKVGDFSQRPASITKNSAVKQAKESYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNDVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHTSQFFNTFTLEGTFTGSVTKGESEDWKAMSKRVNEALEQLTQKEWSGYKTVTAYFVNYRVNSSNQFEYDVVFHGIAKDDGENKAPTVNVNGPYNGLVKEGIQFKSDGSNDEDGKIVSYLWDFGDGSTSTEVNPVHAYEREGTYKVALRVKDDKGKESRNETTVTIKDGSLTESEPNNRSEEANRIGLNTTIKGSLIGGDHTDVYTFNVASAKDIDISVLNEYGIGMTWVLHHESDMQNYAAYGQANGNRIEAKFNAKPGKYYLYVYKYDNGDGAYALSVK

SEQ ID NO: 28454 - protein, 133 aa, Bacillus cereus VDM034
MNKKLLTSLLCSTFLFGLSACSSHDTSSSNGEVKAQGIFKVLDVAVYNRQEEPITLNSNNFKLIDGTGREYHISNESQLVLKAANTATFKFGVLNPNENSEGNIVFDVPKNTQGLTLKINGDMLGEGIELKVE

SEQ ID NO: 28455 - protein, 333 aa, Bacillus cereus VDM034
MKGKLLKGVLSFGIGLGALYSGSSAQAEMSINQNNTLKVMTHNVYMLSTNLYPNWGQNERADLIGAADYMKNQDVVILNEVFDNNASNRLLGNLKKEYPNQTAVLGRSDGNEWDKTLGNYSSSTPEDGGVAIVSKWPIIEKIQYVFEKGCGPDNLSNKGFVYTKVKKNDRFVHVIGTHLQAEDNMCGQTSPASVRTKQLQEIQEFIKNKNIPNNEYVLIGGDMNVNKINAENNSDSEYASMFKTLHASIPSYTGHTATWDATTNSIAKYNFPDSPAEYLDYIITSKDHANPSYIENKVLQSKSPQWTVTSWLKEYTYNDYSDHYPVEATISMK

SEQ ID NO: 28456 - protein, 958 aa, Bacillus cereus VDM062
MNKKSKFTQMILGISTMALSFGSIQTQVSAEENTPYNVLQKKPIGIETSTDEIAHSTKADETLSYEERLKVNDFSQRPAPVVKRAAAKQFQQKYSVTELNRMSDDELIDTLANVSWDQIADLSQFNQETKAFYQNKERIQVIIDELGRRGSTFTKDDTKGIETFVEVLYCGFYLGFNNKEINYLNERSFHDKCLPALKAIAKNPNFKLGTNKQDKVVSSYGKLISNASCDAETVQYAANIVKQYNDNISTYISDKNKGDALYNLIQAIDNDIQSYGKKADETIWYGKIDGFINEVSRMALLNQVTTENSWLINNGVYYTGRFGKFHSNPDKGLEILTQAMRMYPRLSEAYFNAVEQISTNYGGKDYNGNTVDLKKIREEGQKQYLPKTYTFDDGSIVFKTGDKVTEEKVKRLYWAAKEVKAQYHRVIGNDAALEAGKADDVLTIVIYNDPYEYKRNSQLYGYDTNNGGIYIEGKGTFFTYERTPQQSSYTLEELFRHEFTHYLQARYEVPGSWGQGELYQNERMTWFDEGNAEFFAGSTRTNNVVPRKSVIRGLSSNPAERYTAERTLFSKYGSWDFYNYSFALQSYLYTHQFETFDKIQDLIRANDVKGYDAYREALSKDPNLNKEYQDYMKQLIDNQDTYNTPQVSDDYLAEHAPKPLADVKKEIENVANIKDTTMTKHKSQFFDTFTLEGTYTGDVTKGESEDWKAMSKQINQSLEQLAQKEWSGYKTVTAYFVNYRVNANNQFDYDVVFHGVATGEEEKQTIKVNMNGPYNEMLNEKVEFHSDGTESTGGKIVSYLWDFGDGTTSTEANPTHVYGKEGTYTAKLTVKDNKGNVGRAQTTVTVKKDEPVGHGFDSAKAIRFNKLFKGNMDMPNMAYMYTFNVTSPKEVDISVIDEQGIGIGWNLIRGTDMEHPVAEGQVDGNNIKGKIELEPGKYYLVMFFSEENRNGTYSLLVK

SEQ ID NO: 28457 - protein, 918 aa, Bacillus cereus VDM062
MMKNKKRTATVALTTGLALTAVIPYGVGHAEETDQLQVQIQEDSFRTGELTQPSQKAPENVVKDALKEKTEQALSPKQVNGEMGVDYKVLQKRGSYDGTTLVRMQQTYEGKEVYGYQLTAHVDKKGVIKSVSGDSAQNLKQEDLKKPINLSQEKAKQYIFTKYGNDIKFISEPEVKEVIFVDENNGQASNAYQVTFAAVTPKYVSGTYLVNAHNGEMLKNMVQDSDLKASEKLVDALEESRKSNLASLTGTGNDAFGISRTFGISKQSNGEYALADYSRGQGIETYDVNYRDITKEESYYPGTLATSTSTTFNDPKAVSAHYLATKVFDFYKDKYKRNSFDNKGQKVVSVVHAWDSEDTNDPKNWKNALSANINNSSMLVYGDPMVKAFDVAGHEFTHAVTSSESNLEYSGESGAINEALSDIMGTAIEKYINNGNFNWTIGEQTGLVLRDMKNPSSINYSNGVPYPDDYSKYTNLNGEDDGGVHFNSSIINKVAYLIAKGGTHNGVTVKGIGEDKMFDIFYYANTDELNMTSDFFELRSACLRVATNKYGANSAEAQAVQEAFDAAKIKVTVEEKEKAVEKQAPELTVPFTTTLHVGDTFDPMRGVKAVDKEDGDLTNRVKHKGDVDTSKPGNYIVEYSVVDSQGVNATATQTVIVEENGETPDMEPKLTVPVGATMNVGDSFDPMAGVSATDKEDGDLTSKVTVDGKVDTSKAGTYVLTYTITDSKGHEVTAKQTVTVRAREEVKDEKTVLKVPAETTITEGNQFDPMAGVSATDKEGGDLTSKVTHEGTVDISKAGTYEVIYSVKDFAGNEVTTIQKVVVKDKDNGNGSDNGNNGSDNNNGNNPDKGSTGTNNSNASDTGNSKISNNSTSDKKEDTYKELPKTGASTNNSAAMGLLMVLAGMALSFGRKFRKVLK

SEQ ID NO: 28458 - protein, 968 aa, Bacillus cereus VDM062; identical to SEQ ID NO: 28441

SEQ ID NO: 28459 - protein, 183 aa, Bacillus cereus VDM062; identical to SEQ ID NO: 27302

SEQ ID NO: 28460 - protein, 503 aa, Bacillus cereus VDM062
MLNKKMVAMAMTVPLVMGTISTVSALEKQQQVKLEAYSPQKKAIEYLKGHATEYGLKADLSDLQYISTTETSVASYVRFQQVVNGAPVFSKQITVTLNGEGKGLLAISDYQPVTGVKEVTKKISEKDAEQKSMAYVGGESEQNLWAPTEKEFGYIVEEGVAIPVYKVVVHSNNPFGAWETFIDAENGKLIKKVDINRKAEGTGKVFLPNPVVSSGSLAGLKDNNDADSTALTNQLKTVTLKGLDGTGFLIGEYVTISSKAKTKSTNLQFNYTRANDSFEDVMSYYHIDTLQRYIQGLGFQNINKRSIKVNVNGTTDDNSFYSPSTKALTFGTGGVDDAEDAGIIAHEYGHSIQDNQVPGFGSSPEGGAMGEGFGDFLGATYEDAVSTTGYGKACIGEWDAAAYSSSDPTCLRRLDTNKVYPKDITNEVHNDGEIWAQGQYEMAQSFGRDVATKIILQSHWSLTPNAKFRDGAKAIKQADALLYGGQHATEIDRIWAARGISTN

SEQ ID NO: 28461 - protein, 455 aa, Bacillus cereus VDM062; identical to SEQ ID NO: 28445

SEQ ID NO: 28462 - protein, 971 aa, Bacillus cereus VDM062
MKGYSKKVLVGVSFASLMLGSFQGSILAEDTKGEQVSYRNVLKMEPVGVQLPVEELAHSSKVLESKSFEKRLQFADLSQRPPEVKKESKQLAVAKTYTIAELNQLSNQQLVDLLVTIDWEQITGLFQFNKDSLAFYQNDSRMQAIIDKLKQQGQAYTQDDSKGIETLVEVLRSGFYLGFYNTELSKLNERSYHDKCLPALKTIANNPNFKLGTLEQNKVVSSYGKLIGNASSDVETITSAAKIFKQYNDNFSTLVDNLSAGNAIYDIMQGVDYDIQSYLYDTRKAPKDTVWYQKIDSYINELSRFALMGTITEKNGWLINNGIYYTGRLGTFHSTGTKGLQVVTDAMKIYPYLGEQYFVAAEQITTNYGGKDANGNVVNLDQIREDGKKKYLPKTYTFDDGAIVLKAGDKVTEEKVKRLYWAAKEVKAQFHRTVEGDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGLSSNPAERYTAERTLNAKYGTWDFYNYSFALQSYMYNKRYDMFDKVHDLIRKNDVTAYDAYRSALSKDANLNKEYQDYMQMLVDNREKYNVPLVSDDYLATHAPKPVSAIAAEITAEAKLSNVSVKKNKSQFFNTFTLQGTYTGTAAKGENEDWKTITQNVNDTLKRLSAKEWTGYKTVTAYFVNYRVNASGQFEYDVVFHGINTEEGAVNKAPVAVINGPYSGHTNEAISFKSDGSKDEDGKIISYKWELGDGTVSNEQNPTHVYTKEGTYTAKLTVTEDKGLTNTATTSVTVQKKEDNSVEKEPNNSFQTANKLQLNQVLRASLGNGDTSDYFEINIETAKNLQINVTKENNIGVNWVLYSEADLNNYVTYAQQQGNKLVGSYYTYPGKYYLHVYQYGGGTGNYTVEVK

SEQ ID NO: 28463 - protein, 164 aa, Bacillus cereus VDM062; identical to SEQ ID NO: 28446

SEQ ID NO: 28464 - protein, 931 aa, Bacillus cereus VDM062
MQNTVSSKVDQVTVIGLVGFYFKDTAFKDLMFIQVGEKSNLMDKSRINTVSQQIQSVRWMGNLIPPQTGEYKLSTSFNNNVIMQINGETVINQSNIEKSLQIEKDKVYEIKIEYRDTSDTLSDLQLFWSIGDTERELIPEKYILSPNFSEKENVLAEKEVTPFFPDYNLFDRQQDNGQKQSISAPLDSDNDGIPDEWEEKGYTFKDNQIVAWNDSFSALGYRKYVSNPRKARTAADPYTDFEKVTGHMPAATKDDARDPLVAAYPAVGVGMEKLHFSKNDNVSEGDSGTVSKTTTKTDTTTNTVEAGGSAGWDGKKFSLSFSAKYSHSWSNSTSTADTDSRTWSSQIGINTAERAYLNANVRYYNAGSAPIYELRPTSNFVFQNSGDSITTITAGPNQIGNSLGPGATYPQKGQAPISLDKANETGTIKISINAEQLDKLQDGTEILNLETTQNKGQYAILDAGGTPVTDPSKQWDPIRTNIDAVSGSLTLNLGTGKDSLERRVTARNMNDPEDKTPEITIKEAIEKAFNAKEKDGRLYYTDQDGKNIFIDEPAINLIVDQNTKKEIENQLSQMPGKKIYDAKWKRGMKITLHVPTSYSDFETGNPTWHHISYGSDGGNSGKRYGRMETRGWASLPELKPYTSYTARAYARTASATGNNDVNFFVGNEAGGGQGVSIKGKLTGDKWKLVELSFNTVANPEYFRSIGFINEGNAALHFDDVSVTEWKPTEDIKKGHGLGKCKYSASIPLIDGITFPRIPSTKVRYQLEIDGKMTDIRSDAVIDASGTRYVNFHKFNNGNGIDMYKRIIVFAVDEKNDNLKAKLNVYSEFEYESMDTGYVGNNRYINGITYGKVPLENFKYQLYVNGNWTSILYGDAKPNGKMYINFLSFNNGRGYHIVNGFTIQIFTVNINDNNKKTYLATLSFREGNFIYS

SEQ ID NO: 28465 - protein, 727 aa, Bacillus cereus VDM062; identical to SEQ ID NO: 28443

SEQ ID NO: 28466 - protein, 297 aa, Bacillus cereus VDM062
MEYTNLVVGKEYTVKGKLMNKAINEPLLIDGKEVTAETKFTAKEKNGFVTLDFSFVGAEQQGREVVVFEDLLHEGQVIATHADINDVGQTVRFVEPSIKTTATNKADGSKELDASKSVTIQDKVEYKDLIVGKEYVVKGKLMDKATKKPLLVDGKEVTVESKFTAKEKNGSITLDFTFNASALQGKEVVVFEELYQDNVLVAIHVDIEDKGQTVKFKEVKPEQPKPEQPHQDKNTPTSEQPKEQVKEQPQPQPKKEIQSKIGWLPQTGADLTSWISMAAGALLLIVGGVIFLKRKNA

SEQ ID NO: 28467 - protein, 458 aa, Bacillus cereus VDM062; identical to SEQ ID NO: 26793

SEQ ID NO: 28468 - protein, 333 aa, Bacillus cereus VDM062; identical to SEQ ID NO: 28455

SEQ ID NO: 28469 - protein, 965 aa, Bacillus cereus VDM062
MNKQSKINKVLLSISTMALSLGAIQTNVSAEEKVPYNVLHSKPVGIEKPVDEIGHASKAEETLSFQERLKVGDFSQRPASITKNSAVKQAKESYSMADLNKMNDQELIETLGSIKWHQITDLFQFNEDAKAFYKDNGKMQVIIDELAHRGSTFTKDDSKGIQTFTEVLRSAFYLAFYNNELSDLNERSFQDKCLPALKAIAKNPNFKLGTNEQDTVVSAYGKLISNASSDVETVQYASNILKQYNDNFNAYVDDRMKGQAVYDMMQGIDYDIQSYLNEARKEANETMWYGKVDGFINEINRIALLNDVTPENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEQGNADDVLTIVIYNTPDEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVGNYDTYRETLSKDSKLNKEYQEYMQQLIDNQDKYNVPEVADDYLAEHAPKALTEVKKEISETLSMKDTKMTKHTSQFFNTFTLEGTFTGSVTKGESEDWKAMSKRVNEALEQLTQKEWSGYKTVTAYFVNYRVNSSNQFEYDVVFHGIAKDDGENKAPTVNVNGPYNGLVKEGIQFKSDGSNDEDGKIVSYLWDFGDGSTSTEVNPVHAYEREGTYKVALRVKDDKGKESRNETTVTIKDGSLTESEPNNRSEEANRIGLNTTIKGSLIGGDHTDVYTFNVASAKDIDISVLNEYGIGMTWVLHHESDMQNYAAYGQANGNRIEAKFNAKPGKYYLYVYKYDNGDGAYALSVK

SEQ ID NO: 28470 - protein, 133 aa, Bacillus cereus VDM062; identical to SEQ ID NO: 28454

SEQ ID NO: 28471 - protein, 291 aa, Bacillus cereus VDM062; identical to SEQ ID NO: 28436

SEQ ID NO: 28472 - protein, 209 aa, Bacillus cereus VDM062; identical to SEQ ID NO: 28452

SEQ ID NO: 28473 - protein, 378 aa, Bacillus cereus VDM062; identical to SEQ ID NO: 28449

SEQ ID NO: 28474 - protein, 297 aa, Bacillus cereus VDM062
MEYTNLVVGKEYTVKGKLMNKAINEPLLIDGKEVTAETKFTAKEKNGFVTLDFSFVGAEQQGREVVVFEDLLHEGQVIATHADINDVGQTVRFVEPSIKTTATNKADGSKELDASKSVTIQDKVEYKDLIVGKEYVVKGKLMDKATKKPLLVDDKEVTVESKFTAKEKNGSITLDFTFNASALQGKEVVVFEELYQDNVLVAIHVDIEDKGQTVKFKEVKPEQPKPEQPHQDKNTPTSEQPKEQVKEQPQPQPKKEIQSKIGWLPQTGADLTSWISMAAGALLLIVGGVIFLKRKNA

SEQ ID NO: 28475 - protein, 431 aa, Bacillus cereus VDM062; identical to SEQ ID NO: 26767

SEQ ID NO: 28476 - protein, 150 aa, Bacillus cereus VPC1401
MVASGGDSTEKTSTDSKAVSKEGVSSDVKIAVGSMETVDSVGNEYTKEQAQGVFKILEVTLTNNQKDAITVDANSFKLVDNKGREFTYSTQGQTSFDLTNGGKTDFFLKQLNPGLTQTGKIVFDIPKDAEGLFLKASGGMTGKEINLKVE

SEQ ID NO: 28477 - protein, 372 aa, Bacillus cereus W
MKTKQTIAASTLALAMIAGANSAHAEVNDATPQQSTGDRLAEIKQHKQELDAKLQQHKENVDQTLNELNKVKENVDTKVNELHERKQVADEKINEIKQHKQELDAKLQQDKQIAEDKIAEIKEHKKQVEDKVAEVKEHKQNIDNKVNEIKEHKQTVDEKVNEIKQHKENIDQKVNELKEVKKQVDEKLAELKKAKQTAEDKLAELKENKPNTGNTLEELKKIKSNLDSLSANLELAKQDVKNKLAALQEARQDLINKINEIKQSKQTVSDDLSKKKQDLDIKINDFKHTEKKIDDKLAEIHTTKQNVDNKINEVSQSKQTETKTGTTNANNNARELPNAGSEQSNNMALGMLSVLGGILLVTRNKIKTLFSK

SEQ ID NO: 28478 - protein, 455 aa, Bacillus cereus W
MNNRLLKQLQNMKMNKKSLGAVALTAGIIGTTLIPQNTYAHGFVEKPGSRSALCSPTYGALNVNCGSVMYEPQSLEAPKGFPQGGPVDGQIASAGGKFGGILDQQTADRWFKNTITGGENTFTWKYTAPHLTSKWHYYITKKGWNPNKALTRADLEPIGTVQHDGSAASNHLTHKINVPTDRSGYHVILAVWDVADTANAFYNVIDVNLINDVKPDTEAPSIPNRIQAQKVTANSIELAWNASTDNVGVKGYQIFRNGEMIDTVPGTYFIDKKLQPSTEYSYTVKAIDAAGNVSKESATLTVKTTVEVPDTEAPTQPKGLHSMGTTASSVDLMWSPSDDNIGVDHYDIYRETKGLMEKIATSNTTSYMDKYLLSNTTYKYVVKAVDVAGNESVQSDIFIITTKTESVSYEEWDAKKAYEKGDRVLHEGKVYEAVQSYKGNGDPNWIYALSLWKTV

SEQ ID NO: 28479 - protein, 1297 aa, Bacillus cereus W
MEGNGGKSKIKSPLNSNFKILSDLVGPTFPPVPTGMTGITGSTGATGTTGATGETGPTGTTGATGETGPTGTTGATGETGPTGSTGATGTTGATGETGPTGSTGAMGTTGATGETGPTGSTGAMGTTGATGSTGPTGSTGPTGETGSTGSTGATGTTGATGETGATGPTGSIGAMGTTGATGETGPTGSTGATGSTGVTGSTGPTGETGATGSTGAIGNTGPTGSTGETGATGSTGAIGNTGPTGSTGETGVTGSTGPTGNTGATGSTGVTGNTGSTGATGPTGSTGATGNTGATGSTGVTGNTGATGAIGPTGSTGATGETGSTGNTGPTGSTGVTGNTGATGETGPTGSTGATGSTGVTGNTGATGSTGATGNTGPTGSTGETGATGNTGPTGETGVTGSTGPTGNTGATGETGVTGPTGSTGVTGSTGPTGSTGATGTTGATGETGPTGSTGAMGTTGATGETGPTGSTGAMGTTGATGSTGPTGSTGPTGETGSTGSTGATGTTGATGETGATGPTGSIGAMGTTGATGETGPTGSTGATGSTGVTGSTGPTGETGATGSTGAIGNTGPTGSTGETGVTGSTGPTGNTGATGSTGVTGNTGSTGATGPTGSTGATGNTGATGSTGVTGNTGATGSTGVTGSTGPTGETGATGSTGAIGNTGPTGSTGETGVTGSTGPTGNTGATGSTGVTGNTGSTGATGPTGSTGATGNTGATGSTGVTGNTGATGAIGPTGSTGATGETGSTGNTGPTGSTGVTGNTGATGETGPTGSTGATGSTGVTGNTGATGSTGATGNTGPTGSTGETGATGNTGPTGETGVTGSTGPTGNTGATGETGVTGPTGSTGVTGSTGPTGSTGATGNTGATGETGPTGNTGVTGSTGPTGETGVTGGTGPTGETGVTGSTGPTGSTGVTGNTGATGATGPTGETGVTGNTGPTGETGVTGSTGVTGNTGPTGSTGATGNTGPTGETGATGSTGVTGSTGATGNTGATGSTGVTGSTGATGNTGATGSTGPTGNTGATGSTGPTGSTGATGNTGPTGETGPTGSTGVTGNTGATGSTGVTGNTGATGATGSTGPTGSTGVTGSTGATGSIGATGATGSTGPTGSTGATGATGSTGPTGSTGATGVTGSTGPTGSTGTTGNTGVTGDTGPTGATGVSTTATYAFANNTSGSVISVLLGGTNIPLPNNQNIGPGITVSGGNTVFTVANAGNYYIAYTINLTAGLLVSSRITVNGSPLAGTINSPTVATGSFSATIIASLPAGAAVSLQLFGVVALATLSTATPGATLTIIRLS

SEQ ID NO: 28480 - protein, 431 aa, Bacillus cereus W; identical to SEQ ID NO: 26106

SEQ ID NO: 28481 - protein, 306 aa, Bacillus cereus W
MNIKQSFKLLAMFLSILFVLFPLQKAFAEVMDHTKYQMDWSYSKSKKKPIRTELIKTADGKIAFCLNVDLKSPSGQDLPEMGKVDINVYRVLLNGYPQKSPQELGVSDWREAHYATQLAVWNALKQIDINDLDFRNKNVEKVTKDIVAKASASEELQEITMSVTPTEEQEAVLKNDFFETGLYTVETNAKSGTYKVQATGAPAGAKFVNEKGETKTEFNVGEKFRILIPKQTPAGGFSFKVIGKLTKLQGIAHKGTPTIQNAVVLLERSEEETSPELSVSWKKGNGHDNNKPHTPNEPNKPNQYKR

SEQ ID NO: 28482 - protein, 148 aa, Bacillus cereus W; identical to SEQ ID NO: 27692

SEQ ID NO: 28483 - protein, 471 aa, Bacillus cereus W
MDCFKKGKFIPFPCALPIPEAGPTGPTGPPGSAGGSTGPTGPTGPQGLQGIQGVQGNPGTTGPQGIQGIQGIPGVSGPIGPIGPTGIQGVQGIQGFPGIPGPMGPIGLTGPTGIQGIQGIQGVQGIQGIQGDVGPTGPQGIPGIPGLTGPTGSQGVTGVTGPSGGPPGPTGATGPTGPAGGPPGPTGPTGPAGGPTGLTGPTGPTGPTGIQGIQGVQGTQGIPGPTGPQGIQGVQGLQGIPGIPGSMGPTGLTGPTGLQGIQGIQGNPGPTGPFGPTGPTGLQGIQGLQGIQGIPGPTGPQGIQGPTGPASTLSTKAILFGGTNSGFQRIAGSPGADSQDIPYVLGGAGSVVGLSASISINNLPIGVYTIRVCKNVPINLAAPGPGQVISTIILTTTAVISGTIILTINPSDIGAQPVRVFNPNLVIAPATVAWSSTIPGDIVARGDAMSLFITPGITQNAVYTVFLHTGN

SEQ ID NO: 28484 - protein, 503 aa, Bacillus cereus W
MFNKKMVAMAMTVPLVMGTLSTVSAVETKKQVKVEAYSPQKKAIEYLKGNANQYGLKPDLSDLQYISTTETPVASYVRFQQVVNGAPVFSNQITVTLNGEGKGVLAVSDYQPIKAVKQVTEKISEKDAIQKSMAYVGEASEQNLWAPTDKEFGYIIEEGIARPVYKVVVHSNNPFGAWETFIDAENGKLIKKVDINRKVEGTGKVFLPNPVVSSGSLAGLKDNNDADSTALTNQLKTVTLKGLDGTGFLIGEYVTISSKARTKSTNLQFNYTRANDSFEDVMSYYHIDTLQRYIQSLGFQNINNRSIKVNVNGTTADNSFYSPTTKALTFGTGGVDDAEDAGIIAHEYGHSIQDNQVPGFGSSAEGGAMGEGFGDFLGATYEDAVSTTGYGKACVGEWDAAAYSSSDPTCLRRLDTNKVYPKDIKNQVHADGEIWSQGQYEMAQAFGRDVATKIILQSHWSLTPNSKFSDGAKAIKQADALLYGGQHAADIDRIWAARGISTN

SEQ ID NO: 28485 - protein, 910 aa, Bacillus cereus W
MSRYDDSQNKFSKPCFPSSAGRIPNTPSIPVTKAQLRTFRAIIIDLTKIIPKLFANPSPQNIEDLIDTLNLLSKFICSLDAASSLKAQGLAIIKNLITILKNPTFVASAVFIELQNLINYLLSITKLFRIDPCTLQELLKLIAALQTALVNSASFIQGPTGPTGPAGATGATGPQGAQGNTGATGATGPQGVQGNTGATGATGPQGAQGNTGATGATGPQGVQGPAGATGATGPQGVQGNTGATGATGPQGVQGNTGATGPQGVQGNTGATGPQGAQGPAGATGATGPQGVQGNTGATGPQGAQGPAGATGATGPQGAQGPAGATGATGPQGVQGNTGATGPQGVQGNTGATGPQGVQGNTGATGPQGVQGNTGATGPQGVQGNTGATGPQGVQGPAGATGATGPQGVQGNTGATGPQGVQGNTGATGATGPQGAQGPAGATGATGPQGVQGPAGATGATGPQGVQGPAGATGATGPQGVQGNTGATGATGPQGAQGNTGATGPQGVQGNTGATGATGPQGVQGPAGATGATGPQGVQGPAGATGATGPQGVQGPAGATGATGPQGVQGPAGATGATGPQGAQGPAGATGATGPQGVQGPAGATGATGPQGVQGPAGATGATGPQGVQGPAGATGATGPQGAQGPAGATGATGPQGAQGPAGATGATGPQGIQGPAGATGATGPQGVQGPTGATGIGVTGPTGPSGGPPGPTGPQGPQGNTGATGPQGIQGPAGATGATGPQGAQGPAGATGATGPQGVQGPTGATGIGVTGPTGPSGPSFPVATIVVTNNIQQTVLQFNNFIFNTAINVNNIIFNGTDTVTVINAGIYVISVSISTTAPGCAPLGVGISINGAVATDNFSSNLIGDSLSFTTIETLTAGANISVQSTLNEITIPATGNTNIRLTVFRIA

SEQ ID NO: 28486 - protein, 315 aa, Bacillus cereus W
MSSWRNNINGYCSCNNQNGVHVDSCCFSCDGTVPKLGPTGPTGATGITGATGITGATGATGATGATGVTGPTGATGITGVTGVTGATGITGATGITGATGVTGPTGATGVTGSTGPTGATGITGVTGVTGATGITGATGITGATGVTGPTGATGITGSTGPTGATGITGSTGPTGVTGTSITATYAFANNTSGTAISVLLGGTNVPLPNNQNIGPGITVSGGNTVFTVANAGNYYIAYTINITASLLVSSRITINGAQLAGTVNAPALATTSFSATIITTLAAGDAISLQLFGLLAVATLSTTTPGAVLTIIRLS

SEQ ID NO: 28487 - protein, 984 aa, Bacillus cereus W
MKQNKRKRINAMVIAAALSLPFAVYSTPALAAVAIEANKTGHVLEDGTYDAVIKAYKDKTNEESMAAVYIKNPKLTIENGKKIVTATLSDSDFFQYLKTEDIHTPGVFHDVKVISEDKKKNGTKVIQFEVGELGKRYNMRMHIYIPTMAYDNKYQVQFEVNTLNLDKDVPEEQKENKEDKLDQQDANVIIDKQLQRHINKYNLNRENLNAPITKEDLLKVKSLIVVEAKSKGIKDVSGLEYMTNLENLTLEEVKLENIKFISNLRQLKSVSITYAELEDIGPLAELEHIESLSLRNNKISDLSPLSQMKKIKLLDLNSNYIKDIKPLFTVKSLRTLTVANNQISNAGLEGVHQLKNLKTFEISNNGLSNVEHINGMNKLIELGLSKNELVDLTPLSKLSGLQKLNLEENFISDITPLSQLTSLYDLKLGSNEIRDVRPVQELGKRMYIDIQRQKIFLDDVEKDKEVKIPIYNLQGEPIDTIQLNSEDGIVNNGSVKWGTTGEKTYEFMLDIKPEENRIKFNGTVIQNVVERLDEIKEDNEQKESVILDKTLQQHINKENLGRENLNAPITKEDLLQIKKLEILKEKGKEIKDITGLEYMTNLEKLTLEGVGLKNLEFISNLEKLNDVNVSHNQIEDITPLSALKNLQWLNLADNHIKDVSVLGSMLDLLSLKLSGNEIRDVRPLIQLGQWFSIDVGRQKIVLSEAKVNEEIQVPVYDLEGESIENIKLISEGGTFNNGVIKWNTSGEKVYKFDLDSDGISIRFNGTVIQSIVEKEEVKEPVKEVEEAKEEVKEPVKEVEEAKEEVKEPIKEVEETKEEVKEPVKEVEETKEEVKEPVKEVEEAKEEVKEPVKEVEETKEEIKEPVEEVEGTKEEVKGPVKEVEGTKEEVKEPIKEVEEAKEPKKEVKESATGLDQEPKGKNQVVENEGRKADTLNKQYTNKPEEGKKSLPSTGGEASTSTLLSGITLVLSALSMFVFRKRLFKK

SEQ ID NO: 28488 - protein, 965 aa, Bacillus cereus W
MNKKSKINKVMLSISTMALSLGALQAPASAEEKVPYNVLKTKPVGIEKPVDEIGHVSKAEETLSFQERLKVGDFSQRPASITNKATVKQVKESYSMADLNKMNNQELVETLGSIKWHQITDLFQFNEDAKAFYKDKGKMQVVIDELAHRGSTFTKDDSKGIQTFTEVLRSAFYLAFYNNELSELNERSFQDKCLPALKAIAKNPNFKLGTTEQDTVVSAYGKLISNASSDVETVQYASNILKQYNDNFTTYVNDRMKGQAIYDIMQGIDYDIQSYLIEARKEANETMWYGKVDGFINEINRIALLNEVTQENKWLVNNGIYFASRLGKFHSNPNKGLEVVTQAMHMYPRLSEPYFVAVEQITTNYNGKDYSGNTVDLEKIRKEGKEQYLPKTYTFDDGSIVFKTGDKVSEEKIKRLYWAAKEVKAQYHRVIGNDKALEPGNADDILTIVIYNSPEEYQLNRQLYGYETNNGGIYIEETGTFFTYERTPEQSIYSLEELFRHEFTHYLQGRYEVPGLFGRGDMYQNERLTWFQEGNAEFFAGSTRTNNVVPRKSIISGLSSDPASRYTAERTLFAKYGSWDFYNYSFALQSYLYTHQFETFDKIQDLIRANDVKNYDAYRENLSKDLKLNEEYQEYMQQLIDNQDKYNVPEVADDYLAEHAPKSLTAVEKEITETLPMKDAKMTKHSSQFFNTFTLEGTYTGSVTKGDSEDWNAMSKKVNEALEQLAQKEWSGYKTVTAYFVNYRVNSSNQFEYDVVFHGIAKDDEENKAPTVNINGPYNGLVKEGIQFKSDGSKDEDGKIVSYLWDFGDGSTSAEVNPVHVYESEGSYKVALIVKDDKGKESKSEITVTVKGGSLTESEPNNRPEEANRIGLNTTIKGSLIGGDHTDVYTFNVASAKNIDISVLNEYGIGMTWVLHHESDMQNYAAYGQANGNHIEANFNAKPGKYYLYVYKYDNGDGTYELSVK

SEQ ID NO: 28489 - protein, 780 aa, Bacillus cereus W; identical to SEQ ID NO: 26446

SEQ ID NO: 28490 - protein, 971 aa, Bacillus cereus W
MKGYSKKVLVGVSFASLMLGSFQGGALAEGTKGEQASYRNVLKMEPVGVQLPVQELAHSSKVLENKSFEKRLQFADLSQRPPELKKESKQLATAKTYTIAELNQLSNQQLVDLLVTIDWEQITGLFQFNKDSLAFYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSVKEWTGYKTVTAYFVNYRVNASGQFEYDVVFHGINTEEGAVNKAPVAVINGPYSGNVNEAISFKSDGSKDEDGKIVAYKWEFGDGTVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWVLYSEADLNNYITYAQQEGNKLVGSYYTYPGKYYLHVYQYGGGFGNYTVEVK

SEQ ID NO: 28491 - protein, 74 aa, Bacillus cereus W; identical to SEQ ID NO: 27864

SEQ ID NO: 28492 - protein, 333 aa, Bacillus cereus W; identical to SEQ ID NO: 26112

SEQ ID NO: 28493 - protein, 336 aa, Bacillus cereus W; identical to SEQ ID NO: 26393

SEQ ID NO: 28494 - protein, 3497 aa, Bacillus cereus W
MKKLFNICLIVFVLFSQFISFPYNQAKAETLQETSLFDTVEMKDATDHIIDEAKNPKNLIKIGSTIQVEYAWSIKDQQVVHANDTAVIQIPLALKVSKDLQGDLVTDQKNIGQYFITAKDNKLKLIFNDQVENSKDAKGKIKIDTVFNPTLKTEEKSVQIAFPLGTLVQPITVPIQVEDSKEDGTKQDTNKQVPDQVAKPATDNPEQNPATKPATDNPEQNPATKPATDNPEQNPATKPATDNPEQNPATKPATDNPEQNPATKPATDNPEQNPATKPAADNPEQNLASDPAEITNSGPKQITTNILTGVKLTDKDGKPFTEDNRPSTDSPANIEFTWELLKSMNVKSGDYYIFDLPKHFKIYNTINSPLYDSENNPIGNFTVTKDGKVTMTFNDYVEEHPDVVGNLQLKTEFNKAEIKGTTTQEIPFPIKDKDVSITVDFKPNVQTATNKKGLPDRPINTNEINWTVEMNKTKDTLKNAVFKDNIPQGTSLNKDSIKVYYLEVDVNGNATRGQEADPADYKIISSDGSKLEIAFKDSIKKAYQIEYVTKITDENVKSFQNNVTITSDNQGQQKASSTVTVSRGTHLNKTSKYDPKTQTIEWTITYNGDQRNIKKTDALLKDIFDDTHELDVNSIVVKNASYDDNGRLITGDTVNNYTVTNKKNGFDLQFNEDINSAYVITYKTKPTDNVIKDGKIKNTVTADNGSSKENEAGFQQQNIIKSNNKAETNYKDKTTTWTITVNNNNYPLNNAIITDTFDHGGLQLKDKKLEIKDGDYTLQAETDYVLDVTDKGFKITLIGTYQSNMTKTLIVKYTTDFDYTKLESGKTSFKNTGNLSWRDAESNPQSNKVEADFDPDTFTKANGYKYGSYNAQTKEITWIIGFNYNNVEIKDPYVIDVIQDKQKLVPGSIEVRHMILNGSPNNARPGDAVPIEQYELEEPTDKNKNTLQVHFKQSINSPYYIIFKTSLDGELIQNTYKNEAELKDGSKIVNTLKGDAQVNKGGSFVTKKAVQDDNYINWSIAINESQSTIADAVVTDDPTDNQVLVEDSFHLYPTTVDYYGNVTKDTANELKQGTDYKLTITTDNNTGKQHFEIAFLKKIDRAYILEYRSLINADDKEKVSNKAKIAGNQLTVKNTETVETIEVRMSSGSGGGSATKGRGNLEIIKVDNDNKKVPLSGAEFTLYDRTGKTVIRKITTDKDGIAKFNNLKRDKYLLKETKAPEGYVISWDLKQGKIVELGSQETTTYKLANKKFVGKVVLTKSDDLNKNVTLQGAVFTLLDKDKKIISEHEKLTTNDQGQITVDNLKPGTYYLQETTAPEHYKLDSTPIQFTIKEDQTTVINRTATNSLIPGSAILTKVDKDGKTLAGAEFSVRDRHNNVIRGYEKLSTNDQGQIEAKDLRPGDYQFVEEKAPKDYDIDKTPIEFTIVKSQKKAVTVTATNHLIKGGVTLTKTDDIDGTALAGAVFKIVDANDEKKVIRKNVTTGADGKVTVKDLEPGTYKFIETEAPKDYVLNTNPIEFTIDKSQQSFATVTATNSLKTGEVELLKVDEFGDKKPLKGAVFKIVDVNNNDVRTDLTTDADGKTKADKLRPGTYKFIETAAPEHYVLRAEPIEFTIDRSQKETLLVKAENALKPGDVELTKVDDIDGTALEGALFKIVDANDEKKVIRENIKTGADGKAIATGLRPGDYKFIEVTAPKYYDKNTKPIEFTIKESQGTSPITVTAKNSLTKGGIELTKVNAADEKETLEGAVFKIVNRDTNEDARTNLVTNSEGKLVVDDLRPGNYKLIETKAPTYYDVNVEPIEFTIEKGQQTLLPLTFKNSLTKGKVKLIKEDDVESSIALAGAVFTLQDANGTEIAKDLKTDEHGVLVIPDLAPGDYQFIETAAPEHYKLDQTPIKFTIKKGSKDDLPVPVTVTNSLLTGGVTLTKVDDVDGTTLEGAEFIIVDAHDTEKVVRKGLTTDEHGKVSASDLRPGDYQFIEVKAPKDYTLGNDPIPFTIGKSQKENITVTATNSLKKGAVTLTKIDDIDRTMLKGAIFKIVDMDGNEVRTNLVTNKNGKIYVPDLRPGDYEFIETKAPEHYVLDETPIPFTIERSQTKEINVTGKNTLKKGSVELTKIDDIDTDTKLANAVFNLLDADGEIVEEGLKTNAEGKIVVENLRPGTYQFVETIAPEHYDLNKTPIEFTIKKSQTETLHVTAKNALTKGAVELSKVDDIDGTKLEGAVFNIVDMNGTVIHKNLVTNSKGKIEIDDLRPGDYQFIETKAPKHYVLDETPIDFTIEKGQKKTISLTAKNSLQQGSIELLKVDDLNDQMKLSDAVFNLLDQNGKVIKTDLKTNNEGKIVVENLRPGTYQFVETTAPKHYDLDKKPIVVTVEKSQKNIATVTMKNSLTKGGVELSKVDDVDGTTLEGAVFNIVDMNGTVIRKSLTTNSQGKISVPDLRPGDYQFIETKAPKHYDLNKEPIPFTIEKGQAEPISVTAKNSLTKGAVELSKVDDIDGTALEGAIFKIVDMNGHDVRTGITTDAKGKVSISDLHPGDYQFIETTAPKHYKLDATPIKFTIEKSQAEKLQVTAKNSLIEGAVELIKVDDITPDTKLSDAVFNIIDAKGKVVRTNLTTDKDGKISASNLRPGDYQFVEMKAPKDYDLNETPIPFTIEKSQSTHVSVTAKNGLTKGGVELTKIDSLDTKETLEGAVFKITDLNGNDIRTNLVTNKDGKIIAKDLQPGDYQFIETKAPKHYDLNETPIKFTIERSQTKHVFVTAINSLTKGSVELIKVDDVEENTTLEGAVFKIVNKDGHDIRTDLTTDKNGRLVVDELPPGDYEFIETKAPTHYKLNETPIKFTVKKGQEKIASVTATNSLTKGAVELSKVDDIDGSALKGAVFKIVDMNGNDVRTDLTTNKDGKISVSDLRPGDYQFIETKAPKHYDLNQTPINFTVEKSQTATASVTAKNSLTKGAVELTKVDDIDGTTLEGAIFKIVDSNGHDVRTDLTTNKDGKISVSDLRPGDYQFIETKAPTHYDLNQNPINFTVEKSQTATASVTATNSLTKGAVELSKVDDIDGSTLKDAVFKIVDMNGNDVRTDLTTNKDGKISVSDLRPGDYQFIETKAPKHYDLNQTPINFTVEKSQTATASVTAKNSLTKGAVELTKVDDIDGTTLEGAIFKIVDSNGHDVRTDLTTNKDGKISVSDLRPGDYQFIETKAPTHYDLNQTPINFTVEKSQTATASVTAKNSLTKGAVELTKVDDIDGTTLEGAIFKIVDSNGHDVRTDLTTDKDGKISVSDLRPEDYQFIETKAPTGYDLNAKPIPFTITKGQSQVTSVTALNSLTTGSMELTKVDIDHNGTLEGAIFNILDQDGKVVREGLKTDGHGKLIVNDLKPGNYQLVETKAPEGYQLDASPISFTIEKAQASPLQITVSNKKIESSSGGDNKPITPPNKEEKPGKETSEELENGNPKTQTNKQQDDRNTGKELPNTGHKNDSTQTVGIILLLAGLLSVLATKRKKYY

SEQ ID NO: 28495 - protein, 412 aa, Bacillus cereus W; identical to SEQ ID NO: 26362

SEQ ID NO: 28496 - protein, 173 aa, Bacillus cereus W
MKKLLASATAVTLFTVGYSSAAFAAKSPNDTKNCGHFKNQQEAQAFWDQNGYGVGNDPNRLDNDKDGIPCEDYKYSTNTNTTTDNKETTKPQEQTKQENTKQEPVKQENTQQNNQTTNNKQEQTKQTAVKTETKKQGEKLPNTASNGVTMMLASVALVLAGSILVFRRKKTNA

SEQ ID NO: 28497 - protein, 596 aa, Bacillus cf. pumilus SG2
MKKLFLNKKFLVFSFIFVMLLSLSFFNGESAKASSDKSSKMIGYYPSWGAYGRDFQVWDMDASKVSHINYAFADICWEGRHGNPDPTGPNSQTWSCQDENGVIDVPNGSIVMGDPWIDVQKSNPGDTWDEPIRGNFKQLLKLKKNHPHLKTFISVGGWTWSNRFSDVAADPAARENFAASAVDFLRKYGFDGVDLDWEYPVSGGLPGNSTRPEDQRNYTLLLQDVREKLDAAEAKDGKKYLLTIASGASPEYVSNTELDKIAETVDWINIMTYDFNGGWQSISAHNAPLFYDPKAKEAGVPNAETFNIESTVKRYKEAGVKADKLVLGTPFYGRGWSDCESADNGEYQKCGPAKEGTWVKGVFDFSDLEKNYINKNGYKRYWNDRAKVPFLYNAENGNFITYDDEESYGYKTDLIQSNGLSGAMFWDFSGDSNQTLLNKLAADLGFAPGGSNPEPPSSAPDNLRVTEKTATSISLAWDVPSDGANISEYVLSYEGGSVSVKETSATIGKLKPNTTYSFTVSAKDADGKLHTGPTIEAATNSDQTCGYNEWKDTVIYTGGDRVVFNGKVYEAKWWTKGEQPDQAGESGVWKLIGDCK

SEQ ID NO: 28498 - protein, 699 aa, Bacillus circulans
MINLNKHTAFKKTAKFFLGLSLLLSVIVPSFALQPATAEAADSYKIVGYYPSWAAYGRNYNVADIDPTKVTHINYAFADICWNGIHGNPDPSGPNPVTWTCQNEKSQTINVPNGTIVLGDPWIDTGKTFAGDTWDQPIAGNINQLNKLKQTNPNLKTIISVGGWTWSNRFSDVAATAATREVFANSAVDFLRKYNFDGVDLDWEYPVSGGLDGNSKRPEDKQNYTLLLSKIREKLDAAGAVDGKKYLLTIASGASATYAANTELAKIAAIVDWINIMTYDFNGAWQKISAHNAPLNYDPAASAAGVPDANTFNVAAGAQGHLDAGVPAAKLVLGVPFYGRGWDGCAQAGNGQYQTCTGGSSVGTWEAGSFDFYDLEANYINKNGYTRYWNDTAKVPYLYNASNKRFISYDDAESVGYKTAYIKSKGLGGAMFWELSGDRNKTLQNKLKADLPTGGTVPPVDTTAPSVPGNARSTGVTANSVTLAWNASTDNVGVTGYNVYNGANLATSVTGTTATISGLTAGTSYTFTIKAKDAAGNLSAASNAVTVSTTAQPGGDTQAPTAPTNLASTAQTTSSITLSWTASTDNVGVTGYDVYNGTALATTVTGTTATISGLAADTSYTFTVKAKDAAGNVSAASNAVSVKTAAETTNPGVSAWQVNTAYTAGQLVTYNGKTYKCLQPHTSLAGWEPSNVPALWQLQ

SEQ ID NO: 28499 - protein, 682 aa, Bacillus circulans
MKPSHFTEKRFMKKVLGLFLVVVMLASVGVLPTSKVQAAGTTVTSMEYFSPADGPVISKSGVGKASYGFVMPKFNGGSATWNDVYSDVGVNVKVGNNWVDIDQAGGYIYNQNWGHWSDGGFNGYWFTLSATTEIQLYSKANGVKLEYQLVFQNINKTTITAMNPTQGPQITASFTGGAGFTYPTFNNDSAVTYEAVADDLKVYVKPVNSSSWIDIDNNAASGWIYDHNFGQFTDGGGGYWFNVTESINVKLESKTSSANLVYTITFNEPTRNSYVITPYEGTTFTADANGSIGIPLPKIDGGAPIAKELGNFVYQININGQWVDLSNSSQSKFAYSANGYNNMSDANQWGYWADYIYGLWFQPIQENMQIRIGYPLNGQAGGNIGNNFVNYTFIGNPNAPRPDVSDQEDISIGTPTDPAIAGMNLIWQDEFNGTTLDTSKWNYETGYYLNNDPATWGWGNAELQHYTNSTQNVYVQDGKLNIKAMNDSKSFPQDPNRYAQYSSGKINTKDKLSLKYGRVDFRAKLPTGDGVWPALWMLPKDSVYGTWAASGEIDVMEARGRLPGSVSGTIHFGGQWPVNQSSGGDYHFPEGQTFANDYHVYSVVWEEDNIKWYVDGKFFYKVTNQQWYSTAAPNNPNAPFDEPFYLIMNLAVGGNFDGGRTPNASDIPATMQVDYVRVYKEQ

SEQ ID NO: 28500 - protein, 524 aa, Bacillus circulans
MNQAVRFRPVITFALAFILIITWFAPRADAAAQWQAGTAYKQGDLVTYLNKDYECIQPHTALTGWEPSNVPALWKYVGEGTGGGTPTPDTTPPTVPAGLTSSLVTDTSVNLTWNASTDNVGVTGYEVYRNGTLVANTSTTTAVVTGLTAGTTYVFTVKAKDAAGNLSAASTSLSVTTSTGSSNPGPSGSKWLIGYWHNFDNGSTNIKLRNVSTAYDVINVSFAEPISPGSGTLAFTPYNATVEEFKSDIAYLQSQGKKVLISMGGANGRIELTDATKKRQQFEDSLKSIISTYGFNGLDIDLEGSSLSLNAGDTDFRSPTTPKIVNLINGVKALKSHFGANFVLTAAPETAYVQGGYLNYGGPWGAYLPVIHALRNDLTLLHVQHYNTGSMVGLDGRSYAQGTADFHVAMAQMLLQGFNVGGSSGPFFSPLRPDQIAIGVPASQQAAGGGYTAPAELQKALNYLIKGVSYGGSYTLRQPAGYVGLKGIMTWSINWDAYTNNQFSNAHRPFLNGLSTQKTEEVVY

SEQ ID NO: 28501 - protein, 718 aa, Bacillus circulans
MFQMAKRAFLSTTLTLGLLAGSALPFLPASAVYADPDTAVTNKQSFSTDVIYQVFTDRFLDGNPSNNPTGAAYDATCSNLKLYCGGDWQGLINKINDNYFSDLGVTALWISQPVENIFATINYSGVTNTAYHGYWARDFKKTNPYFGTMADFQNLITTAHAKGIKIVIDFAPNHTSPAMETDTSFAENGRLYDNGTLVGGYTNDTNGYFHHNGGSDFSSLENGIYKNLYDLADFNHNNATIDKYFKDAIKLWLDMGVDGIRVDAVKHMPLGWQKSWMSSIYAHKPVFTFGEWFLGSAASDADNTDFANKSGMSLLDFRFNSAVRNVFRDNTSNMYALDSMINSTATDYNQVNDQVTFIDNHDMDRFKTSAVNNRRLEQALAFTLTSRGVPAIYYGTEQYLTGNGDPDNRAKMPSFSKSTTAFNVISKLAPLRKSNPAIAYGSTQQRWINNDVYVYERKFGKSVAVVAVNRNLSTSASITGLSTSLPTGSYTDVLGGVLNGNNITSTNGSINNFTLAAGATAVWQYTTAETTPTIGHVGPVMGKPGNVVTIDGRGFGSTKGTVYFGTTAVTGAAITSWEDTQIKVTIPSVAAGNYAVKVAASGVNSNAYNNFTILTGDQVTVRFVVNNASTTLGQNLYLTGNVAELGNWSTGSTAIGPAFNQVIHQYPTWYYDVSVPAGKQLEFKFFKKNGSTITWESGSNHTFTTPASGTATVTVNWQ

SEQ ID NO: 28502 - protein, 110 aa, Bacillus circulans
AQVINTFDGVADYLLTYHKLPDNYITKSEAQALGWVASKGNLADVAPGKSIGGDIFSNREGKLPAKSGRTWREADINYTSGFRNSDRILYSSDWLIYKTTDHYKTFTKIR

SEQ ID NO: 28503 - protein, 1616 aa, Bacillus circulans
MKSLLRKWNGMMIIALVISLLTPAWGKASAQSLGQESGGVQPQSAGVTDDVYVLSRDGTFRLPVGHINVNVDAPPQKTNYVALFTSGAQVTNSQETDKVFVKKTNTAIAVDKHDQVIRVIGPTAVPPTGSTWEENQNLPIPEGGYVLLANDSSWGTSVTRKPLFEHYKTGDTVSLHKGGQVVHAGDFLNPDPGLNLVTASGTTVTSPDFTVSGQVVRYGSGQGISLTVNGTEAALKADGAFQSAVRLTAGTNAISVKLLKDGREIVSSTVTVTYNDAQQPADLIEVEAAPIDITISIEGPAHAIGYVDQDIAGIDDTVALFTNDWGPQITVPQFNVAVQVDAGSKVTKVVNPSIDGKTPAWTGPTDLEIPSGGYVLVAQDTSYAGKNIKKYLATYFKVGDAIKLRKNGFAVPVKDLMGTGGPIARVTLDNYAMYTETKPSTELSGTITNMDDPSKIALTVNGTPLPFGPDGKFKTSYTLAEGINYLDLVVTKEGKEQDSKDLVVYSRPGFSTGKKVILWVDQAANARKFQTGDNVANFLRTAKENGVTSVVFDVKGVEGYVSYKKSTLTGRPYVSAIKAPEKAGSNPDLDLLQEFIRYSRELGLDIHVSFNIFAEGSIASNEFALLDSHLDWEERVYNAADNGQIKRLRESAKQGAVAFVNPSNDEVRDFQLKTIEEVLQNYDVDGVVLDRARYDNESADFSDLTKAKFESFLGARGKQLQNWPDDVFTYAGNVRKDGPLIRDWWEFRSKTIKSFTSEVRQLTDRVKAEKGKKIEVSAYVGSWFESYYLNGVHWGSTEFRYDERLRMKDKSVYTPGYYESGYVKNLDFIMIGAYQTTAPEIEHYITLGNIVTNGEVPLYAGIALTNVQEPALQRDVFQAGLVNTHGLMLFDASQVNWPVAGAALRNLVYVRDYQLGISLPDSPDSFLEGSYYNTNLIENNIGVLTDTFGYSTGNSRFGVEAVVDSSGKVTSVPNKTQAMTWNWGKPDETNSVIPKGGFVVSTLDASGIRTKRQLVANAYETGDSVRAAALSGFLAYEGLRTSADSVTFRGKVDVLGPGKASVTVNGQEAALREDGTFQADTVIRPGANPVVIIVRVDGFKTNEKTVTIIGDEAAVKALKLDRGTYSMNKGESLRLAVTAEYSSSSTDVTGQAAYASLDPAVVSVDATGRITALREGSGTVQATYEGHTATARVSVTSGSTGGGSDTGSGTGSGSGGGSAGGGGTAPSGPERTSVTETKDSDGRNLTLVSADAGVMEAEIAALQGKAAPVLSYEIPGEEPAGIVSLPGTALAKRFAGSPGAILSVSSHLGAIELPAGLLEADLPAVGSFDLLVQIGRTAADETADLRPGGERRHAGTRHAGCFPCFAENRRRNKRNRRLRKLRPKNRKLAGSGRPLTAPRRWSWTRPPECSASCPPASNRPGARRRPLSATEAGGPTRWSPPRSASPTLHPTGRARMSSCWPRSIVDGMGAGGFSPDEALTRAQFAALLTRALALDPAPAAADFTDIPGDAWYAGAVARRSGPARGRFRNRGVPTRRGADTRTDERDAHARREAGRYPDGGELRCRCAGALRGPGRNLRLGGRCRFAGGGSRPAGRTRGRTLRARPARLPVRKARPC

SEQ ID NO: 28504 - protein, 713 aa, Bacillus circulans
MKKFLKSTAALALGLSLTFGLFSPAQAAPDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSTTENGIYKNLYDLADLNHNNSTVDVYLKDAIKMWLDLGIDGIRMDAVKHMPFGWQKSFMAAVNNYKPVFTFGEWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKCNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTVTWEGGSNHTFTAPSSGTATINVNWQP

SEQ ID NO: 28505 - protein, 35 aa, Bacillus circulans
VNYGNGVSCSKTKCSVNWGIITHQAFRVTSGVASG

SEQ ID NO: 28506 - protein, 1050 aa, Bacillus circulans
MRKTTIVRWTAAVLFVAVPAVAGVSVQLAKRTQPAATHATAAAEKLPGPPVAATQAVAIRDDGSFKKSESEEGGQIPAAWQTDGGGQLSLSAAHYKHGRQSLQWNWAQGSRLLVIKPPNLEQAGASKRGGIKLWLYNEKAVDGKATFRLGSEQEINSNNPRYVFEIGINFTGWRGMWIQFREDGAYDGYKGDGKAPLEVMEIIPPAAAPQGSLFFDVVEFEGTIPATRSTDYQVPYDRKRSNDGMGGTWDRSYYWSQMKPDLPLADRITPEQSRAFETIAKRYEGWIYGEHPDLTREPLRIRNSALQSFIAKGLQKYAQLGLNRDGNGYITGPPLFSSRSTHGPEFGEDVAKTIFLPLVFDYKINGRQESKNKVLDLFDYFHDQGWADGSGLETLDHETNRTNGYFHAVYLMRKELQESGRLDRELATVRWFTNFGKTYIADPGETTADEIRTKFMYELLYVLALDDGPAKVREMQSLLRWMNHALAVATGFAGTIKDDFMGFHHRGVYMSAYARQAFHMAALIAYLLHDTPFALSKQSTDNMPKRAADFSDGGEQIRRAGGLSGRFPAKDGVANEIVPAYAYMALASEPVDREMAGAFMRLWDPSSPYLKQGLFPKADSGDVSYLDTIGGLQLALKLADQGFAPEKSPQFWMKPSAAFAVMRRDDWAVSVKGWSQYVFDFESQAPKAADSAQKALAGQNVFGRYASYGAMQVMAAGDPINKANNGYGLDNGWDWNRWPGATTIRLPWERLGVSKDRPQTRSFTDQTFVGGVESEGKDGIFAMKLHDTVYDKSFRAEKSVFFLDNEVIALGSGIHNDDGAHSTETTLFQSYMKDTGMPIRTGSAGSAETIAEFPYRRDFKPKENVWLMDPYGNDISYRCGGCALNEASSRRPIRAVKKRRPAATAPPGSITARSRRVRATNMRCSCRLLPSRCGNTRSRRAMRCFEKTARLISSDMRRSARSDTSFSMRRRKCRAASSGKQAGRRSLWKNKRRTESFSASPIRICACPSFPTKEWTTASADAWNGGDGAGRAERKLAAGTAASGRHPSDG

SEQ ID NO: 28507 - protein, 1050 aa, Bacillus circulans
MRKTTIVRWTAAVLFVAVPAVAGVSVQLAKRTQPAATHATAAAEKLPGPPVAATQAVAIRDDGSFKKSESFEGGQIPAAWQTDGGGQLSLSAAHYKHGRQSLQWNWAQGSRLLVIKPPNLEQAGASKRGGIKLWLYNEKAVDGKATFRLGSEQEINSNNPRYVFEIGINFTGWRGMWIQFREDGAYDGYKGDGKAPLEVMEIIPPAAAPQGSLFFDVVEFEGTIPATRSTDYQVPYDRKRSNDGMGGTWDRSYYWSQMKPDLPLADRITPEQSRAFETIAKRYEGWIYGEHPDLTREPLRIRNSALQSFIAKGLQKYAQLGLNRDGNGYITGPPLFSSRSTHGPEFGEDVAKTIFLPLVFDYKINGRQESKNKVLDLFDYFHDQGWADGSGLETLDHETNRTNGYFHAVYLMRKELQESGRLDRELATVRWFTNFGKTYIADPGETTADEIRTKFMYELLYVLALDDGPAKVREMQSLLRWMNHALAVATGFAGTIKDDFMGFHHRGVYMSAYARQAFHMAALIAYLLHDTPFALSKQSTDNMPKRAADFSDGGEQIRRAGGLSGRFPAKDGVANEIVPAYAYMALASEPVDREMAGAFMRLWDPSSPYLKQGLFPKADSGDVSYLDTIGGLQLALKLADQGFAPEKSPQFWMKPSAAFAVMRRDDWAVSVKGWSQYVFDFESQAPKAADSAQKALAGQNVFGRYASYGAMQVMAAGDPINKANNGYGLDNGWDWNRWPGATTIRLPWERLGVSKDRPQTRSFTDQTFVGGVESEGKDGIFAMKLHDTVYDKSFRAEKSVFFLDNEVIALGSGIHNDDGAHSTETTLFQSYMKDTGMPIRTGSAGSAETIAEFPYRRDFKPKENVWLMDPYGNDISYRCGGCALNEASSRRPIRAVKKRRPAATAPPGSITARSRRVRATNMRCSCRLLPSRCGNTRSRRAMRCFEKTARLISSDMRRSARSDTSFSMRRRKCRAASSGKQAGRRSLWKNKRRTESFSASPIRICACPSFPTKEWTTASADAWNGGDGAGRAERKLAAGTAASGRHPSDG

SEQ ID NO: 28508 - protein, 717 aa, Bacillus circulans
MLYKAKHMDFKKAGKVLLGLVLLLSVIIPSFTIQSRTAEAADAYKIVGYYPAWAAYGRNYNVTDIDPTKVTHINYAFADICWNGIHGNPDPSGPNPVTWSCQNEKSQTINVPNGTIVLGDPWIDTGKQFAGDTWDQPYAGNINQLNKLKQVNPNLKTIISIGGWTWSNRFSDVAATSATREVFANSAVDFLRKYNFDGVDLNWEYPVSGGLDGNSKRPEDKQNYTLLLSKIREKLDAAEAVDGKEYLLTIASGASPTYAANTELANIASIVDWINIMTYDFNGAWQKISAHNAPLNADPAAASAGVPDSNTFNVAAGAQGHLNAGVPAAKLVLGVPFYGRGWDGCAQANNGQYQTCSGGSSIGTWEAGSFDFYDLEANYINKNGYTRYWNDTAKVPFLYNASNKRFISYDDAESIGHKTAYIKSKGLGGAMFWELSGDRNKTLQNKLKSDLSTGGTVPPTDTTAPSVPGNARSTGVTASSVTLAWNASTDNVGVTGYTVYNGTSLVTSVTGTTATISGLAPGTSYTFTVKAKDAAGNLSAASNSLTVSTTVQPGGDTQAPTVPTNLTSTAKTSSTITLSWAASTDNVGVIGYEVYNGTALVTTVSGTSATVTGLTADTSYTFTVKAKDAAGNLSAASSALTVKTEVGTTNPGVSAWQANTAYVVGQLVTYNGKTYKCLQSHTFLTGWEPSNVAALWELQPYIPVKDDTSDKLGSVFM

SEQ ID NO: 28509 - protein, 380 aa, Bacillus clausii
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 28510 - protein, 475 aa, Bacillus clausii
  strain KSM-K16
MEKVDAADQQLLLAGAVFSLLDEAGNVLEENLMTDQHGRLEINNLPPGDYQLVETKAPEHYQLDATPIVFTIEKGQTVTPVITVENTLIPGAAALIKVDQDNGDIRLAGAEFMLTDADGNVVAEQLVTDENGLVAVSDLVPGTYYFVETKAPLHYERDAEPVAVTVEKGQTEAAVVKKSNTLIPGAVVLEKVDSSDHSTLLAGAEFRLEDEQGTVIQEKLVTDETGRIIVTDLKPGNYQFVETKAPNGYDLNEEGLAFTIERSQEAAVVVKAENTLTPGSVEIVKVDSSDGARLEGAVFTVLTEDGDMVAEGLTTDESGSVQLDGLAPGTYQLVETKAPAHYQLNETPIAFEISKGQTERLVLTVENTLIPPGEEPKEPQPPSEPKQPPTEPGDGQTPTGPQNNNGGTGTGKTGTPKAGGGDPSPLLSKGAQPASGGQLPQTGETEMFMFMVAGLLLMAIGALTLVNGRLARKRG

SEQ ID NO: 28511 - protein, 284 aa, Bacillus clausii
  strain KSM-K16
MKCNQMTLCLFFFIVFALSSVVISEDVHAIAAKTGEVDTQTSLNVRSGPSTSHEVVGSLTPGEQVAYTDNGDGWGELVDGSGYISLHYITNHDGEPVDRSSAKHDSVPLNNERIVLDPGHGGKDSGAVANGLMEKEIVLDIGKRTRDILENAGFAVLMTRDEDVFVSLEERTAMANAWGADQFISIHANGFSNPAANGVETYYFPGSAAGKHMAANVQNQLVEHTDRTDRGIFEESFYVISHTTMPAILVETGFVSNADDASQLADANYRQTVAEAIANSVIDD

SEQ ID NO: 28512 - protein, 429 aa, Bacillus clausii
  strain KSM-K16
MTIISDVYAREVLDSRGNPTVEVEVHLESGVMGRALVPSGASTGEYEAVELRDGGDRYMGKGVQKAVDNVNEKIAPELIGENALDQIGIDRLMIELDGTENKGNFGANAILGVSMAVAHAAANALDIPLYVYLGGFNAKQLPVPMMNIINGGEHADNNVDIQEFMVMPVGAESFKEALRMGAEIFHNLKSVLKAKGYNTAVGDEGGFAPNLSSNEEALATIIEAIEKAGYKPGEQVKLAMDVASSELYSKEDGKYHLAGEGKVLSSEEMVSFYEELVSKYPIISIEDGLDENDWEGHKLLTERLGDKVQLVGDDLFVTNTKKLAEGIEKGIGNSILIKVNQIGTLTETFDAIEMAKRAGYTAVISHRSGETEDATIADIAVATNAGQIKTGAPSRTDRVAKYNQLLRIEDELADLAQYNGLKSFYNLSK

SEQ ID NO: 28513 - protein, 159 aa, Bacillus clausii
  strain KSM-K16
MKEKVLVLLGLIVCLLLIVGFATNGLSKPETVQGNASDQEESKHESQEISDIEITLNGYSVKDENEEELLVKVDLTIENKRESTVNFSLMNLTLMDSEHYAYSHESNVETKGILGGQISPGRSVSGEVAFIVPRDTSYELVYTDHFRTGQLFFPIEVTD

SEQ ID NO: 28514 - protein, 93 aa, Bacillus clausii
  strain KSM-K16
MDLFFAYMFVASATPLFLWLEHRKIALASIPFIIVMWVLALAHIFDGFLFDLHHSAFVTAFLINVFIAHFAALVLYVYPHLRSKSRRFTQSTE

SEQ ID NO: 28515 - protein, 923 aa, Bacillus clausii
  strain KSM-K16
MPVRKSMRHMILLVFTLFVCLTVPQSASGETGEKTLHIIHTNDIHASFDEYGKVAAYIQNKRQSSDHFLYVDAGDFASGNPVVDLNNGKPMIDVFNLAGLDAFTIGNHEFDYGQDHLKTNMEQADFPWLAANLDTGATGVENTKPYVLIDADGISVALFSLTQAPPATAPANVIGMEFDNDYIGTALAYKDELESQADVIIALTHIGYDQDRRLANEVEYFDAIIGGHSHTTLNAPAVVNGTPIVQTGSNLQHIGELDFTYNETTDEVTEVSGQLTAVSSLTETDEDVQAVIDKYNEEMDELLGKVIGYSNTGLSRDGRYDRDAPLGNFWTDAMRAFADADIALTNNGGIRDSIAPGEVTLNDIYKIEPFANEIMVIEMTGEAIENVIAYSYARDDRNQIDLQTSGLHYEIITGMTGNFIDVNLSIDGQPLEADSTYKVAVADYIGTGGSGYHFEGEILQETVGLMTTAMEQYALERTAAGQALDYESEGRIALKVDPTAPNPGEIIGSTNTGLYSENKNKQDVGLGNLYADSIRAKTGSDFALLNSSSITGEIPPGSITDKQIEALDRYGNTIVVVETTGSRLKEVLLEQSRYHRGVDLQGSGLTYTLIPDENSVFNDVTILLENGEPLDLNGTYTVAYNDYMHASTFYNLGTAIDNSYGPVWQAVVDYVSTQTEPIDYTEGSRIAIEGKEPEDPTGTLTVAEAIANNSGTKAVKGYIVGSINNNRPIIGEGSHAPSNLLLADSPDETDRAKMLPVQLVNGTPVRNGLNLVNNPENIGKQVRITGSLETYFGTPGMRNPSTYGFIEEPVEPDPELPACDYKAWDKTAIYTAGDRVEHEGDFYEAKWWTQGENPAASGRWDVWKKATDCYEEPDGPQEWQADEIYTAGDRVYYEGQLYEAKWWTQGENPSESGQWDVWKKVSN

SEQ ID NO: 28516 - protein, 2870 aa, Bacillus clausii
  strain KSM-K16
MQSKKLLTRRRLLELRKLVIVTMVFLLSLSNFLPYSAQYAQANETPSLSDLELKQDVDGEERKEVEKGATFTFNVDALIPESGSNEGTLTILNQVNKQLAIENVEVVVNEEESDLEATVEEQDVSLELTPEQLDTVAGQHVTLKITAAFQDEVEAGTEIEHVAEAFINGELAEKAEPVTVALLADAEATSEEEEAPAEEEAQQEEENAGEDSSEEEQISEEEQTTEEEAEGEESIVSAADAETNNVVDINHVDSYGISNTSNGNYPQISQFDGNDFSADPKAIVYITGLPNGVSMSNGLAIHPTEDAFYAFGRSSGSGNQFGLYRITADGAAQFVGNLNGIASNAAISQDGERYYHTYVSNGQLFLGSYNLVTGEKEATPISGYPSNDVGGDLIFDGNGYIWFSNNTAGSIIQMDPKTGEILRRVPITSADGRSLQGGVRGLSFLPNGQILLSSGPGGEGSQRADYFTLDPETLQTTFLGSATVSGEGRFYPSYDLASRVYPVFDPLPPELEAEKSVQVLEKGEGNTDEEHAEVGDTLRYTIQARNTVSDSLVQSMVISDTIPEGLEYVPGTLKVDREAVTDEEDDDEGHYVDGGVVGNFGDVTDTEWHTLEFDVVVLPGQAGEDIENTALADGNNIDDPKEPSELVEVYPREGPVVEAEKTVSPEGEVFAGNILTYDVTIKNVGEHIAADAVFEDAIPEGTEYVPGSLKIVAGPNTGDLTDEEDDDAGHFAGDKVMIELGNLETTTELPDGVTVQFQVKTLESHVGETVVNQADIQYRNLQTDEEQSAQSNEVTNEIVETPDIDACATPVALVNGSFEEPDLLNLPDNAAMTKTPYYYYIYDDFVPGWSTTDSSGALEFASPTKLGVSPDINYKYHYVTDVPDGEQYVELNALEFGQLYQDVETTPGQTINWRLSHRAAYKNQTHGHDTMTVRIGSHTTDPSELPVIETLSTHTSDGWVEYRGTYTVPAGQTVTRLGFEAVESVLGEANNGNFLDDIFLGTEPCVVAEKTVSPEGEVFEGDELTYEVTIKNNGGDIAADTVIEDAIPEGTEFVQGSMKILNGPKEGDLTDGNDDDAGHFDGDKVIINIGDLPNTTNLEEGITVQFKVKALSSHVGETVVNKATVGYKNVLTGEDETTDSNEVETPVVYQKPVIESEKNATLLEKADGNTDADNPEVGDTLLYTIQARNTLEGSIVENFVIFDVIPEGLEYVPGTLKVNGEAVTDEEDDDEGHYSGGEAFGSFGDVTNTEWQTLEFQVIVGEGQAGKDIENVAVVDGDNLDEPDEPREEVKIYPREPKLESRKSAQNADENKERYEVGDTVVYTIESRNTVSDSLLENLTITDVLPEGLTFVEGSLEVSHGGTGSFEDGTVTADFGEVADTEWRTVTFEATIDTGYSGETIKNVAVVEVPNIDEPDEPETEIDVDPKEPVLESEKAASLIEKAEGNTDEDNPEVGDTLRYTIQTRNTIEDSLIENLTISDVIPEGLEYVPGTLKVNGEAVTDEEDDDQGHYVDGTVVGQFGNVEDTEWHTLEFDVVVLPGQAGEDIENTAVVDGDNLDEPDRPQEEVKIYPREPKLESRKSATNADESKDGYEVGDTVVYTIEARNTVSDSLFENLTITDQLPEGLTFVEGSLEVSHGGTGSFENGTVTAEFGEVTDTEWRTVTFEATIDSGYVGETIENVALVEVPNIDEPDEPGTEIDVDPKEPKLESEKSAALLEKADGNTDEDNPEVGDTLRYTIQTRNTIEDSLIENLTISDVIPEGLEYVPGTLKVNGEAVTDEEDDDQGHHVDGTVVGHFGNVEDTEWHTLVFDVVVLPGQAGKDIENTAVVDGDNIEDPDEPREDVEIYPREPKLESRKSATNADESKDGYEVGDTVVYTIEARNTVEDSLLENLTITDVLPEGLTFVEGSLEVSHSGTGSYEDGKVTAEFGEVKDTEWRTVTFEATINSGYVGETIENVALVEVPNIDEPDEPGTDIDVDPKEPKLESRKSAQNADESKERYEVGDTVVYTIEARNTVEDSLLENLTITDVLPEGLTFVEGSLEVSHSGTGSYEDGTVTAEFGEVKDTEWHTVTFEATIDSGYVGETIENVALVEVPNIDEPDEPGTDIDVDPKEPKTESRKSATNADESKDGYEVGDTVVYTIQSRNTVEDSLLENLKISDVLPEGLTFVEGSLEVSHGGTGSFENGTVTAEFGEVTDTEWRTVTFEATINSGYVGETIENVALVEVPNIDEPDEPSTDVDVDPKKPKTESEKSAALLEKAEGNTDADNPEVGDTLRYTIQTRNTIEDSLIANLTISDVLPEGLEYVPGTLKVNGEAVTDEEDDDQGHYVDGKVVGHFGDVKDTEWHRHTLVFDVVVLPGQAGKDIENTAVVDGDNIDDPDEPREDVEIYPREPKLESRKSAQNADESKDRYEVGDTVVYTIEARNAVEDSLLENLTITDVLPEGVTFVEGSLEVSHSGTGNFEDGTVTAEFGEVKDTEWRTVTFEATIDAGYVGETIKNVAVVEVPNIDEPDEPSTDVDVDPKQPKLESKKSAKNADESKDGYEVGDTVVYTIEARNTVEDSLVEDLRITDQLPEGLAFVEGSLKVSEGGEGSFEDGTVTATFGNVTDTEWRTVTFEATIEPGFANKTVKNVATVGGGNIDDPDKPEHEVDVDPKEPKLESKKSAKNADESKDGYEVGDTVVYTIEARNTVEDSAVEDLTIIDQLPEGLAFVEGSLQVSDGGTATFEDGTVTAEFGTVTDTEWRTVTFEATIESGTSIKNVATVNGGNIDDPDKPEAEIEITEPPAPPTPGDGDKEDPVDPTPGDKPEEPKPGNGGTNKPQEPTPGDKSPSDGSKLPKTATSTYNLLLIGASLLVLGAILWFLRRKKAA

SEQ ID NO: 28517 - protein, 261 aa, Bacillus clausii
  strain KSM-K16
MVKEKWMKCCRAVLLQTVVFGLLAFAGVQVASAHGYIESPSSRGLLCQQGINQDCGAIVWEPQSLEAPKGFPGQSVPDGQIASAGGLFPKLDEQSSTRWSKVPLTSGTHTFTWHLTAMHSTAKWHYYITKPDWNPNQPLTRDQFVLIPFYERHDNGARPGEKVTHEVTIPERTGYHVILGVWDVADTANAFYNVIDVHFGPNDGTSPGEPSPPDPAPAYPEWNAGTVYLGGDRVTYEGRAYEARWWTQGERPGTAEVWRPL

SEQ ID NO: 28518 - protein, 212 aa, Bacillus clausii
  strain KSM-K16
MLYFWRIVTYIYRLIGGSGMKKYMTLSALVLASTLALAACGDEADISASDSNTDAEAEETNTDKESEDNSETEAEDGAEVDEGEEVSGFQIGDEVNFNDLSITVNSVDFSEGSEWEQPSKDKYAYIDITVVNNGDEDYTLSSLMQFELVTNEGRSQDITIVSDQDGELDGTIGAGRTMAGQVVFDVSEADYYELIFEEILLSGQAIWEIPNE

SEQ ID NO: 28519 - protein, 598 aa, Bacillus clausii
  strain KSM-K16
MDWKRLRKLLTPLFVVILLLVSDGGGQVNAATKSDDDPYKIVAYYPSWGAYGRDFQVWEIDASKVSHINYAFANICWDGRHGNPDPASPNPQTWSCQDENGVIDVPNGSIVMGDPWIDAQKSNPGDTWDEPIRGNFKQLQKLKEEHPHLKTLISVGGWSWSNRFSDVAATKETRENFANSAVDFVRQYGFDGVDIDWEYPVSGGLPGNSRRPEDKENHLLLLQEVRNKLNEAGQEDGKEYLVTIASGASSEYVENNKLAEIAEVVDWINIMTYDFNGGWQNTSGHNAPLYFDPATADSELPTPEQFNVESAVEGHLQAGVPGNKLVVGMPFYGRGWMNCEEANYGEYQHCSPPQDGTWENGIFDFSDLEDNYVNKNGYQRYWNDVAKVPFLYNAANGGFITYDDVESFQHKTDFIKDNHLAGSMFWEVSGDRNGTLLTALAEQLDFKPGKGQHPEEPSLAPRDIRAVDVTSTSITLSWEPSNEAATRYIVQYGTEEQVTDETSLTITNLKPSTAYTFTVSAEYEDGSRHTGQALSVTTKAENGGEACAAPNWEQTAVYTGGDQVQHKGHLYEAKWWTTGEEPGTTGEWGVWKLLGECE

SEQ ID NO: 28520 - protein, 670 aa, Bacillus clausii
  strain KSM-K16
MPIQEKTRARDTCWLPEEGQGHRAEKVHISVVGNGFRLDTIKKVAQTYLPRIFADVDIVDAEFANVIVGTFADLGRSERVGHQEGYRIFADGSQLIIAGDTEFGVLYGFYEFLKKSQQGCPLLTMEAEDQPAMEVRMINHWDNLDGSVERGYAGKSLFFDNNAWAASDEEIVQYAEMLSSIGINALTINNVNVHAKETELITEKWLPQLAKVANLFDAYHITLFLSANFASPMTLGHLQTADPLDKRVVHWWKTQVEEIYKYIPTFGGFVIKADSEHRPGPFTYGRTHAQGANMLADALKPYGGVVFWRCFVYDCLQDWRDRSTDRAKAAYEHFAPLDGTFADNVILQIKNGPMDFQVREPVSPLFGALTQTNYVMELQITQEYTGQQIDVCYLPMQWQEIWSFDTHANGEGTKIADLLSSRQQDGKGKGVTAVSNIGNNQNWTGHPFAQANLYGYGQLAWNPEQCPRKIAEEWAKRTYAHLSAEVRQTICSILKRSWSVYEAYTAPLGVGWMVNTGHHYGPNVNGYEYSPWGTYHFSDRSGLGVDRTKTGSNYISQYKQPVAELYGNVATCPDELLLFFHHVPYTHMLKSGKTVIQHIYDAHFEGVEEVEAFLEAWEGQKEAMPDSLYMHVKERFEAQLANAREWRDQVNTYYYRMSGINDERGRTIYK

SEQ ID NO: 28521 - protein, 380 aa, Bacillus clausii
  strain KSM-K16
MKKPLGKIVASTALLISVAFSSSIASAAEEAKEKYLIGFNEQEAVSEFVEQIEANDDVAILSEEEEVEIELLHEFETIPVLSVELSPEDVDALELDPTISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGVAALVKQKNPSWSNVQIRNHLKNTATGLGNTNLYGSGLVNAEAATR

SEQ ID NO: 28522 - protein, 109 aa, Bacillus coagulans
AVINTFDGVADYLIRYKRLPDNYITKSQASALGWVASKGNLAEVAPGKSIGGDVFSNREGRLPSASGRTWREADINYVSGFRNADRLVYSSDWLIYKTTDHYATFARIR

SEQ ID NO: 28523 - protein, 280 aa, Bacillus coagulans
MRISGAAPPKGPAKKLLPLLCCWTLFPSGFGAKASLKPSEPATGSRDEDPSPGTLQFVGARTGLDAGRWHDIMTLMNRAEPDHWNCITYSGYCEDTNDQPAYPFAIGGASADGGRDTHPDGPEVFKAYDPAKAAGNASLEAALRRLGMNGKLTGSILCIKDSETVVCGKIKGLQPDRAWRPAIWPTFYKVYMGYSVGQARPRGFTSALTIGSLVDTAGNQPASGASGTLPGLLARSGSRTNEGTFLKGFHAKRTLLGMGQMNLRNVDGEIAHVAANWQMK

SEQ ID NO: 28524 - protein, 280 aa, Bacillus coagulans
MRISGAAPPKGPAKKLLPLLCCWTLFPSGFGAKASLKPSEPATGSRDEDPSPGTLQFVGARTCLDAGRWHDIMTLMNRAQPDHWNCITYSGYGDDTNGQPAYPFAIGGASADGGRDTHPDGPEVFKAYDPAKAAGNASLEAALRRLGMNGKLTGSILEITDSETVVCGKIKGLQPDRAWRPAIWPTFYKVYMGYSVGQARPRGFTSALTIGSLVDTAGNQPASGASGTLPGLLARSGSRTNEGTFLKGFHAKRTLLGMGQMNLRNVDGEIAHVAANWQMK

SEQ ID NO: 28525 - protein, 62 aa, Bacillus coagulans
MKKIEKLTEKEMANIIGGKYYGNGVTCGKHSCSVDWGKATTCIINNGAMAWATGGHQGTHKC

SEQ ID NO: 28526 - protein, 431 aa, Bacillus coagulans
  strain 2-6
MSLISDVYAREVLDSRGNPTVEVEVYTEDGGFGRALVPSGASTGEYEAVELRDNDKSRFLGKGVETAVKNVNDTIAEAIIGRYDVFDQVGIDKAMIELDGTPNKGKLGANAILGVSLAVARAAANELDLPLYKYLGGFNAKQLPVPMMNILNGGAHADNNVDIQEFMIMPAGAPTFKEALRMGAEIFHNLRSVLKAKGYNTAVGDEGGFAPNLKSNEEALSTIIEAIEKAGYKPGEQVLLAMDVASSEIYSDEDHKYHLAGEGKALTAEEMVNWYEELISKYPIISIEDGLDENDWEGFKMLTERLGKKVQLVGDDLFVTNTEKLARGIEEGISNSILIKVNQIGTLTETFNAIEMAKRAGYTAIVSHRSGETEDSTIADIAVATNAGQIKTGAPSRTDRVAKYNQLLRIEDELAETAEFLGKKTFYNLKK

SEQ ID NO: 28527 - protein, 137 aa, Bacillus coagulans 36D1
MEQTYGNYPQSQGLGHFGSYAGGSQPYYDDDMDMMQHYCPMGQMGQMGASDGLAGQYPMAGQMYPGQHSATSMYPGMYGMPGYGQHMGLPMGPGYTGAGYGHGQMPGYPGYAGAGMGMAPGMMHGYYPGMTGRDCHC

SEQ ID NO: 28528 - protein, 431 aa, Bacillus coagulans 36D1
MSLISDVYAREVLDSRGNPTVEVEVYTEDGGFGRALVPSGASTGEYEAVELRDNDKSRFLGKGVETAVKNVNDTIAEAIIGRYDVFDQVGVDKAMIELDGTPNKGKLGANAILGVSLAVARAAANELDLPLYKYLGGFNAKQLPVPMMNILNGGAHADNNVDIQEFMIMPAGAPTFKEALRMGAEIFHNLRSVLKAKGYNTAVGDEGGFAPNLKSNEEALSTIIEAIEKAGYKPGEQVLLAMDVASSELYSDEDHKYHLAGEGKVLSAEEMVNWYEELISKYPIISIEDGLDENDWEGFKMLTERLGKKVQLVGDDLFVTNTEKLARGIEEGISNSILIKVNQIGTLTETFNAIEMAKRAGYTAIVSHRSGETEDSTIADIAVATNAGQIKTGAPSRTDRVAKYNQLLRIEDELAETAEFLGKKTFYNLKK

SEQ ID NO: 28529 - protein, 599 aa, Bacillus halodurans
MRFRKRMGKLLIWIVTVLLVVTWMPADQVVGAAETSDDQYKIVAYYPSWGAYGRDYQVWDIDASKISHINYAFANICWDGRHGNPDPAGPNPQTWSCQDENGVIDVPNGSIVMGDPWIDAQKSNPGDTWDEPLRGNFKQLNKLKEEHPHLKTLISVGGWTWSNRFSDMAATKETRENFANSAVEFIRKYGFDGVDVDWEYPVSGGLPGNSRRPEDKENHVLLLQEVRDKLDEAGQEDGKDYLLTIASGASPGYVENNKLNEIAEIVDWINIMTYDFNGGWQNISGHNAPLYYDPATANTELPTPEHFNVESAVEGHLQAGVPEHKLVLGMPFYGRGWSNCDGANQGEYQRCAPPREGTWENGVFDFSDLEDHYINKNGYQRYWNDVAKVPFLYNATNGNFITYDDEESFRYKTDFIKSNNLAGSMFWDVSGDRNGTLLTALADQLGFTPHEGQEPEEPSSAPTNIQATEVTSTTVTLTWQAPTEEPTQYSVAYDSKEKTTTHTTITIEDLQPETTYTFVVSAEHKDGIRHAGQALQVTTKSETGGDGCTAPTWQANNVYTGGDQVQHGGKLYEAKWWTTGEEPGTTGEWGVWKLIGDCE

SEQ ID NO: 28530 - protein, 396 aa, Bacillus halodurans
  strain ATCC BAA-125 / DSM 18197 / FERM 7344 / JCM 9153 / C-125
MITLFRKPFVAGLAISLLVGGGIGNVAAAQGGPPKSGVFGENEKRNDQPFAWQVASLSERYQEQFDIGAAVEPYQLEGRQAQILKHHYNSLVAENAMKPESLQPREGEWNWEGADKIVEFARKHNMELRFHTLVWHSQVPEWFFIDEDGNRMVDETDPDKREANKQLLLERMENHIKTVVERYKDDVTSWDVVNEVIDDGGGLRESEWYQITGTDYIKVAFETARKYGGEEAKLYINDYNTEVPSKRDDLYNLVKDLLEQGVPIDGVGHQSHIQIGWPSIEDTRASFEKFTSLGLDNQVTELDMSLYGWPPTGAYTSYDDIPAELLQAQADRYDQLFELYEELAADISSVTFWGIADNHTWLDGRAREYNNGVGIDAPFVFDHNYRVKPAYWRIID

SEQ ID NO: 28531 - protein, 361 aa, Bacillus halodurans
  strain ATCC BAA-125 / DSM 18197 / FERM 7344 / JCM 9153 / C-125
MRQSLKVMVLSTVALLFMANPAAASEEKKEYLIVVEPEEVSAQSVEESYDVDVIHEFEEIPVIHAELTKKELKKLKKDPNVKAIEKNAEVTISQTVPWGISFINTQQAHNRGIFGNGARVAVLDTGIASHPDLRIAGGASFISSEPSYHDNNGHGTHVAGTIAALNNSIGVLGVAPSADLYAVKVLDRNGSGSLASVAQGIEWAINNNMHIINMSLGSTSGSSTLELAVNRANNAGILLVGAAGNTGRQGVNYPARYSGVMAVAAVDQNGQRASFSTYGPEIEISAPGVNVNSTYTGNRYVSLSGTSMATPHVAGVAALVKSRYPSYTNNQIRQRINQTATYLGSPSLYGNGLVHAGRATQ

SEQ ID NO: 28532 - protein, 272 aa, Bacillus halodurans
  strain ATCC BAA-125 / DSM 18197 / FERM 7344 / JCM 9153 / C-125
MIINHNLPAMNAHRNMGINLNQGQKAMEKLSSGLRINRAGDDAAGLAISEKMRAQIRGLDQASRNSQDGISLIQTAEGALDEVHSILQRMRELAVQSSNETNVEQDQAALNDEFQQLVEEIERIKDTTQFNTQKLLDDTVDTVQLQVGANSGELIELDLTKVDLSAIHTALAAEDITDHTNAQSAIDAIDEQLKAVSEGRSYLGAMQNRLEHTIKNLDNASENLQAAESRIRDVDMAKEMMEFTRTNILNQASQAMLAQANQQPQAVLQLLR

SEQ ID NO: 28533 - protein, 429 aa, Bacillus halodurans [sequence omitted]

SEQ ID NO: 28534 - protein, 215 aa, Bacillus halodurans
  strain ATCC BAA-125 / DSM 18197 / FERM 7344 / JCM 9153 / C-125
MSNETKPKKPFYKKWWVWLIAVIVIFAAVSGGDDDSSETAQEPEPEAEEVSADQSENESEEPEEAEGTEEDTEEESAEEEDPIAGLGEALKVGDVVFTANGTSTAGSVGDVLTAEAKGTFLIVDVTIKNEGSDSITVDSSFFKLKVGDVEYDSDSSAGLYANEGADFFLTKLNPGLELPGKVVFDVPQDVLDSDDILLNVQTGFFGTQQGEIKIQ

SEQ ID NO: 28535 - protein, 160 aa, Bacillus halodurans
  strain ATCC BAA-125 / DSM 18197 / FERM 7344 / JCM 9153 / C-125
MKGKLAILAILFAVLVGVISFTRSDKPIEVQGSDSALASASSSHVEEVNDLKISLNEARVEDLADEEDMQLVIIDLTVENTSNEVKEFALYKFTLVDSEGYAHPHASNVETKGILGGQLHPDRKNRGEIAFKVPVDTSYELIYTDHLRTGQVSWEITIDS

SEQ ID NO: 28536 - protein, 204 aa, Bacillus halodurans
  strain ATCC BAA-125 / DSM 18197 / FERM 7344 / JCM 9153 / C-125
MISFLLLLFPTTGYATSDRMPTIDIETFPADVLFSVDHLKPGDWIPRELIIVNHGDDRTYVLSACFVSGSKALYNIMDVTIKDEWQTLYSGKLKDFRKLDSRALSSGEDDVLFITVTFPEEAGNEYQGLQTDIVFQIRSEGRLSTLQPPIDFPADGSMSGPGGILPQTGEAVQTWMYLIGILLLSIGIVFLIRKNRKESLEGGS

SEQ ID NO: 28537 - protein, 93 aa, Bacillus halodurans
  strain ATCC BAA-125 / DSM 18197 / FERM 7344 / JCM 9153 / C-125
MDLFFAYMLVASATPLFLWLEHRKIALTSIPFIIIMWVLALSHMFEGFLFDLHHSVFLTAFFVNVIIAHFAALVLYAYPHIRPKSRTFTESMD

SEQ ID NO: 28538 - protein, 1816 aa, Bacillus halodurans
  strain ATCC BAA-125 / DSM 18197 / FERM 7344 / JCM 9153 / C-125
MKHLSNKLLLLAMVAVLISHTFLASIGLPLQAIANATANVFTNVELKDDDGRTIDAAQFPEHTVAIDSTVQLIISWAIDGEDVAEGESHSLQIPSELNATPQQGALVTTDNEEVGAYEVVGENITLTFAEEASGSGTIAVPATFNEELVDGESELSLTFLLHGESRTIVVPFTVEEEAEEEVAEETTEESTEELTEETSEETSESESEPVTEEEGAEDEEAPIFIMSASEIAENIITGVEVRDEDGNILQADSTNHLDLGDPIGITYHWSLPNGHGYTAGSTFTFQLPDVFHLYNDIENEPLVFNGTEVGTFTITQDGTVTMTFNEMIEQLFNINGMLQVWTEIKEDLQGDVRRDIVFEVKDEELLRLPVQFRVPSASMIDKQGIVDRGYNATEITWTVDFNKQMREIDNAVLRDPIQLGQALQAGSIEVYELNVQLNGSVVQGDLVDPSNYSIGQIDGDDFQINFGDIDSAYRVVFKTDITDGDATSYQNVATLDGDNIDPMPANASVGTQRGVPIAKTSTGYNSATQTISWEIRYNYNEKTVAEADAILTDWFTNSQELIPGSFRVIRMTIDENGNATEDEEVSNFTLTETSNASQNGFELQFNEDINNAYKIVYQTTSSERVLGNQTIQNTVETGEGRTAGANRSIGQVVFHKRHGTPNYQEKTIPWTITLNDDSYEMTNVTITDVFNNGGLTLIDGTFTIRSGSTTLVQGVDYTFALDGADGFTIEFTNPITTPHVIEYVTAFDYEARQDKSRNVLDNVATLEWVPEGETDSRSMQATAVFAPDSNTRNNGFKNGSYNAVTKEITWNIGVNYNLQELHDAVVEDFIQEGQHLVADSIEVFEMGLTGGANGVNQGDLLTEGVDYDLVMVQDGDGNPGFRVEFRDTIDSPYWISFKTSLDERLIKQTYQNEAILSSSNTDDFRLDAAVSVQHGGEYVNKSGVQDGRVIDWRININYTQSTVTNAKIVDVPSPNQILLEDSFQLFSTNVATNGTITKGAPLERGVDYILEIFTDEDGNETFELSFPNVIDRAYILEYKSFIYAQNNEFVSNQVSFEGDEITTNESTNSSESIQVRLSGGSGTGSGERGSIEVTKVDATSGETLAGATFVLYDSTGEIVLRTVVTGEDGIATFANLMYDDYILRETSAPEGYLVGINDSEHITLNTELHELTVENAKIIRDVQLHKIDDETGESLQGAVFTLQQRQGSDFVDYRENLETDENGVVAVEDLEPGDYQFVEVAAPSGYVLNADPIPFSIGEEQTEVIELTKENEIILGSVELVKVDRDDSSIVLEGAEFSLLDEDGNVLQTGLTTDDEGKLVVSDLRPGNYQFVETTSPEHYLLDDTPYPFTIVLDQQEQLTVTATNRLIPGSVQLVKVDADHPAVVLEGAEFSLLDEDGNIVQEGLSTDANGQLIVTDLRPGNYQFVETAAPEDYILDATPREFTIERSQEEGISIVVENELIPGSVRLVKVDVDDPSIVLEGAEFSLLDEEGNILQEGLMTDENGEIVVNDLKPGNYQFVETAAPEHYLLNSAPLTFTIERSQEEQLTVTATNRLIPGSVQLVKVDADEPSVTLEGAEFSLLDEEGNILQEGLTTNEAGELVVSDLRPGNYQFVETAAPEHYLLDETPLTFTIERSQEEQLIVTAMNRLIPGSVQLIKVDSEDSTITLEGAEFSLLDGEGNVLREGIRTGENGQFVVVDLRPGDYQFIETKAPTGYELDDTPIVFTIEKSADEVLTLVVENTVTPKPDPSGPGGGSKDPGDSTGTGDSEKPGDSNNRIDRLPQTGEEFLTFLLILGLLLMTAGGVLLLKRRNVAEC

SEQ ID NO: 28539 - protein, 262 aa, Bacillus halodurans
  strain ATCC BAA-125 / DSM 18197 / FERM 7344 / JCM 9153 / C-125
MVRQNLTKCCRLIVVHTAVLGLLMLAGIQVASAHGYIENPSSRALLCQQSINQDCGAVIWEPQSLEAPKGFPGPSIPDGQIASAGGVFPKLDEQSSTRWSKVPLSSGTQTFTWHLTARHATAKWHYYVTKPNWNPNEPLTRDQFELIPFYEQYDGGARPGEKVTHEVTIPERTGYHVILGVWDVADTANAFYNVIDVEFGNGNDTPPVDPSPQPPEPSPYPIWDATTVYLGGDRVLYEGRAYEARWWTLGEVPGSADVWRPL

SEQ ID NO: 28540 - protein, 682 aa, Bacillus halodurans
  strain ATCC BAA-125 / DSM 18197 / FERM 7344 / JCM 9153 / C-125
MNRGETGYETWLRYEEITDSALHTQYRAYFQTIEIKGNSPIIESAKEELMQGLRSLLGVTPKCLSATGEQASCLIGTIADVAEVSQAIKERLREEGYAIYSEKGRLVLVGKTETGVLYGTFHLLRLLQMRDHLHDLRIVENPRNQLRMINEWDNMDGSIERGYAGGSIFFEHNKVTNNLQRIKDYARILSSIGINAIAFNNVNVHEEETKLITRKFLPDVAKVANIFRQYGIKTFLSINYASPIQLGKLETADPLDEKVRAWWKETVADIYRYIPDFGGFLVKADSEHRPGPFTYGRNHAEGANMLAEALAPFGGIVLWRCFVYNCLQDWRDRKTDRARAAYDHFKPLDGLFHDNVVLQIKNGPMDFQVREPVSPLFGAMPKTNQMLEFQITQEYTGQQKHLCYLVPQWKEILDFDTFANGKESPVKSIVDGSQYDYKVSGITAVSNVGNDENWTGHLLAQANLYGYGRLTWNPNLSTEEVTTEWTRATFGDNEEVIQTIHEMLLQSWLIYESYTAPLGVGWMVEPGHHYGPNVDGYEYSVWGTYHYADCHGIGVDRTVATGTGYTAQYFAENYELYEHLETCPDSLLLFFHHVPYTHKLKSGVTVIQHIYDTHFSGAEQAEQLLESWRSLEGKVDSERFQQVLERLEHQAEHAKEWRDVINTYFYRKSGIPDEKKRTIYPI

SEQ ID NO: 28541 - protein, 599 aa, Bacillus halodurans; identical to SEQ ID NO: 28529
  strain ATCC BAA-125 / DSM 18197 / FERM 7344 / JCM 9153 / C-125

SEQ ID NO: 28542 - protein, 792 aa, Bacillus halodurans
  strain ATCC BAA-125 / DSM 18197 / FERM 7344 / JCM 9153 / C-125
MNKRLKRWSAIMSIVLLVNLLVPVGTFADTDEEEKVDIIVTYKDVVSESPDSRLSVYENEQTMKTLPIKTMTVPVSEVERLKEDPNVVSVSLDQPLQLMSDTRELGEHDWNNDMVKAFDAWDDGYTGKGVKVAVFDTGFDGHQDITYAGGHSVFEGEPYTHDHHGHGTHVAGIIGAREGTLHQGIAPDVQLYGVKVFSQEKGGNTSDLIAGIDWAIQEGMDIINMSLGYTNEVPAVHTAIKQAVAQEILVVAASGNGGKADGSGETIEYPAKYDEVIAVASVDKEMKRTNTSATGVENELAAPGHLIGGLAPGNKYVFMSGTSQATPHVTSLAAILMGKHPELSSQQIRALLVEQSLDLGSEGHDRLYGYGLAQYVSSTPPDEEENEESPAENPQEQPSDGKENEGSEDQGSTPPDEEENEESPAEDPQEQPSDGKENKGSENQGSTPPDEEENEESPAEVPQEQPSDGKENEGSEDQGSTPPDEEENEESPAEDPQEQPSDGKENEESKNPDSAPPAGEKEGKQTARVQVKPVNLGGVAIVSNADVASVLDNGTLVVFFDSALDDLTRLALTADQVKELKDRGITLVIAKHDLELVIPHGVFKAGDVVIEFERVVGKGIPYAGQAKSTVYQFKIIQNGQQVRHFDEEIEMGFRVDQEKNVNNLKIYYWNESLNEWEKIGGNYQEGFIVARTNHFSTYTVFDSAVFEETKSGTPISGGKTNGNSTTEGTTNRGTSKNGTGSEPQAEESNEQNNKDGTLPKTATNLYNSLAIGALLLLIGFVLLRKSKRRIVE

SEQ ID NO: 28543 - protein, 1661 aa, Bacillus halodurans
  strain ATCC BAA-125 / DSM 18197 / FERM 7344 / JCM 9153 / C-125
MKTLKHISYKLRIFALIALLISQTLLTSLSLPFQAVANSEKSGLTNVEITDANGQTIDADQFPDRFVSIDSILQIILSWSVDESVAQGAEYSLNIPSALVVSSHGGVLTTTDSQEVGTYEVKDNGEVTLQVNEKGNGTLIVEAAFNKDEVHGKSEVPLTFHLDDETRTITVPFTVEEKTEEAVEPASESETEATIEQHKEDEEEEMVALTTQSTEASGSEITENILTSVQLKDEEGNLIHANENPDLRPALGSAVEVIYNWKLRNNHGYTAGSTFTFQLPDAFRFYNNIENEPLVFTQANTTVGSFNVTTDGTVTMTFNESIEQLSNIRGNLHLWTEFREDLQGDRLQVIHFEAKDEVIASIPVEFENATGHSIDKRGVVDQTFNATEIKWTVDFNKQLQPIEQAILKDPIQTGQALRAGSIKVYELNVQLDGSVVQGAEVDPSSYTIEQVDGNDFQIVFGSIDSAYRVEFITDITNRNATYYMNRATLTGENIDDLSADAGVWTHRGTPLSKASTGYDPATQTITWEIKYNYDGKLIRQADAVLTDLFTNSHILLDDSMKVYRVTINEHGNEVSTEEVSNYSVNGTSDEDHNGFVLQFTEDVQDSYKIIYQTTAAERGFEDATIENTVTTGDHEAKTSRTVHQQTFNKWRGQIDYAKKTVAWEYFFNEERQELTNVIISDVFANGGLTLIEDSFTITSFPSTDEEVTLENGNDYRVVTNETGFTIEFMAPITEPHHVRYETTFDFDARDDKNKAFLENGATLQWQTSSGNTMKKEGKSEFHPDTFTRNNGFKNGLYNATSKEITWNIGVNYNLHTLEHAIVEDFVREGQRLLMDSIEVYEMGLLGWWDGVSQGSKLEEGTDYVIEAVEDGEGHPGFQVRFLNTIDSAYWITFKTSLEDTLIKSNYPNRATLKSDNAEDFNVDASVSVRHGGEFVTKSGAQNGRLIDWSLNINFSQSSISNAKIVDEPSVNQILLEDTFRLYATNVQPNGTMTKGDELERDKDYTLDIRTDGEGNQHFELQFTEDIDTGYILEYQSFINARNGDVVTNNVKLEGDQLTTEEVTESSGAVSVRLSGGAGTGSGETGSLEVTKVDADTGEVLQGATFTLYDSEGEFAIRTLETGEDGKATFVNLLYGDYLLKEDSAPEGYLVGINDTQRVTIDTVLHEVTVENEKSDINRVSAVGAVQLQKVDEETGESLQGALFALQQKVDDEFVTIAEMETDEEGIVFAGSLEPGDYQFVELNAPVGYKLDETPVVFTVEEDRTETIELQKENHLIPGSVQLVKVDADDAANTLEGAEFTLLDGEGNVVQEGLTTDENGQVVVTDLKPGEYQFVETKAPAGYELEATPIGFTIERNQQEVATVAVENHLIPGSVQLVKVDADDAAITLEGAEFSLLDGEGNVVQEGLTTDATGQVVVTDLKPGEYQFVETKAPAGYELDATPIGFTIERNQQEVATVAVENHLIPGSVQLIKVDREDSAVTLEGAEFSLLDEEGNVLREGIRTGENGQLMVIDLKPGDYQFIETKAPTGYELDDTPIAFTIEKGTDEVLTLVFENKLTPEVPESPENPENPENPENPEIPEDLETPESPENPETPESPKHSEDSEVPNSDKNPEKSSDSNNRIDRLPQTGEEFLTFLLILGLLLMTAGGVLLLKRRNVAEC

SEQ ID NO: 28544 - protein, 162 aa, Bacillus intermedius
MKKISSVFTMFALIAAILFSGFIPQQAYAETPLTQTATNETATIQLTSDVHTLAVINTFDGVADYLIRYKRLPDNYITKSQASALGWVASKGNLAEVAPGKSIGGDVFSNREGRLPSASGRTWREADINYVSGFRNADRLVYSSDWLIYKTTDHYATFTRIR

SEQ ID NO: 28545 - protein, 430 aa, Bacillus isronensis B3W22
MPFITQVYAREVLDSRGNPTVEVEVFTESGAFGRAIVPSGASTGEYEAVELRDGDKGRYLGKGVEKAVENVNTIIAEELEGQYSVLDQVVIDQALIELDGTENKGKLGANAILGVSMAVAHAAADYLDIPLYQYLGGFNSKQLPVPMMNILNGGAHADNNVDIQEFMVMPVGAKSFKEALRMGTEIFHNLKTVLKEKGHNTAVGDEGGFAPNLGSNEEAITVIIEAVEKAGYKMGEEIRLAMDVASSELYNKETGKYVLAGEGVEKTSEEMVAWYEELTSKYPIISIEDGLDENDWAGHKLLTERIGDRVQLVGDDLFVTNTTKLSRGIEEGVGNSILIKVNQIGTLTETFEAIEMAKRAGYTAVISHRSGESEDNTIADIAVATNAGQIKTGAPSRTDRVAKYNQLLRIEDQLGATSRFEGLKSFYNIK

SEQ ID NO: 28546 - protein, 269 aa, Bacillus lentus
AQSVPWGISRVQAPAAHNRGLTGSGVKVAVLDTGISTHPDLNIRGGASFVPGEPSTQDGNGHGTHVAGTIAALNNSIGVLGVAPSAELYAVKVLGADGRGAISSIAQGLEWAGNNGMHVANLSLGSPSPSATLEQAVNSATSRGVLVVAASGNSGASSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 28547 - protein, 269 aa, Bacillus lentus
AQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 28548 - protein, 592 aa, Bacillus licheniformis
MKIVLVNKSKKFFVFSFIFVMMLSLSFVNGEVAKADSGKNYKIIGYYPSWGAYGRDFQVWDMDVSKVSHINYAFADICWEGRHGNPDPTGPNPQTWSCQDENGVIDAPNGTIVMGDPWIDAQKANPGDVWDEPIRGNFKQLLKLKKSHPHLKTFISVGGWTWSNRFSDVAAGPAARENFAASAVEFLRKYGFDGVDLDWEYPVSGGLPGNSTRPEDKRNYTLLLQEVRKKLDAAEAKDGKEYLLTIASGASPDYVSNTELDKIAQTVDWINIMTYDFNGGWQSISAHNAPLFYDPKAKEAGVPNAETYNIENTVKRYKEAGVKGDKLVLGTPFYGRAGAVVNQGGTENIRNADRLKKGHGKRAYSIFQILKGTYVNQNGYKRYWNDQAKVPFLYNAENGNFITYDDEQSFGHKTDFIKANGLSGAMFWDFSGDSNRTLLNKLVADLDFAPDGGNPEPPSSAPVNVRVTGKTATSVSLAWDAPSSGANIAEYVVSFENRSISVKETSAEIGGLKPGTAYSFTVSAKDADGKLHAGPTVEVTTNSDQACSYDEWKETSAYTGGERVAFNGKVYEAKWWTKGDRLINPVNGAYGG

SEQ ID NO: 28549 - protein, 598 aa, Bacillus licheniformis
MKIVLVNKSKKFFVFSFIFVMLLSLSFVNGEVAKADSGKNYKIIGYYSSWGAYGRNFQVWDMDVSKVSHINYAFADIRWEGRHGNPDPTGPNPQTWSCQDENGVIDAPNGTIVMGDPWIDAQKSNPGDVWDEPIRGNFKQLLKLKKSHPHLKTFISVGGWTWSNRFSDVAADPGARGNFAASAVEFLRKYGFDGVDLDWEYPVSGGLPGNSTRPEDKRNYTLLLQEVRKKLDAAEAKDGKEYLLTIASGASPEYVSNTELDKIAQTVDWINIMTYDFNGGWQSISAHNAPLFYDPKAKEAGVPNAETYNIENTVKRYKEAGVKGDKLVLGTPFYGRGWSGCESGGHGEYQKCGPAKEGTWENGVFDFSDLEKNYVNQNGYKRYWNDQAKVPFLYNAENGNFITYDDEQSFGHKTDFIKANGLSGAMFWDFSGDSNRTLLNKLAADLDFAPDGGNPEPPSSAPVNVRVTGKTATSVSLAWDAPSSGTNITEYVVSFESRSISVKETSAEIGNLKPGTAYSFTVSAKDADGELHTGPTVKVTTNSDQACSYDEWKETNAYTGGERVAFNGKVYEAKWWTKGDRPDQSGEWGVWRLVGGCE

SEQ ID NO: 28550 - protein, 580 aa, Bacillus licheniformis [sequence omitted]

SEQ ID NO: 28551 - protein, 598 aa, Bacillus licheniformis
MKIVLINKSKKFFVFSFIFVMMLSLPFVNGEVAKADSGKNYKIIGYYPSWGAYGRDFQVWDMDVSKVSHINYAFADICWEGRHGNPDPTGPNPQTWSCQDENGVIDAPNGTIVMGDPWIDAQKSNPGDVWDEPIRGNFKQLLKLKKSHPHLKTFISVGGWTWSNRFSDVAADPAARENFAASAVEFLRKYGFDGVDLDWEYPFSGGLPGNSTRPEDKRNYTLLLQEVRKKLDAAEAKDGKEYLLTIASGASPDYVSNTELDKIAQTVDWINIMTYDFNGGWQSISAHNAPLFYDPKAKEAGVPNAETYNIENTVKRYKEAGVKGDKLVLGTPFYGRGWSGCEPGGHGEYQKCGPAKEGTWEKGVFDFSDLERNYVNQNGYKRYWNDQAKVPFLYNAENGNFITYDDEQSFGHKTDFIKANGLSGAMFWDFSGDSNRTLLNKLAADLDFAPDGGNPEPPSSAPVNVRVTGKTATSVSLAWDAPSSVANIAEYVVSFENRSISVKETSAEIGGLKPGTAYSFTVSAKDADGKLHAGPTVEVTTNSDQACSYDEWKETSAYTGGERVAFNGKVYEAKWWTKGDRPDQSGEWGVWRLIGGCE

SEQ ID NO: 28552 - protein, 563 aa, Bacillus licheniformis
DSGKNYKIIGYYPSWGAYGRDFQVWDMDVSKVSHINYAFADICWEGRHGNPDPTGPNPQTWSCQDENGVIDAPNGTIVMGDPWIDAQKSNPGDVWDEPIRGNFKQLLKLKKSHPHLKTFISVGGWTWSNRFSDVAADPAARENFAASAVEFLRKYGFDGVDLDWEYPVSGGLPGNSTRPEDKRNYTLLLQEVRKKLDAAEAKDGKEYLLTIASGASPDYVSNTELDKIAQTVDWINIMTYDFNGGWQSISAHNAPLFYDPKAKEAGVPNAETYNIENTVKRYKEAGVKGDKLVLGTPFYGRGWSGCEPGGHGEYQKCGPAKEGTWEKGVFDFSDLERNYVNQNGYKRYWNDQAKVPFLYNAENGNFITYDDEQSFGHKTDFIKANGLSGAMFWDFSGDSNRTLLNKLAADLDFAPDGGNPEPPSSAPVNVRVTGKTATSVSLAWDAPSSGANIAEYVVSFENRSISVKETSAEIGGLKPGTAYSFTVSAKDADGKLHAGPTVEVTTNSDQACSYDEWKETSAYTGGERVAFNGKVYEAKWWTKGDRPDQSGEWGVWRLIGGCE
